United States Patent 9,328,346 (POLYCOMB-ASSOCIATED NON-CODING RNAS) - sequence listing, part 99

SEQ ID NO: 18567 - RNA, 53530 nt, Homo sapiens
cggugcgccgcgagggccgccgggacgggucucccuggcgauccguggugugccgcuacugccggugcagccgccaaaccggugccucggugacgaccgugucccugccgucuuccucgagcuccccggggcuugacccccggggcccucggcaggcaucggugaggagccugcggagcgaaccugugcuccuauucuugcccuucaggaccccauaucgcgacuccgaggaggggaagcgagaggggcugucgcgacuccgcgccgugugucgccgggcggggccgcggggccggggcuccuucagcccccgggaugcgcgcgcgagcccucgccuccacuuccuuguugcugcugucacgacuggagccgccucucgccgacagcggggagcgcgagugcgccagccaucccccucguccagccgccgggccaagcgccuccgggaaugugagcggcgcagcuugcacgcuccuccggguaagucccgccuucgagggccgcgccgagccgcugggcgaccucgaguuggaugcugcggcucucugagccucuacugagucuuccacaaaguagggccacugagccuuaguguccuccuuccgcaauccguaugggacauucggaugucccagacgucuuagcuugaccaagacuuugucugguuuggcucuugcuucauucaugacccagaaugagggaaaggagcuagcccagagucaaacuguggcccauggcugagcccucaaaggcaaucucgugagauuccaaggaggaucugaugggacagagaaagugucucgcauauuucagguauugaccuuaacucuguuuuacagaugaaauaacggagacuuaggguaaguagauugcuuaaggucagagguccccgugcuggugcgacugguguagucuguacuagaacccggauuuucuguccucuagagcccuucguuuuuaaccuuaaauuguccugccuuuuuuugcauugcuauacugcugccucgagucugauaacaaacuuguacucaggcuuagaacaggguaauaaaacaaacaaaaccguaggguguugucuuccugcccucagcccaagguggcuguaaugaguguuuccuaacccguuuugcgcagggugcuuaguacccuauaugccauucauuacagaugcucuccugcaguuacugcccuucuccacaaggcuuucagccgcccagaagucaauucagggcaaaaaagcgcaguccccacguagccuugauuugaacuacugcuucccuuauccuuuacuggccuauugcuuacccagccaaguuguagacuguguucucuuccuggguugcacuauggcaguuagaauguagguuuuuguuuuguuuuucuuuguuaguuuaguuuuuguuuuuaauaggaagaggaaucauuuagagaugacagagaacuaggaagaaccuaaggaauaaugugugcuuuaccugggguauauccugaaaauuauaggugaaauacagugugucugcaauuucuaggagagguuuuuuguuguuguaguuguuuguuuuuuuaagcuuucgcaacauugucaaaagaauucuugccuccaaaagacuaggagccacuggguucauccuuuucucacaguagaaacaguugaaauuuaggauguggaauagacuucucugagaucauaagguuagaguuuaggucucuugacuccacaugcagugcucauuauaccuuauuuguggagugaggucuaaaugagaggugugugggcuuuguacugcacguaucagucccauauuuaccaccacaacugccucuucccagaauucuaaauuuccuccugacagauuuucaggggcaacuauguuauuuccucuuguaaaauucaagugguuucugugagccuuucucccuccaaggauugagacuugugguaaaaguccaauuuagaacuuggcuacaaaaaaaacuaacucuucuugaacugguuauuaaguuuuuuaugccucuuuuccuagacauaaaagcuguuaguagauucucuguuuuuuagcccagcaccagagagcugauguugguuggucagaugacuguuuagaucugugcugucucuagcuccuagcauauguugcuauuucaguuaauuacaauuggccagguguggugguggcucaugccuguaaucccagcacuuugggaggccaaggcaggaggauugcuugagccuaggaguuugagaccagcuuggauaauauaaugagaucucaucucuacaaacaauuuaaaaauuugccagacuugguggugcacauguguagucccagcuacuugggaggccaaggugggaagaucacuugagccugggagguggagacugcagugagacaggaucucaucacugcacugcagcccaggggacagagugagaccuugucuuaaaaauaaauaaauuuaaaaauaaaacuaauucaauucuucagucacacuagccauauuucaagugcucgauagccauauguggcugguggcuacuauauuugacagcacagauguagaacauuuccaucaucagaguuuauugaacagugcugguuuggaggguugccaguagagauggauagcaguguagcauaaugaaagaaggcccagggaguuggauuuuugaguuaaaaaucuaucucucaagucccugcuugggcuugguggccuugggaagguuguuaagcaucucagacacagauaauagucuuuaacagaggcuagaugugguggcucacgcuuguaauuacagcacuuugggaggcugagguaagaggaucgcuugagcccaggaguucaagaccagccuggacaacauagcgagauuucaucucuauuauuauuuuuuaaauuauauaaaauuaaaaaaaaaacuuaaugaacucuuccauuuuuuuuucugccaauuaccugacuuuaggaaugaacccagcagggcacaguguaaucccacucaugccuguaauaccaacaguuugagaggccaaggugggcagaucgcccgaguccaggauuuugagaccagccuggccaacauggcaaaacccuaucucuccaaaaaauuagccaggcgugaugacaucaccuguagucccagcuacucaggaggcugagguggaaggauugcugagcccaggaggucaagacuguagugagcccagagugugccacuguucucuagugacagagugagacccugucucaaaaaacaaaaacaaaaaacccaaaaacaaacccuuuucauuugcauagcacuugacuauuuucuuuuuuuuuuuuuaauuaaaaaagauuuuuauuuuuuuaauagagauggggucucacuauguugaccaagcuggcuggccucaaacuccuggccucaagcaacccucccaucucagccucccaaagugcugagauuauaggcgugagucacugcgcccauccaauuauuuuuaaauagaguugugucuauuguauccuuugagucuuaucacuauaaaucugugggaagguaguugagacaugucuuuuuuuauacaugagagagaaagcugaacaaaaagcagcuaaaagaccugaccaaaauugcacaagcuggcagaguauaaagaaaucuuuuacauacaggcccuuacuacauguuugagugaaucaaugaagggauuugcuuaaguugaugaaacauaggaggaaugggccagaacuucugauuccuggccaagcauuuuuuuuuaaccuguuuccauauagaauuguuauaauuuggggcuaauaaaucuuuguguuaaagggguggguggguacuguaucccaugaauauaagugaaaaguauuucuaaggcaguggucacaaacuugcccggucugaggaaucaccugaggcauuuguuaagcauguggauuuccauacccucgggagauucugcuccaggagggcugaaguggagcucuggaaucuuguguguuaaacaaccaagccaggugcuucuuaggauauauuggguuugggaaaugucuaagccuuaaggcacuggcagagguaagggguuauuugaucaggaagcugcugccccucuuaggggagauucuggaaacuuuauuuugacuuuccuuuccuuuagccauggacgcaucauaugaugguacugagguaacugucgugauggaggaaauugaggaagccuauuguuacaccucuccugggccacccaagaagaagaaaaaguauaaaauacauggagaaaagacaaagaaacccagguuagccaacacauuuugguugcugcuagcauuuauaaacagaaguugcuuggagagcugcauugaggaaaacuuuuaagacucuuugaaaaagaguguuaugauugaaguccugugucgagggaugaggagugggaaguggagggauuucugccagcauugccauuacuggccagacuuugcuuuuguuuucaaguugucacaggaaauuguaccauacugaugguagaagcuagguacaaaagagcuacauuauuuauuauuaugccauuguuguuauuuaaacauuuaaaacaaagcauuaauaaaauuacaaaauuagaaauaaggcugggcgugauggcucaugccuguaaucccagcaguuuggaaggcugagacggguggaucaccugaggucaggaguucgagaccagccugaccaacguggagaaaccccgucucuacuaaaaauacaaaauuagccgggcgugguggcgcacaccuguaaucccagcugcuugggaggcugaggcaagagaaucacuugaaucugggaggcggagguugcggugagccaagauugugccauugcacuacagcuuggccaacaagaacgaaacuccucucaaaaaaaaaaaaaaaagaaaagaaaaagaaaaaaaacacacaaaaagaaauaauaccaauuauaucuguacagaauauccaaauuguagcucuaacuucacucuugacugugaauaccucaaacuugugaaacuaccagcauuggucauuuugauuggucugcuugcuucccucucucauccuuggggaggugccauugaccagguuggugaccaaaggcugcguagaggagcacggagugugagugauaaccagccccuugaggaagcuuucccugagaguggaaugacaggacaggacaccuguaucuaucuuugcuuuaaaaucauuccugcacaaaaagcgaucuuuaggaaagccagucaaaugagccuuugcuuccagguuucugaaggggaaacagccacuugcuaucuuuaccauucauuuuccccuccucccuuggagccccuuaucuuccuggguaguuacuccugacuguaauauaguggcucuaauguaguaacuuuaauaugguagcuuauauaagcauuucuccuauaccaugaguuuuuauauuacaaauugaauguaauauaauuuguguuguacugacagcuaucaguuauaaucaggaauaagauuauaacuuauuauaacaccaucugaggauguuauuuaaauguuuguuugcuugacuuucagucccuauuuagauaaaugcuuagaaaugagaagcuagguuuuaucaaccucuugacuacccauaucuuagcauaguaguacuuacugguugaaugaaguccugggucgagggauggggagugggaaguggagggauuucugccagcauugccauuacugggaaagccugaagaagucauugcuuccucaggucugcuuaccuucuguacuauuacgacaucuaccugaaagugcagcaggagcucccccaccucccucagucugagaucaauaagaagauuagugagaguuggaggcuucucagcguggccgagaggaguuacuacuuggagaaagccaaacuagagaaggaagguuuggauccuguaaguaauuuuuuuuuccagcuauuuuuuccacugguucagugaugaaggccuugggaaaaccaagccccuuguucuguuuccuuuucuuuuuuugggaaaaguuucaucguuuuauccuucuugacucugggcuugcuuguuuccauuuugauaaugcccugcacucucuuguccucuucgguugcagcaauacguggagcugacauuuuuuuguguuuucugcagugagccuuagguuccuuuucuaaauuuuaguguaacuuggagccccucauaguuacuauaaauaguagcuuuaauguaguaaacuuuaauauaguaguuuauauaggcauuucuccuacgccaugaguuuucauauuacagauugaauguaguauauuguacuaacugcuaucaguuauaaucaggaauaagguuugcauguuuagagguagauagagcugcuuguguaauacaguaccacauuauuuuguuagcacuggugguuggaaacuaugcugaaagcaaaaaugcaaguaaagccaaagaugguggaggagaccaaggcuuugggugcuuggguuaaaggacuaacaaggaagcauuuagaauuaugucugucagcauuuucuuauuucuaguucacaguaacaaaauacacugacagcuauuuaaacugcuggguuuuuguuuuuuugagaguaucccugucauggcauaaacugcuguuuuuuuaaacugaaauuccugcaggaagaauaaccuugcuguugcaggcuggaaccuuuuauccuuaacuccuuauuucaauagaaacaguugucuguaacuucuauuuugguaauguagagcaacagcaacaacuacguuauagcagaacagguuguauuuucccuuauuggagcucaucagcuacugccauuuaaauuauuuugugcuuauuggccuggcauucuucuuucugggagagcuuugucuuaccuacaggcuuggagaugcuacucucugcucccuccucuaggugauuuguuuauuaacagugaaucugggaaauaaucccuauaguggaguggagauggagucuaagaaaagcuuaucuacucccuuugguuuccuuauuauaauaaaaucagcugucuaggcugggugugguagcucaugcccguaaucccagcacuuuaggaggcugaggugggaggaucacuugagcccaggaguuuaagacuagccugggcaaguuggcgaaacucuaucucuacaaaaaauaggaaaagauuagccaggcgugguggcauacaccuguagucccagccacucaggaagcugaugugggaggaucacuugagccggggaaguggagguugcagugagccgugauugugccacugcacucuagccugggcaacagagugagacucuguuucacacacacacacacacacacacacacacacacacacacacacaaaucagcaaucuuuuugugcaugauaaaauccuacguaauccuggagugauuugauuuuuaaaacuacacacuaauguagaucauuaucaagacuuuaaaaaaauuuaaaucaucugcaaugauucuuccuuauuuacaugcuuauuucuaucuaccacuaucucuaccacugccaccaagaacaugaguagguuaguucugauaauagcugagugaccauuuuaacuuuugagucuugguuuccucaucuguaaaauggcaguagucucuucucauaauguuuaaaauagguaauguaaaucaccuagcugaauucuugauaauacugacauaauaaauauuacccuuuaguagauuaaacauucauugacuauauaauaaggaaaaguggcauuuauugaguaccuggaauguaguaagacugagugaagcuuuaugugcuguguuugaccucucccagacugccuggugugaugggaagacccucaaugcccacauaccuugggagccugucagagcccuguggcaggcuguccuccuuagcagcccuucaggucucuugccaagugcaggcuccagugauaugccuucuagucuauaaaaugaguaucauucaggccuuccagguuucuuugugcuuggauuuguuaaguccaggccaugcuguguguauuugccaccauuuagucuuguucuccuaacauggcugcuucaaaggguggcuugagaaugccauuuccccauuaccucuccaauaaaggcuccauaaaagauucaguccaucugcuuuuauguuucaucugagugcugcuuuuaacuuuucauuucugagugcuuccuuuaugccuuaaguagucucaucgacuucuugcuuuugauuuauugaagaauccuuuuguaguugacuuuaguguucauuuuaaaagauacuucugaaauuuuuuuuuguucuguuuaauuuuaggucucauuuaacuguucacuuugaacuuuucuguuuuccuuauugggugccuuuaaguuuaaauugaaaaaauaaaacauaaaugacuuuuucuuggugccaauuagccauucaggacugugcuuuuuaguaccuggccuucuugauacuuagaagaccuggccuggagucccagcuuuacuguuuacuaauuuuguguuuagggaaaguuuaccucccugaguuucauccuaaauuuucucauuuguuaaaugggaauaauaaucuuaucuaacauaauaguguuguuuuuaagauaaaaucagauaauguguuugaaaacauuuucuaaaccugaagguacugggucauuguuaauauucacauuuuuuuccguaguauauucaggaccuugucacauaaccccuucuauauauacuuucugucacgaagccuucuaaugaagacccuuagcuuugugaucuguucauccucuucuuuguaagucuggggaaaaccagugaggucagaaugcuuacuugcugccuugaguuucaucuuagccuguuaacuuguauuuuaugcuuuuuggguuuuuauugagcguuauacauucuaauguuugaaucuuaugcugcuuuggaauccuaaaguaucagagcucaaaaggaacucauaaauugccagauucagcucccuuguuuuacagauggggcagcugaggccucaggaggggaaaggauuugcucaaggcuaugccagaccucagguucuagcucacaguuucauauggcaagaccagugcucuuuccagaguucaguccaugcuguuuccugugugacugagugaauaagcuacauuggcuaaagugugauucaaaugaagaugacacugcuguugacaggggcugaccuuaucugaauuaggucaagagaguagaguuuuuccagucccuuuugcaggaaaaaaaaagaacuuacacauauauauauaucuuucucucuccauguggucuuaguccauuuaucucugcuugucucccccuuccuggcuuccucauccucagaacucuaagcucucugcacugacugcugugguuccggacaucccagguuuccgcaagauccucccacgcucagauuauaucaucauccccaagagcagccugcaggaggaccggagcugcccucagcuagagcuauguguggcucagaaccagauguccccgaaaggaccuccucuuguguccaacacugccccggagacagugcccagccaugcaggcauggcagagcagugccuggcuguggaggcccuggcugaggaggugggagcccuuacccagucaggugcuguacaggagauugccaccucagagauccucagccaggaugugcuccuagaggacgcuucccuagaaguaggggagagccaccaaccuuaccagacaagccugguaauugaagagaccuuggugaauggcucaccagaccuccccacuggaagccuggcugugccccacccccagguuggggagaguguaucagugguaacagucaugaggguaaguggcuuugguacugaagucuuuggcuuugucuggaguuacuuaaagggcagcuagcaccauacagugugauuccagagcagugguaaucaagaguacugguguggcacuuacugauacugcaguucucuugaaugugucuugccccugggcucacuccagaguuccuugaaauuucucaggcacucuuaccaacucuuugcccagcuuagccagaauuuucuucacaugagaugguucauaagcuacauuagcaagaaagcugcaaauuguauuugaauuauccacgagucaaagcuaggaucugucaggcaauuuaguaucagucaggauuuuauguuuucugaagacugcuuccuuuucuugaaaugggauuucacucuguugcccaagcuggucuugcauuccugggcuuaagcaguccuccugccucagccucccaaguagccaggauuauaggcuuguccaucacacuggcucccugaagacuauuucagcaaacaauggcaccuugagcuguguacaagaauuuucacacaagaccuguacccaggucuuccuggauucagaugggguaggaagaaaaaaguuaucuucaaggccagguugaugggacuuaccucugagaaagaggaagcaaguuucuacaguggccuaagugucauucucaguugaggggaaaacagcacuuuuagugaucccaacaaccucauccccuagaaguggaaguggagagaaacugcuaccaugccauaguauaauauauaaccuguccucuauaaccuuggagaggauagcauucucagagaugggagucuuucugugcaggcuaagaggaccagcuugcuguagcccuuauggccugggcagaagagaacaaguaccccugcaaucugucccagggcuaaauccuuauuuguugccucagugcuguuuaugauaaugaagcgugcaacuagccgguuguuguuguuguugguuguuuuuuuuugguuuuuuuuuuuuuuuuugagacggaguuuugcucuugucacccaggcuggagugcaguggcacaaucucggcucacugcaaccuccaccucccggguucaagagauucuccugccucagccuccaaguagcugggauuacaagcaugcgccaccacgccuggcuaauuuuuguauuuuuuuuuuuuuaguagacauaggguuucaccacguuggccaggcuggucuugaacuccugaccucaggugauccgcccgccucggccucccaaagugcugggauuacaggcgugagccgccgugcccggccgccacuagccuguuuaaagcagguaaauagggugcugagaacacuugaaaggguuagaauuggauucucucacuaacugcuuaugugaucuuagaaguccuaaaugucuuagaaccucaguuuucucaucuauaaaauaaacauagcacacuuccuguggaaauaguuuucucuuuguucuuaaacuuuuugagauaaucauaaauucauuccuuuugauaagcacauugggaugaguacacugucuguuauuaaacuuaauccaggcuuccaguguugaguggccuggguguucuuuauuacucuguuucagugaaacuguccuucucuucauugcccauaggauuccagugagaguagcuccucugcaccagccacacaguucaucauguugccucugccugccuacucgguuguggagaaccccaccuccaucaaacuggucaguacuguaugugggggauugauggcaauuagggugucauaagcauuuuuuuucuaaguagauuugucuuuuuuucuuucugagcuaccaguuguaggaccaagaagauuucuaaaagucuuagaaccucaggaugcgaggacuggcaaagauuucagggauuaugugguccauauguucuuaaugggggugaggggguuguagauagaucuccaugggauccaugaacucaccucaaguuuuauacaaacuuuuuuccuggaauggauuccaugacuuuuauaaaauuuucguaagcauacaugauuuaggaaaaugagcagccacugaucuaauucaauacugugaucguacagauuaggaaaagggccauaggagagaaaggacuuguucaagguuacaagacaagucagacuggauucguuucuugauucccaguugauauuuuuuucagcaucggggcugagauuuaucccuguuuaucuuuuucucacacuauuauaaauggcauuuuuagaaaauuuucaauaucugauugccuacaacuaguauaucguaauacaauugauugcuuuguauauugggcuuguauucuacaacuuugcuuaacucacuuauuaguucugguaacuuuuguagaugcuguuggguuuccuacaaaguuaaucaugcugucuacaaguaaugacaguuuuauauguccuuucugauuugaauuccuucuuuuucuugccuuaugauauugucuaggacuucugguacaaugcugaauagaagugguaagagcagacaucuuugucuuguccucauguaaggaggaaaggauucaguccuucuucauuaaguauauuaacuauagguuuuuccuacaugcccuuuaucauguuuagguaguucccucuauuccuaauuuucugaaagcuuuuaucaggaaugcauguuggauuuuuucaaaugcuuuuucugugucuauugagaguauuauaagaauuuuccggaaguugguuaagguggugaauuucacuauuacucaaauuuuaaaccacccuuguauuccugggacaaaccccauuugacagugauguaguaucccucucauagauuguuggauuucauuugcuaaaaaguuugcucagaauuuggcucagaauuuccuuauacagucucuguccacuuuucauaucaggguaaugcuugccucuuaaaaugacuugggaaguauuuucuccaccucaguucuuuuccuuaaaugguaguauuaccagugaagucaucugggccuggaguuuucuuugugagaagguuuuuaacugcaagcccaauuuuaaaaauauguauaggacuauucagacugucucuuugagugagcauuugguauuuuggcuuucaaggaauuuguccauuucauuuaggcuguuaaauuuauugacauaaaguuguucauaacauucccuuauuacccuguaauaaacaauguacuuaucuacaaagauaauuugaacuguuguuucccuauugcugacagaugaaaaaguuuagaccuuaaaauaauaccugauuguuggccacuucugguuaaggccacucucuccagcuuuccagugacagguaaugcuuuacauuacaaccaacuaauauucuaagauucuuagaaauggacaaaccacuuguugcuuauuuugauuguuucuggacaguuacuaccuguguggaaaaauucagggugcuaaacaacagugucacuuuauggccugguacuacacuagagcaugucacaaguucgcaagggcgguggcugcucccucuacuaacggauacuaccagagaccuucacacagugcagaccucgguuacuaacaccuaaauauuaacacccaugggauuugcagucccuauguucaugucuaguacuuggguaagcuccacaccaggcacauauuguuuuaugcaaucuuuaaagacaucugcaauagacaauaugcaguuuaaacaaacugugagguuuauaaacagagaauucuuuacguuugcuauuaugucauaacaggcacaaucugaaauacaauuuuguacuagcaguguauaaaaauacuuuuaaacgauacuuucgauagguacaguagcacuuuaaagaaaaccacuguguaguuauuccuuuugaggaccuacuaaaacaguucaacuuacugcccccagcuacaucuaaagcacgaauguggaaagcaaguucucuuacccagguacacaccacacacacccacaugcugaaacagucuccauuuaugaugcaugcugaugaggcaucaaucucaaacaggguaugagaugacaguguuuggugccuguuuccauuuccagguuugguaugaaugaacaagaggcaaaggcaagguggagucuguguaugggcccucucuaggaguuuaaucuggcauaucaauauuuaacuugggaggugggggaacauauuucccagggauuaaaacuaccuggucuucccaaacacuggagcaauuuucggagcuucuggaaccaauguuucuucagcaccuucgcuaucuuccugauggagaucauaugaaauguucccauauucucuuaaaaaugggaaaauuucaagcagaaacuggcagaagucucugcgaauaccaaaccaccaaugauugccccuuuuuggccuaaauguuguggucauuaaaguuaguaacaaaagccaaagggggacagauauggagauacaggagaauguauugcggccauccagucugugaaccagcaggacuucaaaggugagcagggcacgaugacagucguuauccagcugauggccauggucacguguguucuucacugcccugguaguucucauuuguucuuuuucuaguuucuuaagguagaagcugaugucauugauucaaaaccuuucuuuucuuuucuuuucuuuuuuugguaaauaagguuucacucuguugcccauguuagagugcaguggcacaaucauggcucacugcauccuugacuuccugggauccaccuaccugccccagucucucagguagcugggaccacaggugcauaccaccacacccagcuaauuguuucaaauuauuugcagagaugggggucucucuguguugcccaggcuggucuuagaacuccugggcucaagcaauccuccugccuuggccuccaaaaguauuggaauuacaggcgugagccaccgugcccagcucuuucuuucuuuucuaauguaggugcuuacugcuaugaauuucccucuaagcacugcuuuaguggcauuccacaaauucugauaugguguguuuucauuuucauucaauucaaauacuuucuaauuuacuucuuugaccuaugagauacuuagaagcguauuauuuacucugcaaauauuuggggauuuuccagauaucuuucuguuauugauuaauaauuuaauuccacuguggccugaccuuuuugauuuauuuaaacugaaucccuuuaaauuuauugagacuugucuuacggcccagaauguggucugucuugauaaauguuauguacacuugaagagaaugcauagucugcuauuggguggaauguucuauacauaucuaauuaggucaaguugauugauaacguucaacccuuuuauauccuuacugauuuugucuacuuguucuaucaauuauaagagaaggcaucuggccgggcacggugauaugugccuguaacccuagcacuuugagagacugaggcagaaggauugcuugagcccaggaguucaagaccagccuggacaaggcagggagaccccgucucuacaaaaagcaaaaaauaguuggguguggugguacacaccuauagucccagcuacucagggcugaggugggaggauugcuugggcccaguaguuggaggauacagugagcugugaucgugccacugcacuguagccugagcaacagagugagacucugucucaaaaaaaaaaaaaaaaaaaaaggaggugacauuuaacuauccuuguagauuugucuguuucuuacaguucucuuaauuuuugugucgcaaauuuugacucucuugcgaaguauguaaacauguaggauuguugugcccucuugauaaauuggccccuuuguuauuacaaaaugaccuuuaucucuaguaaucuuugcucugaaaucuacuuugucuaauaucuagcuuuuaaaaauuauuguuacaucaagaaaucuauuuuuccauccuuuuaacuaauuuauaucuacauaaaguguuuuuguuuuguucugcuuuguguagauagcauauaguuucaauauaaaagcaagacccucugacagucucugucuuuaaaagaggugguuuaagccauuuauauuuaaugugauuauugauaugguuacauuuagaucuauuauuauuugucucaucaauuuuguucugccuucuucugauauaaguauuuuuuauggaucugcuuucuuuuauuggcuuauuagcuauugacuuuguuuugguuauuuuaguaguuucuuuagggcuaaaguacauauuuuuaacuuauaaguuuaucuucagagaucucuacugagauaaacaauauguuguagauaauaaagcugcaauauuuuaaaauaggaacagccugcagcuuugacucauggagaaacugguuauuucuccugagucuuuauucuccuggaaauuacuguucuuucaugcucuaauaaaugucagccaagcacuucuagaaaaguguuuuaugauuaauacuuaggacugaaacgucauccuugaacauuagcacuuuuuuuccuaaagucauuucucuagccuacuuaacaauguuaagaauuuccaaguccaugguaauuuacuuaugaaacuaaccuaucuuaaauuuuuacucugcuuucuugagguguucagaaugagaauuauacauuggccauaaccugagaaaggaucagagauguuuuauauuccacuauuaauagucucucacaagcauguagaaucuaagugaauguuuucucauuucuuaucucacuuucucagcaagacacgccuauaaaauaggaagaacaggcgauuuuacagaggaagaaacucagggcccaagaguuaagguuccuuaccaccaggucacucaguguauuaguggcaaaauuggaacccaaagccuggucuuccucuuuuuggugccauaccacuucacgcucauccuugacuuaauaccacugucauaauuggaagccauaauugaagccuuuuccuuaggcuuccuugcagagguagcuaaugguaguuugguguuuccccaaggaagcuuuuugcguuuuggcugggcuagggaagcugggauuaauagcugaguaaacauucauaugugacagaacaaauaugacagagaaauggguuuuuuuccagccuuaaucuagaagcggagcaugacuaaugaaugagucguuuuuauuuguagcugaaauauuauaacccauaguaauacauuuugcucaaagggagaucaguggagaugauaagagccaguggcuauauauauuaauaugcaaauaacuacauucuguugaguaucaaaggauagggccuggcuuauaguccugaacugcccuuauuuuuucagugaccauggaucuauuuuuauucugaaucccagguccuugguugucugaagaaugaagaugaagcaaauucuuugaaguauuuagagccagagggugcagcuggaugcauagaaggaauguugggccaagaauagagaaauauggguucuaggucuagcucugcccuugauugaugauuugaggcaaagcauuuaaaccucaguaguaauaauacguacuuaauacgauugcugagaguauuaaaugaaauauugguaaaguguuuagcauuguguggugccuagcucaaugcauagcaacuaucacuuucuucauucuucugguaccuaacuguaauguugggcaauugucuuuccccauuugaacuuaguuucuccauuucuaaagagugaauuuguuguauuguaggaccuuuccaacacugaccuuuuaugauaugauuaugaauugguuaucuuuccacaagcuugugaccuccugguguugcugugauuauaguggucaucagucugagagagguuguucuauugauucugaugugcucuuuauuuacagaccacuacauauacccgccggggccaugggacaugcaccagcccagggugcuccuuuacauaugucaccaggcacaagccaccuaagugcccuaccugugguaacuuccuaggagggaaguggaucccaaagguaagguccauuggcuguugcugcuuuggaagccucacagaauagacuuucuguuugccauuaggaacaggugauuuuuaaaaaguuaacauuuguuuuuacugucugacuauacaaguaaaucauuuccauuguauauaguuuguuuaaaaaauacaaaagaaaaauggaauaaauuguuauccaaacucauauaccauccaaagaaaagccauuauuaacauuuugguguacuucuuuccagucuuuuuuucugugaauaaguucuguaucuguuuuuuucuucuucuuucccuucuuuuuuuuuuccaguagagauggggucuuccuuuguugcucuggccucaaacagucuccugucucggccucccaaagugcugggauuacagcacugugagcacuguuuucccuuuuauuuuucuuucuguuuuuucguggauaucuccaauacuauaauauuuugcuuuuuuuaauuuaacauaucaugccuuuaaauagucuucaaaauaguaccuguuucauaauuuccaugaacuacuacaccauguuuauuuacuuguuucugucauccccccgucuguauauagagaugucuguaucuauaugucuuuaacauuuuuauuuaacacucaucaucaguuaacaauguuucuguuuaugucacauugugaguuccuuaaugaccuugguaucucccacagccuuugcccauagaagacacucaauaaauaaaugagcaucacugcugugcccuucugaaguuccguuuaacauguugucaccuguguaugcuuggugcgaacuagauaaaacauauauacuugccacauuuuuuauaugaaacuauacauuuuaagggcuaaaauggauggaagaggcaguaaauucucaccuaguucagagaggagagacauuuauaaggacugagacagacaggcaagguauuauagaagagagagaguugaagauucaacagaauuuggguggguagaaaaggaaagagaggacauuauuuuagugaaaauggcuuagguuagguucgugauuaucacauguuuaacucagcaugguccaaacuuguauguguagaaaaaccuuguauagcagcauaccuuaaacuucucuggggcaauuuucacaucucuuugagaaauacugggauggugacuuuugcccucuggaugaguguuuuggcuucuggcuaaguucaggguagcacuaauuccaggagacaggauaauuaagaacacaauucuggaguuagcuaccucaguucagaccccugcuucccaagguuuuuaacuauguaaucuuggucaagacauucuauaucuguuccuggauuuaaguuuugucucaucugucaauggaaguuaguaccuacuucauuagggauguuagcagggucaaauaagauuauccauauagacuaaauggcaguuucugguacauauuaaauccucagugaauguccugcuaucaucaugauagacaucaauguaauuauuagcccuacuauugcucuucauguugucaggaagggccuagugcuaaugucucacaggggguuuugucuaaggcucuugugccaucuucucugaugugccucucugaagccaucaguguauucacaauguauuccccaaaaaggcaguucucuaacugcaguggggagauugaacuggauaguagucagaaucuuccuuggccuuucuugaccaaugcgaaacaggucucaaaugaccauauuuccugugcuuauacaugaaagacugucagugaucacugugggcuuaucccuccuucaggcuauuuuuacuuuggcuuuuucauuucuuguauguguggcuuucuuuuucauuucuuguaugugugguuuuuuuuccacuuugaaauaacuuuuuuuuuugggacagagucucuugcuauguugccuaggcccauuucaaauucuuggucucaagugauccuccugccucagcuuccugaguagcugguacuauaggcauaugacaucauaccaucauaccuggcuuuaacugaaacagcuuuuuuuuuuuuuuuugaagauagagucuugcucuauuguccaggcuggauagcacgaucucagcucacugcaaccucuaccucccugguucaagugauccuuaugucucagccucccgaguagcugggauuacaggcaugugccaccacagccagcuagguuuuuuuguauuuuuaguagaaaugggauuucaccauguuggccaggcuggugucgaacuccuggccucaagugauccaccugccucccaaaguguugggauuacaugugugagccauggugcccagccugaaaaacuuuagagccaugguucucuuacuaagaucaagcucauggcaugaaaacaauuuuuuucuuagcuaccuucccccaucuugacuugcuaagucagaauuuaccaauguguucugcaaggauuaccaugucaagaguagauacugugauuucuaaagcuuauagaaacagaaugagugugagaagacagguaacauuuuaccaucagugcacuuagaauuuuagaaauaaauugacuuugauuaucagcuacuucaacucuuuugaguuuccagcuaaggaaaaauagauuuugaaaaagcgacuuacuaaauucacacagccaauuaucccauugccuuuuccacuaaaccacacuucucaggcauugcugugcuguuuagcugcagaauguaagacaagcuuguccaaccuauggcccaggauggcuuugaaugaagcccaacacaaauucauaaacuaucuuaaaacauugagauuuuuuguuuuuuaacaacugguaaucaauguauuaaaauaguugacuuaagcaucugcaguggugacuugcaccucaacuccuggcucaguacugauggaaguaauuugcuuaacaaucucagaaggacugugcaagucaauuaguugcuuguggauucuccuauggaaacauuccuaugucuuagaaccuugaccacaaguuuuucuuguagugauucucaaagucuugguaggcauucgaacugauccuuucacugagauucuuuuccuuugcuccucugaucaagucagcacacaucuucuccagggauuuuauguugcagcucguuagagugauuugaauucggugaauugccaccuccagcuccauggguguuuuuccggugucuuuaaaagccuuggcugcagcgggcuuccugaccgacuuguuccuuggcgagagagaacagcggugagucaggagcaggagcgggcaggagcgggcggaccgcagcuccgcaccaccuaugacugugucuuccucaaagagcaaaacauuauauuuuuuugugugugauuauuuuauuuuuauuuuuuuaggcucaucagcuauuguuaguguuaguguauuuuaugugugacucaagacaguucuuccaauguggcccagggaagccaaaauuggacaccccgaucuauuaauaagauuucuugaauucugauuuuugaggcagcaaguauaauuugucucuaaaagcuccaaguguguuugugccagccaggaaaugacucaccuuuuguuguauuguucuagaguucauacuggcuaaaauuagcccaagaaauauguggcauaguucccaaugaguuggauaaaacaaaagauaguauauaaggcuguuuagcucaaggcuucauucuuaaggcucucugauggcagcaguugaggucucucugagccugcagccucagagaauuuugaaaguaacaucuaaaaugaguaggcugaguuaaugaaaugugagaucaccagguagaguuguuuugcucagauugcuuaaauuacccaaucuuucuguggugauuuuugucuaaaauagccuacuuaguaggcaguguuugcucaaaaaucuuaucucaaaaaaugaguuuagucuccuguuuuucugcuaaauuuucccucuccugcaguaaauaagcucugugcacuugacuuggaauuuuucuccauguuaacucacucuuaggggcuauuauguguuagaaucugagaaugcuuuaccaaagagcucuuaagaggucaccuguuacuggcucuuuuuuuuuuuuuuuuuuuccagacagggacagggucucgcucugucacccaggcaugaauacagcucaugcagccucagccuccuggggucaagugauccugccaccucagccucucgaguagcugggaacacaggcacacaggcugcauaccaccaugccuggcuaauuuuuuuuuuuuuuuuuuuuuuuguagagauguggucuugccauguuucccaaacuggucuugaacuccugggcuuaggugagccucuugccucaguuucccaaagacuuaggaucacgggcaugagccaugacgccuggcuguuaccaguucugaacuagaagugcaguaugcagauggcuuuggaaauguugagggguuuuuggguaguaagcgacugggagauaaaucauugaaauuuagugacauuggcacagacacuaaacuuucuguaaugugcagggagguccuacacacuauagaauuaggucacccaaaaugcugucuggcuccuguugacaaauacugagagcccaacccuuugcuauuucauaaggggaaaugaggauucaauugaagcuugccuuauaccacauaacuaauuaggaguggagcuaagcuugauagaacccagccuuuauguuuccuaguuuacagugcccuuuaugauauacaugguggguagaaaaccuuucugaagacaaccacuauuuaaaaacauuuuuaaaagcguauguguguauauauaauacuauuauuuccacugcagugcuaauuggauaaaagcuaagacaccaaggacuuuuuaaagccaggucuagcugaaauagcagcugccauuuuuagugaguuugaauauuuguagcacauaauaaugcaugaguuaauuugauccagugcaaaguaugugacauaugugcaagucauucuuaagacucuccuuaaagaaucugggacaaaaaacagaauuuuucccaaaggagaugggaaaauuugaaucuguccacaugagguugcggccacauugggauuaacugaaucucauaaaaggaccaccaaggugaacaacuuagggcuuuuaggcccuguauggcaguaugucacccucuuucuagacacacagaaguagccuuugaauaauguaaaacuaaauguaaaccuaaaaaaugccaacauuugguugaugaaaccuggagaagcuuuucaauaagaauucauuagaagaugaacaguuuuauucaaacgaaggcauuuaaugcuauagugaaaggaaccuguagccagaaaacuuagauucaggcuaguuuuacacuugagaucuuaaguuaacuucuuccuuucauggaccuuaguuuccuuauuuauugcccauauguuauuaaaaaugagagaauguuugugaaugucaucaacuguaaaaucccuuauguauacaagguauucuuauuuuucuaggaaaagccagccaaaguaaaaguggaauuggcuucuggcgucucuuccaaaggcucuguggugaaaagaaaucagcaaccugucaccacugagcaaaauuccucuaaggaaaaugccuccaaacugacucuggagaauucggaagcuguaagccagcuccugaacguagcuccucccagagaaguaggugaggagagugagugggaggaagugaucaucuccgaugcccauguuuugguuaaggaagcucccgggaauugugguacagcagucacuaagacgccagucgucaaaaguggugugcagccugaggucacucuggggacaacugacaaugacaguccuggagcagacguaccaacaccauccgaggggacaaguaccuccaguccacucccugcuccuaaaaaaccuacaggguaagucaguguguuuguauaauauagggcuuuggaaaugccccauguuucuuuuaucucaugucuguacagcaugccugagagaggcagcagagaccaggcaaugguuccuguuuuagagauacagaaaccaaggccuagagauauauaaagauugucccuucccccggacucugcuauucauguacugcugucagauuacuuacacaucucuucuugucagucucccuaaagcauuaauuagagucuugcugguauaggcucugggcaguauuaaaacuaugaguuaccaguccuggauacuggauuuggaaagagaaucuuuauuaaagcauccuguagaaagaguucuggccuuauagucagagaacucaguacugguucugacuguuucuggcuucuguuugacuuugggcauugucacuucaugucucuucaccucaguucucuccucugaagaaucuugaguuggauauuagaaaaucuuauccucacaggcugacuguacaaacugaagauuguauauaaaacaugcaaccaaguaccuugcaagucggaggaagucacuaucuuuuucuccccuuuuccuccuuaaaugcuuaauuggauucuguguauaucccuucccugaggaaguuguguucuuguaacugaagacccuuauuuguaucaaugguucucaacugguaacaauugugcccgcaaugaacaccagaagccaauuccacuuuuaacuuuggcuggcuuuuccuggaaaaauaagaauaccuuguauaccuuguaugcaaauauguauguguguguguguauauauauuuuucccauuuuuuuuuuaacacaaaucauagcacaacauacauacuucuacaucuuguuuuuuauuuuuauguuuauuuuuauuguuugagacaggaucucucuuugucauucagucuggagugcaguggugcgaacacagcucccugaagccucauccucccaggcucaaucgaucuucccaccucagccucuggaguagcugggacuacaggcacgcacuaccacaccuggcuaauuuuuguauuuuuuuuuuuguagagaugggguuuugccauguugcccagacuggucuugaacuccugggcucaggugauccgcccgccuuggccucccaaauacaucuugcuuuuuuuugggauggaaucucgcucugucgcccaggcuggaguggcgccaucucgucucacugcaagcuccgccucccggguccaugccauucuccugccucagccucccgaguagcugggacugcaggcaccugccaccacgccuggcuaauuuuuuguauuuuuaguagagacggaguuucaccguguuagccaggauggucuugaucuccugaccuugugauccacccgccuuggccucccaaagugcugggauuacaggcgugagcuaccgcgcccggccccaucuugcuuuuuuuaaaaaaaaucauguagcaauauacuuuggcgaugguuuuguauauuuaaaggaugaagcugugcacuuuagaccuuuuguuugagacacguaaaucacucuagcaaauguuuauugaggccuccucugugguauaggccaugugcucaacauuggugcugcaaagaugaagcaaacauggacucuguucucuagggucucuaagcugcugucauaaguauaugcucuaacuagagguagauuagauguuacagcuauaauagcgauuggcauuacacgcuguagacaucguuuuacacuucugugucuucgcaaugaccccauacuguauagguaauuacuguuccauuuuacauauuagaaacuugaaguuaacagaagaaugaaauuacuuguccagggccacacagcuauuuagugguugaauuugaacucaaucugucuaaagcuugacaguuuaaccccaauacuauccucuaagaaagcacuauguagagauugcgcuuugguuuucuucccuuuguuccagaauuuccagauuucucuucuuauucuuuucagagcugaccugcuuaccccuggguccagagcuccagagcuuaaaggcagagcacggggcaagcccucauuacuggcugcagcaagacccaugagagcaauuuugccagccccaguuaacguggggcgaggcagcagcaugggacugcccagggccaggcaggccuuuucccugagugguaagggcugggacauaccugggauggaggggcugucugacaggaaagggacaggagugggggguugagaacggacauagagacuuggggagacucugaaugcacuuaagucaccaguuuggcuccugguucucucagauaagacucccucugugaggacuuguggucugaagccaagcacacugaagcagcugggccagcccauucaacagccaucuggcccuggugaggugaagguaaggcccauuuuccagagugggagcuguuugagggucuggcugcuuccauguaauguaucaaagcuauagguaaaggcacaucccauuucuuacacguuggcagaccucuggguggagguuaacaugaaugauuuaucuguuuuuuaaguaauuucuuaaaacuuaagugaauacauguuuuuaaaccuuuuacuuagaaauaauuuauaacuuagaaaaaagucacaaaaauaaaaauaguacagagaacacccauauacucuuuacccauagugaccuauuguuaauguauuagcccauuuugcuuuaucuuuuauguucauguguguccccccaccauauguggguguguacacauugcauguguguaaaauacacauuauaggguaaguuaugccuuuaugcuuguuuguguauuucauaagaauagggauuuuuuuuuuuuuugguggcagugucucacucugucacccaggcuggagugcaguggcacaaucuuggcucacugcaaccuccaccuccuggguucaagugguucuccugccucagccuuuccugaguagcugggauuacaggagcacaccaccacgcccggcuaacuuuuguauuguugguagauaugggguuucaccauguuggccaggcuggccuugaacuccugaccucaagugauccacccaccucggccucccaaagugcugggauuacaggggugagccaccacgccuggccuagaauaggaauauucuuuuacugaaacauugauguauaccuuuacucucccauucauauuccaaauugugucaauucgaccugugaacccugaaaaucugagacaggucucaguuaauuuagaaagcuuauuuugccaaaauugaggacaugcaccugggacacagccucaggagguccugaugacaugugcccaagguggucagagcacaguuugguuuuauacauucuagggggacaucagucaacauacacaagaugaacauugguucagucuggaaaggcaggacaacuggaagcaaaggcaggaagacucaaagcagggaggggacuuauagguuauagguagauaagagacaagugguugcauccuucugaguuucugauuagcauuuccaaaggaggcagucagauaugcauuuaucucagugagcagagggugacuuugaauagaaugggaggcagguuggcccuaagcaguucccagcuugacuuuuccauuuagcauagagauuugggggccccaagauuuauuuucuuuucacagacccgauuuuauauauauauauauguauauauauauauguauguguguguauauauauauguauauauauguguguuugauauauauauguauauauauguauguauguguguguguguguguguguguguguguguguguguauauauauauauauauauuuuuuuuuuuuuuuuuuuccuccagaaacaaggucuugcuuuguugcccaggccggagugcaguggugcaaucauagcucacugcagccucgaacuccugggcucaaggaauccucccaacucagccuccugaguagcuggguacacaggcaggcaccaccauaccaagcuaauuuuuaaauuuuuuuuguagaaacggggucucuugcuauguugcccaggcugaucucaaacuccuggccuuaagcgauccucuucccuccucggccucccaaaguacugggauuacaggcauuagccaccuccccagugucuucuuuauuuuauuguauauuuuuaaagccccuccuauucuagcacaguuccuuuauauagcauauuuuucuccagucugugauccagucuaggaucagauauuaacguuuaguugucaugucucuuuagcuuccuuuuaaaaaugaaugcaugguuguagaaaauauagaaaauucagguaaaggagaaagaaaagucccucaugauccugccacccagaaugaccauccgaugugcuuucaggucuuuuccugaauuuguguguguuuauuuuuuaauacaguuuuuuaaaaaucagaaacuuggcucuuacuccauauacuaguuuguggcuuauauuuuucacuucauuuagugauacagauauuaaaaauuuucuguguguccaaauuccauggauuagugggguugguugguugguuuuuuggcuauauguagcuagaauaguuaucaaguuuuuuuuuuuuuuuucaugucaaauggguaaugugcugacguuauaaugagguuugagggaggcacaucucacccaugugcaugaauaccagauugucauacuugugagcuauaaaaggaucucucaaaauuuccuaaguuagcauuuuucaagcuuuugaucaugaccuucaguaacaggcauauuuuuuauuacugcccaguaaacauauauacuaaagguuuaaugaagcugugcccuuacuauaugcagucacuuuuuuuuucucauuccuauuugcaaaauccugguuucaacccauuaaauuaauguuaugaccccucauuggauugugaccuguaguuugaaaacugugucauggaccagguuggaauaggaaaacgggucugccaucuccccugucauguguucuuugucaguuaacuuccuuucuuuaacaguuuuacauuugcccugacaggaauaucaacuggcuuuuacuuugagaacuguuuuguuuuccacacagauguggcagcucuggguguaugugugaucuugcgguguagaaggaagguaucugguuagcgucgguaguuuuguauauuuccagccccuagauucccuucauguacacucuguuacuuggguaaaccccagucuucucuguaaauaguuuccuuuugauuggugacauuggguauuuguuaaaagccacaagcucuuuuacuagucuuaaaccaguaaagagguacaugagauauucagaaaaucaacuuaaauucauuauuauagaauaauuuuaauuuuguaugcuuuaucuuuucuuucuuuuuuuuagcuauauaaguaaaauauacauuccuuauaaaacauuugaggccaggcaugguggcucuugccuguaaucccagcacuuugggaggcugaggugggagcauugcuugaguccagcaguucaagaccagccugggcaacauagugagacccacaucgcuaccaaaaaaaaagcaaauuuuguagauagugguaaagagggagaaacaaccaugauuguccucuuacccugugacauuuuagugaauagucuuucagacaucuuucuaugcaaaguuguucaaccauguauuuauauguauaaaagcuauuaugugcuuuuauaacucaguaguaguuguaaaucugauucaugguguuucuaauacaugguauuagaaacugcacagaagcauguggcaaggccuggacuugaacaugacacucagccuuuggugggcuugugacugccaacuggcaguccagagggcucauuuggagaauagcucuacaaauuccccgggaaagcauucccucaagucguuucaggacaugggagcucaggaguuuggcuaagguucaaaagcacuaaauaauuuguucugauccacagcuaccaaguggcccauccaacaggacuucucaggugaaaguuguggaggucaagcccgauauguuuccuccauauaaguacagcugcacugucacauugguaaguaugcagcuagguggugguggguugacauggagguuguuuugauuuugugguugaaggucaguaggaggcugggggagaggguggugguagcugggagggagaacagggucagguauagauuguuaaugaugaagaucccaucccugaugcaaauaauagcuacuggaugaaucugcuggguuguuuuggucucuuuccaggugagauuuauaaaguguaggacagcugagauuaguguauuuuuauugagaguugccagagaugagaaucuaguccagauuuaacauuuagcugucuuggaaccuuuuagcuuagaaaggguguuccacaguuacauuuaggcaacguugccuuuuucucccuaaaacagaguccaguucaacacgaguaucuuaaaguaaaauagagaaguacuuuaguaaagcagcuuauuuuguuuagccuaguguuucccacaggguuuucccuuuauuuuuaacauaacacauauuaacguccuaauggacaaaugugugacauugggaucacccuuuuguagggcaggcagcauagagcagggaaauaaaugcuagacagcugagagaccugguccaaaaggaguucuggcucugcugcuagcaugccauaugccacugggcaagauucuuuccuucugugguccucaguuucacuaucuguaaagugcugcauugguuuagacaucuuuggggcaucugucacucucaacauucucuaauucuguugaugcuuaaaguaucaaccagcaagaugucuuuuggcaguuucucuagcugauuugauuaagaugaacagauuuugagagaacagcuagauuuuuaaaaagucuugccucauaauggcagacagguucagaaagggucauucauuccuucaaaaaauauuuauugagcacauauucuguacuaggaucuguacuggggauucaguagcaaacaagacagcacaaugugauggguuaaugucuggccugaccugauccauaaggagaaugugucucuuauccuggagaucugcucagguuucuuucucuugugaccuaaauauaaucacuaccuuuuccaugccuucacucaccacucccuuuggcuacaggaggcaacuagauuuaccauuuagggggaacuaccccugaguagacccucucuucugcugauuagauaguaacuugucauaggagcuuagaugcuagagcuuugagcuuuaauagucuguaagucacaguuugucuucaggcagggcuugaacucuuuaguucaccagucucaagcacucuuuguuuaaacagaccugcuuuacuccaccaacugccuggacccugaaggcauuugaguuucugaccauugagagucaacucuccuguuucacagauagggaaggacuggacuggauuugccaaaaauuuacagccuguauuaaaaguaaaagaguuaacugcagaaaagguuaaggcucuugaaguuaggcugaaucugguuugcaguugccacucucuucucugauuuacuggcagcugcucauucugguucuggguucugcccagguuuaacuuaauuuuuguagaauugaacacuggucuuacuuuuuuaggauuugggccuggcuacaucaagaggccggggaaagugcaagaaucccucuuguagcuaugucuacaccaacaggcacaaaccucgaauuugucccagcugugguguuaaccuugccaaagaccggacugagaaaaccaccaaggcuaucgugaguuccuucccccaaacacauccccuggccuguucugggcucuguuagugaaccugucuuaguagaaauaagaagauuuuuaaaguacauggugguaguuagagcauccaaacugaaccaguugguggguucugaaccugagcaagugccgccuuuucucugagccuccuuguccccauugccagggugaagggguugacuagguaucuugaucucugagaaccaagaguucacucacugcagagaaugauguagcacaggccuuaaguaggagugaaaggagagggacgaaaggguugcauccucuuaccgcugaggccugauacaagaccuguaaguugauuuacuguuucgguaaauagagaaugccaaccugagacuuugcagauuagaccaccgcugcuuucucaggcuccuuggaaagcuuuuaguuaaucaaagcuuuauuucuagcagucuaggcagcccuccucucugaaguugggccaaacuacuuggguaguaaaauacauuccacuuggcuccuuagggcugcuauuauuauuauuacuauuaccaggaaaaaugggcauuuucagagguccccagaauuuccauaugaguuuuuuaaagugaacagaaaaugguggcacuugaggcagcaaauggaaggacuaaaauaaggaugagaagagaaaugucacuggucugccuuggggaaagaggggauggcacacagaacaggucaggaccugagauggagccuggucacuccagaucaaggcuggaccuugaaaggcaggcagguuuugaauggaaggggaaggcaugccauacuuaagucucucccacuagacuguagucuggugagugaacaugaagugugaguauggauaaggauaagugugagugauaaggauaagugugagugaacaugaagaguguuccauuuggcuggaggagauggcgugggggcauggggugggagaagggguguuacggaaaauaagacgugaaaagcaucuuggaaccaugucauggaaggucuugucaguuuguucuuuagucagugggguccuacugaauguccuugagccggggagaggccuagaggaaaguuauuucaagaggggaauuuaugggaugagaguuugggaguagacaggacuacagagguggggagaacugcuucaagcuuagagguuuauuuguauauggagagaggccuuuuugaugaugaaucucacccuggucuccagagucuguuuccgugcuugaggugauguucugagguuauuguccuugugagaaaggaaaguggaaccaaaguaugugggcacuaauggcuuggugggaaaaacacuggggcugggagugacccugaguuggaagcuucccucucccgagcuuuaguuucuccauugguaaaguaaggugggcaagguagauuagaucugggcauuuuacucuuaagagacaggagccuuagagaagacugauaauugaguuuuaaggaguuuauaaaucccugaaauugcaugcaaaauggguccguagcuuucaucagauucucuugcuccacuggaugccugcugcuggaaguaagcuuucuucccggauuuucaguggguuucaaagugcucuucuugccauagcauugaucacaccccauauugacugcuuuucuuaacucccuaugagaccacaaucucuucuagggcagguaugucuguuuuuccugcaccuucuaacccuggagcuuacauauacaaagugugucuaucuguaauuaggagauagaauugaguucuguguagguagaagcucugagcauuccuuucuccuuccaguucauuuuagcuauuugcgcgguuugcaguggaaguggguguuacucucuagaucuaggaugaugaaggaacuuaacuucucaggugacauaggaaauuaucuagggaccucuugccaauuucaaaucccacucuuaaacuuauauccaucuguauuugguuaacugagaacugcccacccccaggacccucaucugcagaccuuccaucacuuuccaaucuccuaaaguuuggagaaauacaguguaauuacugcuuuccagaaaauaaagcacuggucagaaccacagggaucuucuuguguguugucauuuggagcccccugguagccagauguuuucacaucucugagauggaauggucuuuaguccuuucuauccuucaucucuggcgagagucacgggacaguauuccugccaaguggucuuccagcugugguuucauagucaugacugagaacacacagccucucggggcagcucauucuaguguuagucagcucuucuguagccacugauuaauuaauucucucagccagccuauauugaaugccugcuaugggccaggcuuucagagaugaauaggacguggcccuuucccuugaagagcuuacagucuagugggagagaaagauaaccaagcuauuacaaaugaaaguugucauagguaugcggaguuaauaaaaagcuccuuauuaaguguccuagucuguuuuguguugcuauaaaagaauaccugaggcuaggcaauuuauaaagcaaagagguuuauguggcucauaauuuggcagucuguacaagaaccauaguaccaacaucuuuuuuggugagggccucagacugccuccacucaugguggaaggcaaggggagccagcaugcauagagaucacauacagaaaaaggaagcgaaacucauucaccaccucccuugcuccugccccacgauaaucuacucaugagggaucugccccccugacccaaguaccucccuuuaggaccugccuccaacguuggggaucacauuucaacaugagauuuggagacgguaaacauccaaacuauagcauuaagcauuuaacuucuacagagccauguauaauauguccaucacauaugaaucaguaucuuaugugugucucaggcaucaugcugguugggaaucaguaaauaagcagaauccuacccuuacugaagcggggaggguggugguuuagcagcugucagaugaugaauucugcagucaaggggugcacucagagaacacaaagcggggagugauuuaugcugccuuggcaaaaaggaucagggagaagcuccauugaagagagaccugcuugagaaagaccuauuuuuaaugaguauuucagaacauuguuccuggaagccucugacugguauacaaaauuaccuuguacccagaagccaccgagaauuaaagacagauaacuuuaagcagugcagauacuuguuuauguaucaaaacuaucauucauagagccuucauugcaccauaggcauugugcuaagugcuuuacuuauaauaucuuacuuaaucuguauaauggcucuaagagauuacuauuuuuaugccccauuucacagaugaggaaauugagacucagaaagauuaaguaaauugccuugggucccacauacacagcuguuaaguggcauauccagaacugaaaccugggucuguuauccucuaaaccccauaccugaugaaugagagcuaaguguugaauccauuaccaagaguuguauauaauccucucauuuacugauacagguugacuauccuguaucugaagugcuugauaccagaaguguuuuggauuauuucauaauuugcaauauuugcagaauacauacugcuugagcaucccuaauccagugauucaaaaucugagaugucuaaugagcauaucccuugaauguugucucaguggucaaaaaauuucagauuucagagcauuuuggauuggggugcucaaccuguagagaaacugagccccacagagaaaaauaaccagccuuuagucacacagugaguuauuagcugagcugguuaggaaccuagguuugccaccuaucagucaugggccccaucugucugcugcucccagacuuuuauuauuuuagccugaagcuggcucuuucugcucugagugcuuggugaucaauccacucucuucccaggaggugagcucaccacucccagauguacugaaugccacagagccccugagcacagcccagagggagauccagcgccaguccacacugcagcugcugcgcaaaguccugcagauuccugagaaugagucagagcuggcugaggucuucgccuugauucaugaacucaacagcucucgacuuaucuuguccaacgugagugaggagacagucaccaucgagcaaaccucuuggucgaauuauuaugagucuccguccacgcagugccuucucuguagcagcccauuauucaaagggggacaaaaguaagcaccccuuaacucugccccuagcuaccccaucccauuuggcucauacugcucuuuucuucagaaaacauuaaaacuauaacugugaagauguuauucucugccguuuuuaggcuuccuuuaacuuucugauugcugaaaguaaaguaauaauugguaauuaucauuucuguugaaaugccugaaaguuaucaccagauuaggauuuaguuuacaucuggacugccccacacaauguuuagguuugggaguucauugggauugguuaaauuauguaauaaauucagaguuacauuaauuguagggaugauuccacagauuccaacaaaguggaaauaccuaccuagaaaauccuaagcuccagcaaaugagaauuugccauugaucacugagcccuggaacuccauaaagaagucucuuucccuucuuuuuuuuuguuggugauguuucugguacuagcucccuggcugggccccaggagugcuggcugcugacagccagccgucugcagacagugacugcccaggugaagaugugucugaacccccauugucuggcccugcacagcuucauagacaucuacacaggugggugccaaccuucucuucccucagagcaucccaaagcaggcuugggaacugccucuauggaugagaccucuggcccuuugaggacugggccuucucagauggggcuucugaggaagggggagucuucuuccuaaaugucuuagucccacaagaugacuuuuaccucucaaguguugaagcucucaacugggaucuuuaaaauaacagaucuucauuguggaagggcuggaaaaugcagacaaauaaaaagaggaaacaaaaaaucaagagcauugcuacugccaugagauaaacacuuauuuaacagugugaucaaucuuccagaaauguuuauucaucugugcagaauauaagaaauuauaggauguauagguuuauagucuuucuuugaacaaaaguacgguugugcuagauguuguuuuggaaugugcuuuuuaaacuuagggguacauugugggcaucuuccugugccagcaaguagagaaguacaugaccauuuuuauagggauguauggugcuccaguuuacacuuuugugauucagucuuuguguacagcccuaauuugucuuuuggacaaauacucagaaguggaauugcugcacauuuacccuuuccuccccuauuauucaucaacaucaggcauuuguggaacacucaccguguaccagccauuuuaagacuuugguugaauccuaaguuuuguuuguagaauugagugcugaagaugaaaguguauuuuugauguauucucuuugucuuagaacuuaauggugcuuuauuuugaauucauguuuuuaaugucuuauauuauuagauugaguuuguacuauuuuaugcucuugccaacaguuaacaaaagugccuauuacccuguugucuauccaggcuaguacucaggauuauauauuuauuuagucaacauguauuuuaaaauuuacauguaguuaaguguguugcuccaaguuccauaaguucugacagaugcacuaagugguguaacuaccuucacaaucaauauauagaacaggucuaucacccaaaacauucucuuuuacuguuccuuuguauuuaaacccaucccucucccccaaccucugguaacuguuugaucucaucuuuauccauauaguguucucuuucccagaaugucaugugaaagcaauuauggcacguagccuuuugagucuggcuucuuucaguaaguuaauccuuugagagucauccauauuguguuuaucagugauuuauuccuuuuuauuguggaguaguuuucugugguguggauguaccacagguuguuuagcuguuccccaugggaggauauuugguuugcuaccgguguuuggcaguuacaaauagagcugcuacaaauauuuguguaccagcuuuugugugaaccuaaguuuucauuucucuuggguaaauaccuaggagucagauugcugggucaugugguaaguguguguuuaauuuuauaagaaaacugcauuaccaaaguggcuguaccauuuugcauuccuucccacaauggguaaaaguuacaguuugcucuacaugccaguacuuagcauuaucuguuuuuguuuuucagccauucuaauaggugugucuccguauaaacuguagagucagcuugucaauaucuacaaaguccugcuugaauuuuaauuggauuguguucaaucuguacacaucaauuugggaaauuuugacaugccuaacaauguugaaucuuccaguccauagucuuucucuccauuuuaauagguugucaguuuuucuaguuucagcauauagguccugcccauauuuugguagacuuacauauaaguauuuuacuuuuuuuuuucagugcuaaaugacaugguucaauuucuagcuauucauugcuaguauagaaguauaauuaaguuugucuguugacuuuguuuuuguaaauauuauaauuuuuuuaaguuuaucaauuuuauagguaaaaacuuguguauaaucagguaauuuguuguauuucuuuguaguagguagaguauauguccuuuuuaugauccuuuauggguuuuuuucuauaguaaauuucuuuuguguuuucauucuucuuuuggucuuuuuuguugacaguuuucucccaguuuaucgcucuauuuauucaguuuuaccucuagccugucagaaugugauaucaguugucuuuuacauuuguaccuggugauuucugggggcgucaugacuuuugcuuuuuaaaaaauauuuguaugggaccagagcuuugcucucccuugugguuucagccuuugcacuucuccuuacccuucuucacugggaacacauacuccaaaauuugcuuuugugcagauuagugcauuauguuuugugcacauauaaaaucacccacuuuuauuugucuuaaauugacugcgcuuaaauuccucagauucauucauuucaggauuugguguuggagugauuucauagccuuuguuguaccccuuacacauucaugagcuaaaggaugcuccuggccuuuccccaggugaaguugugugagguguaaaggaagagugauaccuuugguccugaggacugagcugggugggaagaaaguguuccuuuuuuuuauugggggaaaaagaucuacuauauguacuauuucauuauuuuuuguuuguuuguuuaaugauguauuauaggcaacuuugcgucagaacaguuagaucuacuucuuuuuaaaaaaaaauggauuccauguuggaauacuuuauucuuuuuaaugcuuucuauuuuaugaauucaccauaaauuaauuaacccuuucccuauugaugggcauuuaguugugggguuuuuguuuugccuuuuucaagauauauaacuugaauaaaauagagauggggcuuugcuauguuguccaggcuggucuugaacuccugggcucaagcgauccucccaccuugggagacuacaggucucccaaagugcugagacuacaggcaugagauuacaggccauaccuggccuguuuuguuuuuuugagauggagucucucacuguguuacccaagcuagucgacaacuccugggcucaagcgauccuccugccucauccucccaagugccugcaacuacaggcacgugccaccgcacccagcugguguguauucuauuuuuugccauuguguaugauacauuaauuuccuuguugccucuucuuaaccugcaggucucuuuaauguggggaacaagcugcugguaagccuggacuugcuuuuugcaaucagaaaucagaucaagcucggagaggaccccagaguguccaucaauguuguucugaagucggugcaggagcagacagguaaaaguuguuuucuucccuuucccaagguuaguccuaagcucccucggaauuuucagugauggcauuugguuaaaagacucauuuugaagaagagucugauuauuuugaaaaggagacauucuugacuuccuaauacacucuuccuuuugaauuuuacaaaugccaaacuaauuuuggaaagcaugaaucuuuuugugcauccagggacccuuagcaagagauuacgagugacuuguagaaguaccuucuuuggucauagggagacuuggccccauugcauguuagacucauucugaccacacagcuccuggauaucugcuuccagucccaaggcucaugccaagaccuaagagugaggaccauccuuucugucuagaauauuuuuccuccaugcccucuuuacuccuauuugugcuuuucccaucccauuccuauaggcuccaaucccccucuaccuuaccugcugugagaacagauggaguagagccuacuagaguuacaugggccuguguuucagucuuggcucugccacuguugcagugugauuuugagcaaguuauucuugugccucuguuucuccaguuauaaaaugaggauaauagcuccucguucauaaagaauuaaauugaggugagauuaaugacauaacauauccaaagcuuucagcacagcaucuaguacuuaguacaaggcagcuaucacuccagugggaauugcucuuuggguugccaccugagcacuugcaggccagaucccugacccucaggguagguaguacacuggaguguucuuuaaggugaaucagucuggcagaauugcucuacuuacuacccacuggcucaucccuaguggcuucagugucuuuuucugugcccuucucaguguucuugcucuucuuucagagaagacucugaccucggaggagcugagccagcugcaggagcugcugugcaauggcuauugggccuuugagugccucacuguccgagacuacaaugacaugaucuguggcaucugugguguggcccccaaaguggaaauggcucagaggagugaagagaaugugcuagcacugaagagcguggagguaagugccucuuagccaccgugagggaccugcggaauuuucucauuuuggcaccucccuuccuauaugauauccccaggggguggauagcuccaguccugucuaggugaggcaagugaguuuuuccucccacagcccaagauuucauuuagggaaugccagauggaaauggaggcauuuguuuauucaguuacucacuugaaaaauguauuuauccagugaauaaguaucaaaaaauauauauaguaaauauauugaacauaaacuaaaugcauguuuuagacaccugggagauaguaguuaaacaaaguuucuguccucauggagcucacuuucugguuuggaggacacaggaaacaaauaucuguccaggaguagugagugcugugaagcacaguaaagcuggguaagagagagagaacagugucaugggaaagggcauuuguauuuuauagagggcagugaggggggaaggccccucugauacaguagcauuugaguagagaucugaaacccauguggcuuuguggaggaauauuccaggcagagggaacagcucgaacagggucugaggaaggcuugcuggguaugauugaggaccagcaaggagaccaguggugcagcucagagugugggagggagggagggaguggugggguguaugagguccagacagugcaggaggccgacgcuauguaggguaacaugggcuauuuuaaggacuuacacagagugaaauggagagccacugaagggguuggaggaaaagagugaccugagcuaacuuagguucugaacugaaaaauuuucacacaauaauaacaucaaacucagauggcuucauagauuaauuagaacaaauauccaagaaauauuauuccaaacauaggcaaguaacaaaagugggcauguuuccccaacucaucauauaagguuguauaacuuuggaaaccaaaucagacauuugauguaagagaagaaauuggggcugaauauacucaugaauauagaugaaagucugaauaaaauaauagcaaaucagaucuaacacaguaaugcaucaugacaaaguuaaacacaggaaagcaagguuguuucagcaguaggaaauauguuaauguaauucacuacuuaaccgauuaaaggggaaacccuauaugauaauuucauuaaauguauggggaaaaaaaaguuguccaguaugauucuacacccauauuuaugauaaaacuuuuagcaaacagaacaguaggaaaucuuccuuaaccuucuuuaggguuuaaaaaaaaaucccauagauuacuuuucccugugaucaugcuaugaggucuggucuacacucacaggcagggacugcgccuugaauaugccaguaguugcauaggagugugagguuuccaucucugaacucuaccauaguaaacaagagccugggacaugagcugacuuucagguacuggacuugcaucucauguguucacugaucaggcaggugcagaaccuguagagaacagcuuugguguauucuggcaggaccacuagacauauuaaggguugaaugcauaguccugucuuuuacuucccaaguaagaaaccaggcaacuaaaccauuuuguuuguguuaucucaucuagaggcuguuuccagauugauucaaauccgcuugccuaguaguaguguuaauaauaaugcagcuaagauuuauugagcauuuuauuacuaugccaaguucuuaaucugugcuaagugcuuuacuauaugacuuaauuuucccuacaaccccaugagguuuuuauagacauaggcacugaagcccaagggccuugcccaagcucacccagccagagaaggguggggcugagauugaccuugcucuuucucagccgcugacuguggagucugcacccuaagcacugccauucucaccaguaccuccuacgacucugaguucuguuucuucugaucauaucuggccacagcaaguuuaugguuuccaagaauagacagaggcccaccucccugcaaaggugccaucuccuaguccugccuggcacccguccugucccaaucaaggcuccucugucccagaauggaguagcauucccuucacucucaguuugcuugucucuuuccuucagugguaccagguacuucuuucauagagguacuucuuuguuuuguguguggagaguagugugguauguguggggagagaguauccugaagucugugaacuaaaacaggaaguuauugaacaaaacuuaaauaugcuguuauccaugaagagacuugucagccccucucucggaguuguauaaaggaggacccugugguuaguuuguguacuggguuggcauuuccuguucccuugcuccuuguggagaggauagacucagcuggccucauuccccuaggugugccauuuacacagagcaugcacuaagcaccccugugagguggcaaacaaagaggaauaaggugaggagaggagccuuuauggggagcagugguucuuggacuuuaguggguauaagaacuacauagggcagugguucucacaacuuuuuacaguggagggcuugcugggucccacccacaggauuucugacucaggagaucuggaguggggccaggaauuugcauuucuaacaaguugucagaugauacucuugcugcuuguccaggaccacccuuugagaaccauuccucugaggaaacuuuuuuaaaugcaaaauuaggaguuuaguucauacagcucaagauguggccaagguuuuuacauuucuaauaaguaagcuauacaacugugauugagguauuaggauccgggucacguuuugagagccauauaagagggcauugcaagaagaaaaauugaguagcacaagcgcuauuaauagaugucuauaagagauaaguaaaugcugcccuggguagaggagauagcugugugcugaugaugugugggaggaugucggcaauccacagggccuuggaaaauggcuggaauuuuacucaauaggauucugcucguucuugccagccugguaucagcaguaaggguuugggcuuuggaacuagaccuguguugacgugauuguucugucucuucgagugcuugaauacucaccucagccauccccagacuuguuuuuuaguaguucauuacaaagugucuggcacauaacagguacucaaaugguagcuccacuuucuuuguaagacagggaaaaugacauaaacaaagguauagaaacagaagggauuuaggaacuauucaugucugggagaguacuauggugugagggaaagaaaugugaccaaaaggcagguggguacagagcugucaaauucaaggcccuguggcagugccuggcugucugacuucccuucaccaagccuuggcuucccuguguguauaaugacgggguaggcuguuguguugcugauguucugugacucccacaguuugaccuucuuuauccugaccuucuaguucaccuggccugaauuccugggcucuaaugagguaaauguggaggacuuuugggccacgauggagacagaggugauugagcagguggcauuuccugccagcaucccuaucaccaaauuugaugcgucuguuauugcccccuucuucccaccacucaugagaggagcuguggucgucaacacugagaaagacaaaaaccuggaugugcagccaguaccugguaaggccaccugguggcugacuggggucaaaaaagggcucagucaagagucugggacauuguccauggcaagauagcacagugguagcgagagggccaggccccgcugcaggacuccuuucagaaagauaauaacagcccgugucaaaauccccuagaguuuaaaguuguggugcagaguuuugaagagcuguccuccaucuuacauagcaggggcgcacagcucauugucagccuucugggauacacacacugaguagcagaacuccuauaaaaaaugcugauaaggcuccauccccaaagguuuucauugagcaaguguaggggcaggccaaggaaucugccuucaaaacaggccucccagaggguuuugcagcuaguuuuauggauuagacauugagaaacccuggacuagcggguaagaggauagguuucuaacagcuugaguuugauucccagcuuugccacuuagcugugugacccucugucaggucccaucauugcccuaagccacuguugcuucuuuuacaaagagggugcgauaauagcuacccacuuccuagaucacugaagauaaagugagcuaaugcgguuagagugauagccgccuuuuuuaacuguaacccauagugagaaauacauuuugugucaugacgcagaaugauauucguacauaugcaaguguguauaacugaaacaacauucccaaaacaguauuuuucuuuauuuucuaucuuauuucauuuuugaauuuuuggauaugacccacucaauugauauuguaaucacuuaauauguugugauccacugguucucaaacagugcuuccuaauauuagauauugaggcugggcacgguggcucacgccuguaaucccagcacuuugggaggcccaggcgggcggaucacgaggucaggagaucgagaccauccuggcuaacacggugaaacaccaucucuacuaaaaacacaaaaaauuagccgggcaugguggcgggcgccuguagucccagcuacucaggaggcugaggcaggagaauggcgugaacccgggaggcggagauugcagugagccgagaucgcgccacugcacuccagccugggcgacagagcgagacuccgucucaaaauaaauaaauaaauaaaaauaaaaagauacugagguccaccucauauuccugcuaauauuuuaagggcccaggcaucuuuuuuuuuuuugagacggaguccugcucuguugcccaggcuggagugcaguguugugaucugggcucacugcaacucugccuuccggguucaagcaguucuccugucucagccucccaaguugcugagacuauaggcgcacgccaccacaccaccacaccuggcuaauuuuuuguauuuuuagaagagaugggguuucaccauauuggucaggcuggucuugaacuucugaccucagauaauccaccugccucggccuccuaaagugcuaggauuacaggugugagccacugcacccggcccccagggauuauuuuuuuaaggugcccccacauaguucucuugugcuagccagguucaggaacguuguguagagggcacuuuuaaaccgagagcugcuguucuuuucuuauugaugcagucaugguaagcaucugaggucuugguucugaaaaaccuuagaagacuggauuaaaagcugacuuauuuuaggguuuuuuucaguggcgguaugcaggauaucucacucagauguuccagggcagaaagccaguuguaauagacuucaaauaucugcagaaagcguggaccugacuugaguuccaccucugccagcacugggggagggcuuggugcagagcuggcuuccacuguuugcuguuuugugggccuagccuuggccucuggugacuggcggcagcacccucccaccagcacuguugucucuugcaggcaguggcagugccuuggugaggcugcuccaggagggcaccugcaagcuugaugagauuggcuccuacagugaagagaagcugcagcaccugcuaaggcaguguggaauccccuuuggggcagaagacuccaaggugagugucaagggcagugguggauaucggggcuucuggaguaggcugauugguccacuuuuuaggucagggauaugaauaucugugauggcaucugccuuggacacaaggugcuggcagucagggaugccuaggagauggucaacagcuagaugugacauguauguggggccuggccucuaacaguuccuccuguugaagguugugagccuaggcucuggggucaggaauccuggcucuccuccuuacugugugugaccuuggauaagcugcuuuauauuuugagcuucauuuuccuuguuuguaaaauggaaauaaccaaaauacuaaccuugugagauuguuguaaggaaugcacuuuacacagugucugguuacuaccuaugcaagcucuuagaaaaugccuacuguuacauaguguaugugucuauguguuuuauucauacauuauuuacuuucccuuucauauuucugugcuguugaaaauguuaugcuuccuucaagaucagauucaaauguuagcuccccuuugaugguuucuuugcccuguaaaaagugaaaggacucaggccucagagucuggcagcuugaucagcagucuggcuggcuuugucugugaccuaauccuuucagggccuccgauugcuuaccuguaccuagaggagguugggcugaugaggcuccaaggcccgcucugacccaggcaguuuauucuuuugcuuuggguguugggugagugugugaugcugagcaccagccguggucccuuagcauucgcccuuauguuuuuaaucuuguccuucuacuccaggaccagcucugcuucuccuuguuggcccucuacgaaucuguacagaauggagcuagagcuauacggcccccacgucacuucacaggugguaaaaucuacaaggugugcccccaucagguaagaaaauaacuagggggagcuuggagugaauuugcuaauguugaacuucccauacagggacugauccagcucaguuuuggggggcuagacuuaggucacugggcaaccuccggcauagcugcccacgggucaggugcuacccccugggcuagggagggaggcugggucuucugucaguauuuuuuaagcacccuaccacauccugggcaucagcuguugaggguauaagggcgagcuuguauaaagaaugacaaagaugucguuccucccuaguugaccguauauuuuaguggggaaauaaagucaccacagcuuguggcauuggcucugaagaaauuagauaagggccuaagauagaaaguaacagggaggaaccugcugucugagguggcagagaagacugagaccugcaggauagggaggagcccauugguaagccagggaaggagugucacagccaagggaccaccaaggccgugaguggggagacagagugagcugagaggaggggguguuggagggcucccccggggggccagaucacauagagcucucuaggccagaguaacaguucguauuuuauucugacugaugagggaccuuuuggaugguuuugaaugggaaaucuguggaaggguauggacaagguggcacuggguuagcuccaggacagguuauguacuagaugacagagugggcccagguagaucuuggaacggaaacccccccccuuaacagguacugaaugggagagagguggcuuaucagagccuucacugaagcacaugagucagcagggggaucuagcuguaaaaagagaauccaguucccaacuacuuuaacagaagcugugucugaaggagaugcuuaaugcuucuacucugggcagaucagagccugcucagggaauuguguucaugcgacaggggaucaucucaugagaagcagcugacagcacggggagagcuguagaucuugggggcugugaugggaguggcaucacuuggaggugacagccaaguggguguacccagaguuguggaauggugcuuggggggcccugucaguggagguguuuacuaggcuacauuguggauucccaucugggcaacaagcccacuggggucugguggggagcuugcucaaaauacagaugcuuagacccuacuucagagaccuuaguuucuuagguuugaccucgggcccaggcaucuccauucuuaaccagcucuuagcugcugcugcugcuauguagcuagcauagugaacugguaggugauguggagagagugggguuuugaaagauguucugaggugccuuucagccuaaguugaggacaggaugcucccagcugucucucagaagggcaaggaugagcuggugacuucauuuaaggacagaaguaggaagggagcagcaugccaugggcucuggcaggauggccauggcuucggcccugaagcugauugcucaucuuccugggaagaagcgagugagaacuguacacucucugcagacuggcuuccuaauuaacccugcgccccccacccuucaucucccagguggucugcggcuccaaguaucuugugcgaggugagagugcccgugaccauguggaccugcuugccucuucccgccacuggccgccugucuaugugguagauauggccacgucaguggcccugugugcugaccucugcuacccagagcugacuaaccagaugugggggaggaaccagggcuguuucucuagccccacagagccaccuguggugagucaccuccugaggaacugccaugucuccucaagccuaccaugucuugcucugucacccaggcuggagugcagugguguuaucucggcucacugcaaccucugccucccagguucaagcaguucucgugccucagccucccgaguagcugggauuacaggcacacaccaccacaccuggcuaauuuuuguguuuuaguagagaugggguuuggccauuuugcccaggccguucucaaacuccugggcucaagcaauccacaugccucagccugucaaagugcugggauuacaggcaugagccaccacgcccagccuacuccguaaguuuuuacugaccaagcccucuguuugaggccacaguauaucacuuagugugcccaggauaucccaaaccuuguguuaaaagagguugccuuccagagaagccuagaaaguugccaccuuugagaguuauugugcacacugacauauuaaaggccccagccagcccuggauuaguuuaauucaccaugucuuacauuuaguugaccauggauaacacuguauggcaugccuguugugaucugaagauacacugguuuagaaaacacucaucuuauccaacccucuccuuuuauuaaaaggggaagcuaaggcccagaggaggaaauggacuuuuccgggucccacagcagauuaguggcagagcccuugucucugugucuugguauauuguaccagacaguauuucucaccagucauguacccuccaaggccagcaggccagccuuuggccuuugcugaaauagaugucagaacugauaauuaggaagaagggaagaauaacaaagguugagugccccagccaggaugcauuauaggaagugaaggccucuggcuuugccuuggaggagucauuauugucauuacucccuggggcucacuggcuccaugagcaugcuggggacuccagaaaagugucuuaaccucagucagagccugaucuuucugcuccccugcagccacuggccugaauggaccgggggcaauaauagcauaaguaauccaacaucuguucuggaagguggccacuguuacugucccuguucucacaugaggaaauggaggcacuggcgggcagggguuggccuaggagacacaguacauggugauguuaggauucaaagagggcuggcugagccuagaguguucucgucaccagauggguuccaccuuagucauuccuucuuaucaaaaugcauucucauuucucuucuagaguguguccugcccagagcucuuggaccagcauuauacuguggacaugacagaaacugagcacucuauccagcacccagucaccaagacugccacgcggcgcaucguccaugcaggccuacagcccaauccuggugaccccagugcugggcaccacuccuuggcccugugcccugaauuggcaccuuacgcaaccauccuggccuccaucguggacagcaaaccaaacgguguccgccagcggcccauugccuucgacaaugccacucacuauuaccucuacaaccgccucauggacuuccucaccagccgcgaaauugucaaucgucagauccaugacauuguacagagcugccagccuggugagguggucauucgugacacccucuaccgccuugggguugcucagaucaagacagagacagaggaggagggugaggaagaggagguggccgcaguggcagaauaagccaggcuguuguacagggacuacaccaucucucaagccauaguaaggcccuugccugaggcagagcuauccaggggaccugcagaaguggucuccuguggggagggccucugacugcugggacugaccaaagagcuuccauucccugagcauggugggacccaggguccucaguucucaacccuccaggggucaggagugguaccaggaaaccucuucuggccccgagagagcacuugggggacacgguauguuuaauggaggggaggcugagggaaaggcucguagcugguggguuccguggggccugcggugugggucaggguggagguccugggugggcuaaggcgugagccccagcacuaggugggaaggcugcugaggucucucccaccccugaggagcccugguuucagcccccucagucugaugaauugcuuagccuguugccuuugacuaggggccuggguggccucauuaacucuaggggucccuuugggcucuugauucucccugaaggagggaugcauuucucucuugcucuuccuguacccacauuugggggaagcugaggagggaggaacagucagccacagcucucuuccagcacuguccucuccaccccaagcuuugaggaagagcauccccuuccuccuuucccuggccacugcugcugcagccaauauccucucugggccugggacccucuccacagaggggauguggucccuggucaugacauaaccuagcagcaguaggaaaaacucccuucuaugaaggggaagcagacugggccauaaggaaacagcaggacuggcucaagugcccaagguuuguuuagggccugggaauuggccauguguuaauuuauugaguggaguagguggcuuuuuuucccucccucuucccccaacaagaauaaaguuuauuaaauuaucugguuuugguguagcaggagucaauuccgugcacaucguauggggcacaguguggucaagcuccacagcugugagcucgucacuucaugugaaggagggaaggaaagaaagacguuccagggaauuugcagguacucauguggcacaaagaaccagaggcugacugcauuaaugcuguuaguuuaauguggacagagacaucccacggcgugacuguuaguuaggaugagucagcuugggggaguuugugcuuccugcuugguguggccagccacaugccaagguccccugccuucuagcccagaaugacgggacugggcagaacacccccaacuuuuagcugccacuuggcucauuacagcaguaccaguaugggggugggaggggugaggcuguggagugaaggcggcguauagggcagagacuaagagguccugugagauucuuagaggagccauccugcuccaaggggccugagcugaguguggucugugagcaucugcugcuccucucagagagggagaucucacucucugccagucugucuagccccaaagagccugguuuucucaguaucaguguagcuccuggggacuucauaggcauaaagucaguccauuuccaugaagauaaggggauuaggaaagaagguucuacuaguuggcauagcaaacacgaggccaacaccaugagaacaguaggggaggggggggugagggcucagcccccagccccugacuggcagugauggcccaugcucaggaagugggauccucugaccuccccugaaucccucaccuucccaaguuucagagcugggccgagcuguugagugaaaugaccgaaggcagaguuuguauguucuccccgugucgccccauccauggaggaguugaaguuugugggaggggagagugguacucccugucgucaacuccucagcagaacugauaguuguugggcugcagcaagggcugggcgauauccccuugcucgcagcaggucaggugcucacuagagcucuccuccuccagcucacugcugcugcugccgcugccaccgcuucugcugcugcucggcagauugguauaguccugag

SEQ ID NO: 18568 - RNA, 4158 nt, Homo sapiens
auaagcugccaguguugcuuuucuguugguagagcucucccauuuggugacauggaaaauaccuuuccauuaucacaacaaagcaguugcucaguagaaagucuagauuucugucuuauaggugauuucugucuuauaggugauuauaaucaaguguaggcuuccugaauuuugacauccuuuuagaacuugggucuggaauuccagaaauguuaauugcugcuuguauuuguucuuguuuguuuuuuagccaguauuugcccuuucuauccagccuuaugaauaauagcaguaaaaucacaguaucuuggucagucuuuauuuuuuuccuuuuuucuuuuuuaagagacagucauccaggccagagugcaguuugaugauagcuuacugaagcuucccacuccugggcucaaguuauccuuccauuuuggccuccugaguagcuagaccauagguaugcaucaccacacccugcuaauuuuuuaaauuuuuuucuagagagagggucucacuguguugcccaggcuggucucaaacuccaggcucaagcaauccuucagccucagccucccagaguguugggauuacaggcgugagccacugcacuuggccaaguuauuuauuuuuaaucucucuugcccuucucccaaggcaggcuuaaguugagacuauuauaggugucuaauaaccugugacagaguaaugaguacaugcuuaagauguuauaauuagccaacaccaacacagcaaaaaauauaauuccagccaaagauucuggaaaaucccucagaaggagggauaacaggauuugaccuuuaccagcgauuucuguccauauguggauguaaacaguucuggaacguuaugcaugcaguuagcgaauccuugaauuauguucugguuuguacuugucccauccauccaaacaagagauucugcuuuugguagccaucuguagaaacauuuaagaugucacuagaauuuacauuucauccucucuacuuggguugagguugccuauacuugcauauuguuaaaauguuuugguugcugauauucagaggaaugaaaccuggaaccaaagccuaauuugccgauaaaaaaacuguuuucggccaggugcaguggcucaugccuguaaucccagcacguugggaggccgaggcggguggaucaccugaagucaggaguucgagaccauccuggcuaacacugugaaaccccgucucuacuaaaaauacaaaaaauuagcggggcaugguggcacgcgccuguagucccagcuacucaggaggcugaggcaggagaauuacuugaacccgggaggcggagguugcaguaagcagagauugugccacuggacuccagccugggugacagagcgagacuccgucucaaacaaacaaacaaaaaacuguuuucauuugcucucuugaccaaaggauaggacuuuaguucuuuaagcauuauuuuaaacacuauauugauacaaaaauaucuugcuuacucuaaacuuuagagucuaaaugaagcuuuuucucaguacaagauucugaguaucauaaaaugguuauuuaauugaaacguagugugguauacucuugaugguuagaacucuuacagccuuauuuauuuuuaaguuuguuacagccaaaggguuggagugugccagugcacagguagacuaaggaaaacauuauagaggagugaagagaacagaccauugaaaagacuauuaucugaccagcggaggcagaaaagagaggaacccaguugaauaggauccaaucccugguuagccucuacacaauaauagggagacaaggauuaggagccauaccucccagagcaagguaucuuucuagagcaaauuucucuuucuagaaggggagggucacagggucacagauucaccaaagcugaaagggcugaggagcucaugguagccugggcugaccuacucuggagcacggugucuuccuucuaaacugagugacuguaguacuaucugugccucugaugguaauaaaacugacaagaugucuaauuuuuuuuuaaguaggaccaaaggaaaacaagauuuagauagucugacuuugcuuuugaacaacagacauugcaagucaaaauuguugucaaauuuacauaugguaaaugaugaacuuuaaaaauguguccagguguuagaugaguucauuagacucuuuuaaugcuaauggcuaguacguuuaaacaaaacagcaguucucugcugcaauauucccauugaccacuuaaaugaccauaaguggucauuuaagaacauguuaggguuagcccugaucugaauauaaaagugagaaaagggcuacagugcauuucuugguaacuuaaacugagucuugaaguuauaaugauccauucgaguucugugauccuuauuguucuuaauuguguuucucuacguauuguuacagaugagccauacguuucuuuguaucaauguagacaugacuucagauaccucugaggaccuacccagcagucuaggacccugggccaagugcugggacuaugguacuaaauccaguagaugggcuguguagcaacucucccagggaacacacuaggguacuuagggaggugcuuuguggagcauguugaagcuuugagaucugagcaggaggcagugaugucccuggucuauucagggaaagauuucagugugaaaugguaaacauccaauugacaggauuuagauuuugcuuaguuuuucugcuuuuuaauguuucuaucccccaucucaguguuuucuuuauccaucccagugaugccuuauuugaaacugggcuuaaacugcaaaaagaaugaaguuggauuuaggaagcuguuagaucauugagugguguugagagugaaguuucacuagcagggaaguuuccuugagccuaaaauaaaaagaaaaaauuaaaaagaaucaguuuuuuuaauuaaaaaaauagaaagcuguuaggcuccuaauucgugggguuuuuuuuuguaaaaacaguuuagauaauccugaaugcaaucauuaacuugguugcuaauuacaagaaugaaaauuauaauggaaaaggacaaaauaauauaccagcugguuuguuauuauaguccguguauuaaaauacuauugaaauacguuaaagguaaauuuuuaagguuuaaaaaaaauuuaguaacuuacagggauggagaauuuagaugucagagguggggagauuuauuuuuauaagguaauuuuuauccugauaaggacuuaaaaaaaaguuuugcaacugaaauuuuaaaguaaacauguuaaguacaguuaaaaaguaagcauuguaguaaauaguggauucucugguguguauuuuuuaucucaguguugaaaauuggaaaagaauggacugaagucuaaaaacuggaauaaugaaggacacuaaaugccuuuauuguagauacuauguuuguaagucuauagcuaagcaacuuaagccaaaaaggucuuucaacugaagcuuuaaucaacuuauuuuggagauguucucuucccuuaucucaugcgucaucccuaaaauaauaagauacaugggaucaaauagcccuugccuuuucaacacaaaucaguuggaaaauuaugguuugaguccuguugcugccauggcuucuguuucucagaaaugaguguguaugaacauaccaaucuauguaauaggcuaccuuuuuuugucuucuuuggaacuuuguacacaaaccaagacaauaucagggugacaggugaaugaacuuaaauucucagucuugucuauucaccaaaaaaguauacugccuguuuuuucuuuaauuauucaagguugaugacuuuuaggaacauguuuuauacuguauuuuuuaauuaaagcaagugccuugauguaauuccauguaaaucauugcuuaacccucuuaugggaugaggaugaguuauuaauguauugcagccuacuggaaaggagggggaguugguuaauagcagauacuuuucuucuagaagcuuauguuuuaugcuguuuauuauguaagauccuguauguguguugagauuuagagguuucauuuguuuugucugcuaauaaauuguuacucuaauaauacauuacucuguauuuaaauuau

SEQ ID NO: 18569 - RNA, 1807 nt, Homo sapiens
cgugcgaugaggagaggcccgagcacuuugggggugcacgguggugguggggggaaugaguaaaagcgcagcguuaucgugaaccccaccccagaugauuaccucgccguuggugauguugaucgccaaauagauguccccgaaggagccagacccgaucuuccguaccaguuuauauuucccuccgacaaugaauucagccuuggagccgcugcuacucgccauccugagagacgaagauggaggcuggggccaagccccgacaccucugggaagaggacggaggccucggggcuccuacacuaggcaaggcuacggaggagggcggcaggaaacggaacacggaggccuuuaccgggguucggggcccagaaucagcagaggggaaccugaucaccgccgcucagucagguuucuuuuugccaggccgcaguuugugaagggcuucucggcgguuaccaggcugggccacuuguuucucggcggccgccgcugccucgcuugcgcggcgacgucgcgggcuggaaaaggggcgcggugagcuagggcggcgauaccgcugccaccacugccgccggcuccggcccagagggaccccugucacuccgcggacgacgccaucuuguuacuccagcuccagccaacacaaaaugcccccaguccccgggagccgcuucuucacggcgcagagcacucugggaaagggaucucgggcgcucgcuccgaaggaucggcagcgagagggcggaaccggauccgugagagucgcggcccacgcuccgagcgucacccugucaccgcccagcugcgcaugagcgcugcaacuccugcugacugcgcaggcgugccgcggccuguccucacccccgucccgggcucucuuccacuuccggucggcggcggcucagcagguguuaccuguuacucgccucggacccgccgggucucuggaaggcugaguggccccccggccuugauauugggaggagucaccuucauguuucguggcagaugaaagcuuaaggccuccuuaggaguuggguauugaccugugcucuuugaggcgguuuuuaaccuuugaucuuucuucuggccguucccccggaccggccuauuccaacccaguuucuguuuggaaagaggcugucgccucugguggagaggaagagaaaagcagccagcgucgaggaaucucucagggcucucgguuguagcagagccuagcuaauuacccuucauaauuagaauuguccuaucuacuacggaguguuauagacccucuuuccacaggaggggaagaaagaaagaagccggaaucccccugccauccuaugucuuugcauuauugccucacuaccacauaugaucuucagaagaaaaccugguauguugcucauaaugaagauuaaggauagauggaaucaacagaaaauuaauuuaacaagagugaaaaaacuguuauguccccucaaccccaccaaaaaaaaaaaaaaaaaaaaaaaaaagaaucguauguuggucuuguugaaaaccucaguauuaaccugaacagaguagagguaacuauuacaaaauuuaauugacaacauuuaaaacuacacgguaauuuuuuucuuuuuuacaaaaaaucgaucagagaaucaaauuuugaccacguuuuguuuuacaaaauuugaccugggaaaauugggcuuaguaauaauaauguucacgaaagaaaacuccaugguugaugcuaucaucuuaagucagaccucagucguaaaaauuuaagcuaagccuauccuaaauaaaauuuaauuaaaau

SEQ ID NO: 18570 - RNA, 57496 nt, Homo sapiens
gucaaaagcuauaagaacauauuccuuaauaguucagcaaacuuuagggaaaacuagcucauugucuuggguucuaaaguccuuuuguuugauuauuuuuauuauaaugaaauuaaacuuaugacuauuacaguaugcucagcuuaaaacauuuaugaguacugcaaggacuaacagaaacaggaaaaauccuacuaaaaauauuuguugaugggaaaucauugugaaagcaaaccuccaaauauucauuuguaagccauaagaggauaagcacaaccauaugggaggagauaaccagucucucccuucauauauauucuuuuuuauuucuuguuauaccuucccaaaacagagacauucaacaguaguuagaauggccaucucccaacauuuuaaaaaaacugcaccccccaaugggugaacaaaguaaagaguaguaaccuagaguucagcugaguaagccacuguggagccuuaaguggugaggucuuccaauuucagagugaugugucuucaacuuguaucaucauuuuagcggaaaaacauaauuuaauuuuggugaaaugagauucaucucguaacaggauuaguaacagcauucacugaauuucacacucuucuuuugugaacagugaagaaaaugaaugguagcuagaagaucaaugggauuccagcuccagcugcagauggaaugacgauauaccaggacaaaaaacaccuauauuuugauuuacaaagcuaacagcaguuuuaaaucugcaacuuaauuacagaccaacuacaccacaaccuuuucaaauggcaaaaauacaaaaaaguguuacaaaaauauuucagaaaaagugcauagucuaagugcauaguaaauaaaagcacugaaaaauaucuugcuagagggaguucagcuuggaaguuauuaccaaagcuaaacauuuuuauuuuacacaaacuauacucaaaaauagcuuuaugagacugauuucuggcuaaaaguaucaaaggguuuauuagucaagaaacaaauaccucaaccgacaaggguggauagaaaagaaacaaagaagcugccuaccccagaaguucagacuuaauaaaauuucuucaguauuacgguacuaauaucccuuaauggcagaaugugauaaucauggaauuaauuauugcuaaaguaguuuucaaauaaaaaaaagaaaaaagaaaacaaaacaaauuaaacuugacacaaucugaccaaacacgugucaauuuacaauuucaagguuauuuuacaaaauaccuacauuuacacaauaggcucccggcagcauuuccagacaaauguucuuuuaauuuauccugacaugcuauaaaugaauaaauuacacuauuuaaaaauuaucaucaguaaguuuuccuuucucaugggucagagaaaaagaaaugagcgugcaaagaagauugagaggaagcgcacgcacacagauaacuuaaagaagcaggaggggcuggggagggucaacaaucacugaaccucacacagugugaugcucuccaagggugaaagucaacugcuuauagccauuucaaaaguauuuuaaagaaaaauguuuuguagggaaacccuuuaaugcuuucauuuuuauucaaaaucaguccagcugcuagucagcgggcagcagcuacaauaccaaguucuggcaguugcaguacuagauauugugccugcaagucauaaaaaaaaaaaaaaaaaaagaaaaaaaugaaagaaugccuuuccccuucagacaaaagaauuacuuuuuucauuuuucuuaaaaaaagaggaaaaguuauaacacgaaaccuaaauugacuugcaaaggaauaccauguaacaaauggcuugaaguagucuaucaaaaaauuggggagauuuuuauuuaauagugagucagcaaggcauuuuuuguuguuuaaaaaaaaucucauuuccuuacagaaacaguuuuuaguuuuuaaugaacuuguaaacaaaaaagcucccauuucaaaauaaaaacaaaaucccagaucauauagauguuuacagugauuacauuuaucuaagcaacauacauacauguucaguuguaagauguuaacuaaauuucugugacaaauaugcuuuuuuuuuaauaccaagaacauuauagaguuaaugcagaguccuaaggauaaucuaguagucacuaaguuuuucuuaagucuucacuuuagaugcuguuauuucuagcacaauuaagcaggcagagucuuucauaugcucaaacacuggaaucuuugguugcuaccauaucagcuggcuugcagacaagaagccaaccauuuuaagaauguuuuaagugaacaacuugcaaaccccagggauggaaaaacccuaagaaugcacaauugugagcauuuaacaaccaucacaacuguggcugaagacuguucaugccguucuucugaaaugagaucucaaagcaguauaguucaaaacaaaagguuuuaacaaaaaauuggcauaugcacaauuucuccaccaauuuuugugugucaaccauuuaguuaacuuuuccacuugaaaaaaugcaauagaaaaccggacaccauguuucacuaucucaguuaauauucacaauuacagaggcuacaacucaggauacagcaucaccaaugcugcccagagucaguuuauacugaaauuaaguucuuuacaccaaguaaaugguuguccacaaccacuggcuaguguacauaugaacuaaaauuucuagauuuggggagaaacaaaugcugcuccgaucaucugcucugcuucuucuguuccucaauucaugcuuagaaaccugguaaaaaaucaaaacaaaaaaaaaguuaaaauuccaagucaaaaauuuuaaauuacacccaaaauauggaaauuggguggaacugagccaauaauuauaguggcucauguuauuucgucucuugugaaaaguauuagcucaacuuuuuaaaacagaaaaacaugaaucuauacuuaaaacuaauuuuuucuguuuugaaugacucuaggaaggagugguacagugaauucaaagccucucagcauacuaaaauaauuauuaguaauucaaaugagcauguuucugcauuuuuacauaugcagaacauauuaggcauucacauauuuaucaaaucaaugaaaaacagauugcuuugcuuuaacuaaagaauacaauuuuaauccuaccauaggcacaaauuauuucugacacaaauuaaaacgguuagcuuuaauaauaaaugcauucaaagcauaauuaucuguauuauuuuacuaaacaaagaccugagaagcauguaauuucuguagagaaaccuuagaccuuuaaaacuucuuuaccggccgcauuagaaagauuguuuugugacucauuuaaaaauguaagcaagugaugcuuuuuuggcuuuauuuacuucucaagccuacacauucuacaaauacuucccuccuccaccacaaguagacccuagggccucuacauaggcccuaggccaaguuugaauacaagaagccucaggucauaaccacacuuuaucuacagcuaaaggcaaagggagaaaauaugccugucccacagcaauagccugaaaaucucuuaagcaccguuuuuccucucaccagacacccacucugaggcaccaaugcuccuuugucuaccuccuuacaaaugagcuagaaacuauagcucauucuagcccacuccaaucaauccucacuucuucagcccaggucauguuuucuucaaucauaaacugcuccuuuucuuuuaguucuuuuuucuuuuuuuuuggagacagucucgcucugucacccaggcuggagggcaguggcaugaucuuggcucaccgcaaccucugccuccuggguucaagcgauucuccugccucagccuccugaguagcugggacuauaggugccugccaccaugccuggcuaauuuuuguauuuauaguagagacacaguuucacuguguuggccaggcuggucucaaacuccugaccucgugauccacccgccauggccucccaaaguguggggguuacaggugggagccaccgugcccagcuucuuuuacuuuuuaaacauuuguugggccaucucccaugggcuuugugggagaaacaaaauaauucuaauauuuauuucuuaugcauauaugccccuuuuuuuuuuugggaaauaauagcgaacauacaagagaguaggugcauaauagaucuuuguugccuggguacuaaguccauaagcaccaaaugccaaaaaugaaagauaacauaacuuugagaauauacuucaccauagggaauaucauuugaugcauguuauuaagaaguauuagcgagguaaaccuuucuuuuaaagguugucaaaccaaaccuuaauaaaaaucugacuauacccugugaccaaauuucaauuuuaaaauacaggaaaaguuucaagcuucuuguuugggaguuuaaaaaagaaaaaaaguacaauacaggauaagcuaugcagguuaagaaacuaaggauuaaacagaaauuaaacagauuaaacaggauuaaacagaauucccccaucaggauuugguuucaagucuugcaauucuucuuaaacaugauuuaaaaaacguauuuucacaacuacuaaaauugcuggguuuuaucauaguuuucuuauguaaucauauuaaacuaauuguuauggugaauauaccaaauggcuuucaaagggaaaaccaccaucacuaacaaacuaaaauggaaacaugcuacauugucagucaaaauacaaggaaacucuugugccuuuaauagcaagaaaacuucagaauguaucuguacaucuuuugaccuguuaucugaggaauugcugagucaauaaaugauuacaauuguuuagaaacugguaaaaggcuacccuaacaauauuccugguagaauagagcagucaaauccagcuuuaacucuucaaaugggucaaugguaugacauuccagccagggaucaacauuucuccagugaauuguccuaagauguuacugaaguauguuuaggaaaaaaccucaauaggaauauucaacagguauucaacagucuugcaguacuaagcauucuuuuccccaauacgcauuggucuuugguuuuuaucuugcagauuagguggcucauccaggcuuccaagaguucaagaacccaucuucacuguaacaucaguuaaaaugaggaaugaaucccuuuauuccuuaaaaaaaaaggggagggggaggggggaguuaaaacagaguuggaggaugugaugauuaagaaguuaauagcuuaauuaaauuucaaaucugcaaaaagcaaaaaaaaguuuauuuuuauauaacuaacaaggauauucuaucccugcccgccacccaaucugaaaucuaaaauguaugcucuggcccagacgagguggcucacaucuauaaugcuaacacuuugggaggcugaggcaggaagaucacuuaaagccaggaguuccaaauaaaccugggcaacauagugagacuuugucuauuaaaaaaauaaacaaaagauaugcuuuuuuuuuuuugagauggggucuugcuguuauguugcccaggcuggacuuaaaacuccugggcucaggagauccuaccaccucagccuccccacaaaguguguaucuguucuuauucguaaauuaauuucaacaguuuucgacuuuuuaaauagaaccagaaacuaguucaaagggauauuuacguagcaguaaggcuuguaaguuugugaugggcuuuugauauuuaggaucccuucaagcuacaagacaacuuuuuaaaaguuauuuugaauauauuaauuaugcuaugucauuuauacuaacuuuuccuauaacaugguugugggguuuuuuuucuuuuuuucuuuuuuuuuuuuuuuuuuugagacggagucucgcucugucacccaggcuggaguacaauggcgcgaucuccgcccacuacaagcuccgucuccuggguucacgccauucuccugccucagccucucaaguagcugggacuacaggcacccgccacuacgcccagcuaauuuuuuuuuuuuuuuuuuuugagauggagucuugcucugucgcccaggcuggagugcaguggcgcgaucuuggcucacugcaagcuccgccuccuggguucacgccauucuccugccucagccucccaaguagcugggacuauaggcgcccgccaccacgcccggcuaauuuuuuguauuuuuaguacagacgggguuucaccauguuagccaagauggucuggauauccugaccuugugauccgcccgccucggccucccaaacugcugggauuacaggcaugagccaccgcgcccggccccagcuacuuuuuuguauuuuuaguaaagacaggguuucacugugucagccaggauggucucaaucuccugaccucacgaucugcccgccucagccucccaaagugcugggauuacagaagcgagccaccgcacccggccuuuuuuuuucuuuucuuuuuaaaauuauuuaaaauagcgaugaggucucccuauguuguccggaugguucucaaaauccugagaucaagugaucuucccaucuagccucaaaaaugcugggauuauaggagugagccacagugccuggcugcuugugugguucuguuuguugcacagaauuaagcuuggagaauuuuaaaucagauuggcaguaucuaaaguuaaagaauaauuaaaaaaaaaaaaccuguaauaacucuuccuucccuauagaaacuaaaagaguauuuaaaguugggaaagauaaaugacaauuuuaaguauaggagguauacacuauuccuaaacugcauuaaaaaacagacugaauuguuuugucuuccuuauaacagaauucauucugcuacacauuucugacguucuggaguuuuaaaauaccuguuuauaauugauucuuuccccagcugguagauggucugcauucaacaccacugagucauagcaacgcuguauucuucuaggucuucuaacaguugugcuaucauccagaugaucuaacaaguugcagaauuugaagguccagcagucuuggagacauggacuccagaugaccacaaaccaacucuugcacuuucauccgcauuuccuguuggguuauuuagaucuuuccagcuuuacuguccacaguaaaaaaaaaagcugacaaaaauucaagauuucagcaagaagaugcgguucccugguacuucuuagaauugaguguauucagagcaguguguucagacuguccagguauuucaaaaucuuccccugugaugugggugugcugcugagugaccagcacauuccuagcagcaauuggugaacucagaaaaagucaaacuagacauaaacgguagaugcagcccaguaaaacuggaagguaauucaaggaagacuguggacaugguaggucaauaugauagaaaaauaauauuuguaauccccucugaaugucaauacuuugagagcugucuauauuauuaugauaaaacucugcuuaguaacuaugguuaggguaguaaacagauggguuaagaugaugagaguacagaauaguagaauuauccaagaauccaccuuuggguucacuaccuucugaaauucucccccaccucugccugcccucaauuaaagaaacacugaacuucauuagauuuugaauguccuaaaaauauuucauuuuccuuuacuuauuuuuaauaucuugaaaaauacuuuuuugauaaucacauauagucaaagggagugaaauaaauuucgaaguguguugggugugaaucuuauguauuuuucuugggaacaugaauaaaaacaguaauuauaaucuuguaguaauugaacauuaaaaacuaguauagauaauaaguggcauaaagagaagucuuuugauggauauuggaauggaguauuugaaaagaucuaaagaauauaaggaaggcagaagucugccuauuauuuaauaggcccacauuagcuagauaagccagacuuaaagaaucuuuaaacauucuuauuaaguuauuaaaacaacaccauuuuuacugaagaaauaucagauauauuuuucaaaaauuaccauauaaaacauuaguaaaugcuaccauuuuggggauuuuccuacauuagagauuuacuugcuuaaaauacacuuaugaaacuuaguucaauaauacuaaauccucugaaaauuuaacucugugaagaguaauauaaaaagcaccuucuaaaaauuccuuguugugacacagggucucaucuguugcccaggcuggagugcaguggcaugaucacagcucucauugcagccucaaccuccagggcucaggugauacucccaccucagccucccaacacagcugggaucacaggcacucacuacugcgccuggcgcuuuuuuuuuuuggggggggggggguuggggacgauguuggagggagcugggacagggucuuacuauguggcccaggcaagucuagaacuccuagggucaagcaauucucccaccucagccucccaaauguguuggaauaacaggcaugagccacugcgccuguccuaaaguuuuuaacaagaaaaccccaguaggauguuuucaucauuauuaaaacgauuuauuauugggaucaaugaaucauugagcuguaugaguuccuuuuuuuuuuuuuuuugagacagagucucacucugucacccaggcuggagugcagcggcacaaucuuggcucacugcaaccuccaccucccagguucaagcaauucuccugccucagccucccaaauagcugggaccauaggugcacgccaccacaccuggcuaauuuuuguauuuuuuguagagauggguuuccaccauguuggccagacucucgaacuccuggccucaagugaucugcuugccucagccucucaaagugcugggauaacaggcgugagccacugcacccagcugaguuauuccuuaaauaaagaaccacuauaguggaccuuaagagacuaugcuuuuaaaugcccuuguuacuuagagacuggaagcaggaauaacauagagcaauuguuuucaaacuccagaauuccuaggagauuucuuaaaggauaacuugcugggcuggggguagaaguuaggggaauauguuccucaugcuuauuucaugccuaaggcccgaaggccagcuacauuuucaugguuuaugagaguuucauguaagauuugucuugagcacaaaguuuuguauuaaaaaagaaaaacagauguuuucaagaugucaaagagcaaaaagaagucuguguucugugaaauggcacuuuucaguagcaauacagauguacugccuuggaaguguauuucuaaaaagcagucaaugacaugugauguguuuuaugaaaagccuaauuuuucaaguccauguuuaugugauaauuuguaugaccauugucucuaaugucacuauaaaauuuuuaaaagauuuuaaguugcuuuuacaaaaaauagcuacaauacaaaauaaggauuaaacaaguuuaauuacaguucuuucccccgccccaaugaaacuaacucaguggauccaacuucucaucuuuaagacauggauagggcaggacacaaauucugcuuguuuauugaauaagagacacacaguaaacuaacaaagaaacuaacuuaaaauaagguaauucuuucugaaaucugcugaaugccugaaguaaaauguucuaggucagaagagauuucaaucuaauuuuaguuauagaaacugcaacuugugaugauccuauuaucccagcuagcuuucggcaaaauugguuucauuuugugagaaaaagcaaauauacuauagguugucagguguaacaaguccuuggguuagagacucuguuuggucuuaccuaaaaugguaggacuguuuuucagugacauuagcuacauaacacauuaugaacuucuuggcacuaugauuaguuauacgaugauuaaaacacucaaaaggagcaacuaucccaacugagaugcagaggcagagcacugugugaacauuaggguuugcuauccugaguuuacaugucaccaucugaaaaacccaacgacaauaaaccuucaacuuugaauccuucccaaauacaaaaacauggaauagaagcaucucaacuucauuccuaacagaugagcugcugggaugaggaugacaucaguuaauaauauuucuugaaaaguaucuucagauuagaaucuauuuuuaaauuauaaaauaguuuaaauacaacacuaaaaaugugaagcaaagauuaaucuauaaaggccaaguucagacuagggcaguauucagaaauuuaaaaauuagaaaccaagagccaaaucuuacuugcccacuacuuccagaaaguaagcagguaucaggagguaagccccagaaaugggaaaagaaagacaaaacaugaaaaugggaguuaaacuguauagcaacagugugcccuaacaguucuacuccuuacaggcaguaagagugccaaagaaaaguagaaaggaaauaagacuagcgguuucaauggcauuugccccaguuaccuucaauuugcaaggccuggcugcagacuucaauuccacauuaaacccugggagccugauauuugcaacauugugaaaaaucaagccaaaaacaaagaaaucguuuugaaauuaagaucauacguaaacugcaaauaaaagaauuauuuuugugacuagaaaagaugugcugagcuuugcauuuauuugagcauuuaagagagaaaaugagaugcucugcaacugagaagauagacacuuuggggguaaugccaaacucaccucuugaaauuacaacauguucacaauuuuccauuuuaaaugcuaaagcauuaacaugcaaaauaaaaaaucuuaacauuguuagucugaaauaaagucaaaauauggcuaaccaaauucauuauuagaaaucaacaaguguuaggucuaggauuuuggauugauugauuauauuauauucccaacaccaaauuuuuggaaaggggguuaaugaaugaguaaaaaagaugcaguuguuaaaaaaaugacccaaaaucccaagagaaaugauauaaauauacacacauauauguauauacaaauacauauacauauauaugaacaaggacauuuggguuuaaaguuaguagucaaauuuuccaaggacgucuuuuuuuuuuuaacgcagagccaaauuuuuauguauuuuaaaaccaccuccuugaucuaacacuguuagaaaugaauuacccaauuuuguauucaauuuuuucccuguaacgucacuugguucuuggcuacuaaccuuucauguuacucuugguuuugucaguuugcuugccuguggggguuugggccugcugacccugcccacuggaagaggcugccugcugugcugcuuucugcuuuaacauuguccaaucaaauguguagucauauugaugguucaggguccuggaacacauaaaauauuuuauguuaauccuuuaauaacagaguccaguuauauaaccuacuaacuuuuuaagacagugacagcauuucuuuacacaacgaauauuuccucaaguguggcagcuucuaaaauauuucuuauuauagaugaaaaaggcagcaugaaaacugaaacaugaaaucaagcugucaguuaucuaggggaauacucauaagaggagguacuuccuaaaaacaaguaagaguaaauauucaacuggaaguuugggaauaagaugucugacugguaccuggggaagacacuuuucugggguuaaaagauuaccugaauucucucuuuuuuuuuuugagaccauguuuugcucuuguugcccaggcuggagugcaguggugcaaucucggcucacugcaaccuccgucucgcagguucaagcaauucuccugccucggccuccugaguagcugggauuacaggcgccugccaccauacccagcuaauuuuuguauuuguagcagagacgggguuucaccauguuggccaggcuggucucgagcuccuggccucaggugauccacccccaucggccucccaaagugcuaggauuauaggugugagccauugcaccuggcagauuacuugaauucuuuguuuuucucuuuugagacagagccucauugucacccagguuggagugcacuggggggaucucagcugacugcaaccuccgcuucccagguucaagagauucuccugccucagccucccgagucgcugggauuaaaggugagcaccaccucacccggcuaauuuuuguauuuuuaguaaagauggggcuucaccaugucgggcaggcuggucucuaacuccugaccucaagcgaucugcccgccucggccucccaaagugcugggauuacaggcgugagccaccguaccugggcggauuaccucaauucuuacucucuuccaacuaagaguuugagccacauguaaucuauuccccccccuuuuucaagaccaguucuggguugugccuaaggaacccuacccuaguuuaggacugcuaccacuugaucagacuccaugacuaugugauauuuuaauugcuuuuuauuugguacuguacaaaguuggagaguuccagaaggcacugacagccacuuauaucuaauaugaauuauaacuauucuggaaaaguuacauucuacuuugaguaugauucaacucucuauccacuccaaacuaaaaucaccuauuuacacuacaaauagaaaaaugccaaauuagucccaaauaaaucaguuucugaaaccuuuuauucauguuagcuagaucugcuuuacuuuaguauuuaucagaaugaauuuguuagguaaauuuaaccaauuucccucacagaguuuauaaucuuaaaauaccuuaaaaacugaccugaaaagaaugcggaauagcugccucagauacauguaaucuggggcuuccucaaagcguagcccacgacaauaguuuaaguacaucgcaaauucugcaggaaaccccuauagguucaaggguuaaaacaaaguuaaaaacaaacauuucaagauagaaaaauaaaugcauuuaaguauaagcaaaaagauauuuuugggcgggauauuuuaccauuucauaggaagauaugagagcuaaaaugauggcuuggucuccucauaaauuuaaauaaaauuucaugacccuaccuacccuauuauguacaauauuaguagaagaaauacauauguucuucccauauagugcuuuuccuauacaguacuauguucuuaaauaacuuacauagcccacuuguuaaaaccugucauuuuaucaaagucgcgccucuucgugaacuuuuuuuuuuuuuaaagacagggucucaaucugucucccaggcuggagugcaguaguguaaucucagcuuacugcaaccuccaccucccaggcuucaagcgauccuccaaccucagcuuccugaguagcugggacuacagacacgagcuaccacgcccagcuaauuuuuuguauuuuuuaguagagacaggguuuugucagauugccaaggauggucucaaauucccgagcucaagagaucugccccccuuggccuccuuggucucccacagugcugggauuacaggugugagccaccaugcccagccuucagaaguuucuaaaugguugcaugauauucuaccuaguauauacaucauuaacuuguucuuuauaauugaacauuuggauguauucuaauuuuucucuauuauuaauaauacugcuaaguacaucugugggcauagaauuuuuccauuuagcuccuuaggaaagauucucaacaauguauaaacauuuucaaggcucuagguaucagucaccaaaaggauuuccccaaucagcaauguggaaauacaaaauauuaaaagagcacaaaccucuauaucuccucuccuagaguaaaugccaauguggagagugguaaaguuaaaggaggcagucucuuucuacaaccuuaugauuguagaguuaaaguuacaaucucuuucuacaaccuuaugagaaauuucucauguccuggaguuaggaaggauagaauggaaaugcuugcaacauuuuuuauugauugcaccgauauaaauugggugaccacuugaaacauauacauauguuaaaagauguaaaauaauacauauuauacaucuuucuaaaacucaacauuuauauacauuuauggcccguguuaaugguaaacaguaugacaaugagacugaaaacaaucucaccacuuuauaauuacuauuuuaacucucacugauuucuucccucaacuauuuauuuguauacugcuuuguacuuaauuucagguauacaauucuuucuugucugaaagaccauauggccuucuuuuuauggaugagaucaugguuauucaucaugacacaaauaccucucuauucuaaacucaauugccuuucuaugaaguugaaaauuucagaaaaaaugagugugauucaaacugucuucuguauuccuguauuguuggacagcugcuauuuuggauugcuccaaucugucugcauguuucccuguuccuuaauguacuaauuguugauaaccuuucuuuuccagcacuaguuuaggguaaggagaauauuucuuacuuuuucuuauagauuaaugagguucuauugaaaauguuuaccugcccuguuuauuuaccccuaguuuucaacagauuagagagcccuaacaaaccagaaacauaaaacacuuauuuuacuuacuuaaaacguuuauuuaacuuauuuuuuauuauuuuacuuauuuuuguuguuguugagacagggucucacucugucacccaagcuggacugcaguggugcaaucuuggcucacugcagccucgaccuccugggcucaagcauccugccccagcauccccaagaagcugagauuacaggcaugcgucaccaugccaggcuaauuuuugcauuuuuuguagcgaugggguuucaccauguugccuagacuggucuggaacucccgggcucaagcgauccacccuccuucagccuaccaaguggcuccucaacugugagccacugugccuagcaaaacacuuauuuaaaaagaccccuauguuaaaaguccuuguuaaagauauuuagaauaauaaaaauguaaauuuaaaauggugaauagcuaccuaauucaauguuacaaguuccagagcuggcaaauaaaauguuccuuuuucuuccuggaucauucauucauucacucauuugagacagagucuuacucuguuaccuaggcuggagugcaguggcacaaucucagauccuugcaagacagccaagauucaccacugcaauuggagccucccgggcucaagugauccuccugccucaggcuccugaguagcugggaccacagacguguaucacugcacccagcuaauuuuuguauuuuugguagauaagguauuucaccauguugcccaggcuggucuuguggaacuucugggcucaagugauccgcccaccucggccuucuaaagugcugggauugcaggcuugagccacugugcccagccggaucauuuaucuauuaagguagaaaugggguuucccuauguugcccaggcuggucuugaacuccugggcucaugugaccuacugccuuggccucccaaagugcugggauuacaggugugagccauugugccuggcuucauuuauauuuuuuuaauauucaucaugcauacuuaccuuacauaaaacuucaacaggcguggacaucuucuuuucacuaaucuuuucauauuuuuguuucuuuguugcagccuguggaaaagaauaaaauaaaaaagauauacucagugcuacugagaagaaccaugguaguuuaacgcacuagacauauaaacauauaccugugagauucaagagaaauuuuaacccagaauuuaaaaaaucaaaguauaauacaucuaaaaaaaauuuuucccaaacuguuaacuucugauguaaguuucuucucuaagaauuuaauuuuagcuauagggaaagggugagucuaauaggaauauauggauauuagauuuaaguaaaaauggcuggggccaaaauugaaaagcauuuucuuucuuucuauauauuuuuuuaaggagauggggucucacuauguugcccaggcuggagugcaguagccauucacaggcucagcaguaauucccuguggccuccaacuccuggccucaagcaauccuccugauucagccuaucaaguagcugggacuacaggugugcaucaucauacccagcugaaaagcauuuucuuuccuuuuuccuuuucuuuguuuuuuuguuuguuuguuuguuuuuuugagacaaggucucccucgguugcccaggcuggagugcaguggcucgauuauagcucgcuguagccucgaacuccugggcucaaagcaauccucccggcucagccuccugaguaauuggggcuacaggcaugugacacuacacccugcuauuuuuuuuuuuuaaaguagaggugaggucuugccauacugaccaggcuggucuugaacuccugggcucaagugauccgccuggcugggccucccaaaguguugaagauuauaggcaugagccaccaugcucagccugaaaagcauuuucuuaacccauguucaacacaagggcaaaggcaucagauuaauacaaaaaaauuuguucaucaauuagugacauuaauaaauggaguuaacuguauaagucacaauauuuuucuaaacuaaaaauacucauauuagauaaagcuacccacccaaggacugagcacuacaacuagcucacagccacucaauaaauacagguauuccuucaaagaacugguaagguaccaaaauagccauuaaaauuuaggacacaccaacaguggugacucacaccuguaaucccaguucuuugggaugcugaagcaggagaaucacuugagcccaagaguuugagaccagucugggcaacacagugaggcacugucucuacaaaaaauaauuuaaaaauuagcugggcaugguggcauguuccuguagucccagcuacagguaggaggcugagauaggaggacugcuugagcccaggagguucaggcugcagugagccaggcauuccggcuugggcaacagagcaagaccauuccccaugcccccacccccacccaaaauuaggauacggugauuuaucauuaacauacacucacaaaaguaacaguaaacuccuagcuaauagaaacaaaauguuaggacauguauugcuggauaaacaggucuugcuguacauaaaaacauacauuuucaacauaauggcaacacaucaaaaugagaaagucuccaccuuucuuaguccaugcccacuuccaucuagauagagcuaguggcuaccaguggguaccagcuuacugucucuuagaggacacuguucuucagcugaacuaaguucuuacuaaaaugaucugguuucauuuucccagauaaaagguaaaaaguaaauuaagguuaauucuuuauaucucagaaaaaucucagacuuagaagggaccuuaaaucuuaucuucuccaauauauauuuuuauucuaaaaaagagagagaaaaaucugauaaugugagucugguuuaccuuuagcccuugccauggcaggcugguucuauuaaaauacaucaaaacauauccuaaugauuccaugucaucucggcgacuagaaaagagaacguaauuuuauaaacuggaacuauuauuaugaaaaaacauaugaaagaaagucaaguacccagaagaaauguucccaaaugaggagggaacacuauuuggugucuuacgcaagaagcuacuuauuuaaggugauuuuaaaaaguucauguguuaccuaccucuaaacaaaacuuuuuccauggaauccaaaaucugacaaacaacugucuuacaauuuaauuuuaaaagaacagaaacgauuuggcuaaacaacccucuaaaugagcuuaaugaaccaagcaggaugacauuucuauguuuugcagaaacucauuaaaaaaaaacuucagaaguacugaaaaggaguuacaacuuaaaacuaauugaacaucuauaugaauguauucaugcauacauaucuauauacacauacauacaaauauauauuuagauauauauauauuuaaggauagguaaugccuuggcguacagaaaaagugacauuacaguuuaaccuagaucauucagauauucauggauauuucuuaagccugaaauucuugguaugagguucuuuaaccuggaggcauaucauuguuuuuucuacuuauuacuucuaugcuaguuuuaaggagcaaaaagugacuguaaaagaugaaaggaacucgaaacucuagaacucaugugaagaaauaggaagagagcagagacuguuacuuuuuuuacuuuaaacuagauccuauuaauuuauauauuugagugaaguauaacaggagaugguccaucaacccacuuuugguuuauuaggacacugauaacauuuuccuuuuaaaaauaaauaaugcauucuucccaaacucagcgugaauuacuaaaguauaaaaagccccaaauagcucuaaaaauauauguacuaucuucagcugcaaaaagaaacgucaacauugcacuuaugcuucuaacuuucuaucacgcaguauuuuccccccaagagacaaccuucaacaacaacaaaaaauccagaagaccucauuuaacggucuucucuacacugguuaaagcagcagguaaaaugauuaauaagcauccuucaaauccucagccaagaaacauccuuagacauuguaagaaacuaaaauauuucaaaaacccauugauggcuucugcuauggcuaugauaagcacauuccauuuucgaacuuaccucugcucaauaccaagaugugcauugaugcuagcauaucgggcagugccagugagguuuuuaucuucucuguaugguauguguugccuuguccuguugucucuguacuuuuuggccaaaccaaaaucaauaaggaauaacuuuaaaagagaaauacagaaacauuagguuuccaaccuuguucaauuaaacugcgucuuauucauuaaaugguaucuauucuaugcauucaaauauaucaaaauaaaguauccuaaguauuaauagaacagauaaugaacagacuuaacacccccccauaagcuuuuacuagucuucaucaauaaaucaaguuaaaaaaaaaaagucuaguaguuuauccuugucguuugcagauuucacaggcccauuucauuacauacucaggaaccugucuuuauaaagaaagaaauguauacaugcuugacagcagaagcaacaagugugcuaucugucauaaugacaccugauagucuguacaccuguuacuacugguaaacaaacaugagguuucaaaaucuagauauaauggccgagcgcgguagcucacgccuauaaucccagcacuuugggaggcugaggcaggcggauaacuugaggucaggaguucaagaccagccugaccaaacauggcaaagucccaccucuacaaaaaauacaaaaauagccgggcaugguggcacaugccuguagucccagcuacacaagaggcugaggcaggagaaucgcuugaacccgggaggcagagguugcagugagccaagaccgcgucacugcacuccagccugggugacagagcaaaacucuuucuuaaaaaaaaaaaaaaaauccagauauaaacuaucugaacucuucccuccuacaaaggccauucuuaaaugugccaacagaauacuuguuaucuacccuaaaagucugacauugccaaugaaaccaagacuuuuuauuaauaaaaaauacuacuuagcacugacauuauacaaaugggucagguuaaacuucuggaaaauuuaacaaguugauauaaaaauccccccaaaaagcgcuuagcauuuaaaucaagguggcuuacaauuagcaguuuaagugagcuaacuaaaaacaaaaacuaguguuuagaacaaaauaacguuuaguguuaucaugucuauaugguacucagggaauaagguauucauuuauaauguagcuaauuguuguauguaauucaaguuuacacuccagaacuuaagccuuuuauaaguaaauaacuauuuuuaugaaaaagaaauccaaaacauauucauauuuaccuaccauaugaaaagaaauaaucuuuacuuaaaauuuuggcuuuugucauaaaaucaccuauuaugcuauauuuuaauaaaaguuaaucuacaaauauuaagcuaggcaggucuaugugcccuuacacuauauagcccuagucuguuguucucuaguuacuccuaaauuuuguaguucuucucuccauuagacuacugggucccuuuugccaguuuauaauuugugaugugcugggaaacuugaucaccuaaccugcagauuucaugucaauaaauaaagcaaguuacugauuuagguuauaaagaucugaccaguaccucuccuaggagcaugaguaacaucuauuucagccaagcauuauaaccuauucucaauuauacuuuggacaguaaagacacugacaguugagcuucagucaccaugucaacgagauacugauuuuuacuuagucuacuauaaaagaaugaagauuaaauuauuaguaaauguuaacuggaugaugaagacucucaaaguaaaaagauuaaacucccuuccuaagcaaucaagucauuacaggaaaauuuguguuguaaaacacuaagaaauaaagcuuauacuuuaaguuucucuugauaugaaaaccagaucaguacacaaauauuaaaaugagcaaaauacauuuguuaagcaaaacaaaagugaugauuaaguucugcagauucauagugaaaagaaaacauggggaaaauaaacacaaaaggacauucagcuucaugguauuuaaaaaauaucucuaagaaauauguagacauugaaugaagagugauuaguacauagaauuuccuccaguucacauuuucuaggauugcuuccuuugguacuuuaaaaugaaggacaaaagggaagagcucugacaugaguaugucuaacaguuucauucaugucuaaaucuacauucaauagcuucauuugugacucaauaaccagacacuuucucacaaccaaaagacugcuuuauaaaaauucaguguucgcuggagaguucuuuccucccacaacgcuaaaggaggaaaccuuauuuaucaaguaaacuacaaauauguaaacacgaucuucuuaaacaucucaaucuaaaaacaaaaaucuaaagagcaaauaauuugaaauguucuccucuuauaaaaacugaaaauacaucaggaaaaaaauguuaguacugaacaaagauagccuauucucaguaaacaacugaaaggaaaacuacuugaaauuaaaaaaggaaauaaaacuauuggugguucauuaccuucggguaccuaucaagcuucuuuaguagcucucucuguaugcuuugcuguuuaaaacuaauaaauauaaacauauaauggaaauguuuacaugaaaccacaugaugccaaagauacaaccaaaaagcuguaaauauguaaaggcagaaccaaaugaggaaaagucaguaucaaauaagcguaagauaaugcauuuuuacuauaggcuuuuaugugcaaagacacaggcacuuccuucagugaaucaagcuccuuuucuguggauuuuuacuaacuacauguuaugaguaaaaucugcgcccauuuuaaacaaugcagccuauucuucaaaggcacagggaacugaguugauaaauaggggauaauuugaccaggugcaguggcucaugccuauaacgccagcauuuugggaggccaaggcagguggaucacuugaggucaggaguucaagaccagucuggccaacaugguaaaaccccaucuccacuaaaaauacaaaaauuagccgggcaugguggcgcauaccuguaaucccagcuauucgggaggcugagacagaauugcuugaaccugggagguggaaguugcagugggccaagaucgcaccacugcacucuacacuccugccugggcaacagagugaaaccccgucucaaaacaaaacaaaaaaaccccccaaaaaaaacaaaaaauaaaaccaaaaaccaaaaaaaguagggggauaauuccauaauuccauucaauagaggcacauuuucuucaaaaucacuguggcuaaucuuaguguuuaguacuugcagcauuuuuuuuuuuuuccuaaccaggggucauaauuucccuugcccuucuaaaacauucacaaggucacuuuacuaaaaaccuagcuaaccuguauguacaaaaucuaaacaauguaauacaacuuucuuuguaaauuauuaaaugaugcuacgaaauguaagcaaaauaugugaauggguaaguaaaaaugaggcacuauaaaacuaguuuuauucuuauaauaugccuaaugauccaccaucuacugucuuccccccaccccuuaucuaacuagucacaauacuugguacuucuuugccugaauaaaaauaacucugaauuucugaaaccuuuuuuaauagcuggaggugguuccuggaauaaagcugggcaguauggaaaaggguuaaaugauuauccagaugauacauguggauaauuuaagguauuacaaagcauguuuuuuguuuuuugauuauucaugccaauacuuccucuucacuguauacuaaacugaaugauuaagauucauuugcucaggagcaugaacauuuaugaacuuaaauuuugugauaaaaaagcuauuuaacuucaacaaaaguguaacaaaauaugaagaguucuacuuacaaauuuagaaaauuaguaggguguuuauccagccugccaaaaacuaaauuuaauauauuucaauguauuacuaaugguaaucuaccauauaacuugauaagugcuuaagcuauguuauuguuauauuguuaagaaugcaguaucuucuaguuccagagccuauaaugcucuguaaauauccauuugcuagaaguugagaauacagacugaggaaauaaguucuagaaacacuagaucugaaaucugaucuacacuuaccugaaguuccuuagggaaggggaagagaggugagguagaauauauucauuauacagcacuaaugaacugaauuuaaauauauuucgugcauuaaguuguguaacuccaaauaaauuuuuaaaaacuaacgaucuaucucaaguuuacuauuagguaaacaauuucaguacuagaccaacaucauuuccucauauguauguuagagagcuaaacauaauauccuauuuucauuuagcuuuuuucuaaacuuuauaaguuuuaagcaaaagccacaaagaaauaucuuaguaauguuauguuugccaaguaugucugaauaaugccaacguaagaggugcuugagcaagaucuacauucuccagaauuaaaacaaaacaaaaaucaucaaaauaaaacaauaaaaaagaaaagcacaugaauuugggauugagguuggaauaggagacaguuucagaccugguuuaauccugagaaagauggguccugagaaguacuaacagucaugcuucuuuuccucuuccccacuggagauucuaaacacuaaacagacaauagaggguggcagugcaucaaacaguauugcuuacauugcaacaauggccggcgcagacaggcaacaccgaggcauuagagaaagaacaggguagccaaaugccauccuucuuccaccaagcacuguagcuucucaguuuuccaaauaagaaucacaugcucaagaacauuugaauucuggaaauuacucagguuuuuaaugccacuauuuugugucacugccugaaacagggauagcaauggugacauuuggcucuuuuauauuuuuaaucaaaaauggggaauuuagaucugcaaucuuugguaccacaaucugcccuucccccccaaaaaaauauuguacgggggaaaaaaaucuucaguaaggaagagguagaaggcauuuagucaccuuaaaauuuauuuucguaagcaugcagggcugauuacuggaagagaugagcaaauucacuaagauuggaguggccacuccuaaauaucaaauucagaacaauuuuccaaauaagaaauuuaacuuuaaaaauuguccucaaaagccccccaaaaccuuuuuuuccccaugaauagaaaacuacuggaacaagcugaccaaagaauccagucucauacaacuggcauuuuucaaacuacaauacagaaaacacuaaaaaucaacuacauaaacaaaacacuaaucuaaaauguucaagagcaacauuuagcauuugaaucuuaguugaguaaaacacuuugcuucuuccccauggccucucuaaaacaguguuaagcagcaagcagcuccacaaaauuauuuuuaauaucucaaggagaaaaggagaccuaaaccuccuaaaaagguuuucaccacuagauaacuuacacuuccuuaagacaacuaugcgauuaacaagcuauucuuaaggggguugugggggagggggggaaggcaaagugauaucuaggucaucauuuaaauuuaaggcaaaaaccacguacugcaaugucaacgaugcagaauaggaaucacauggugauaauggguuuuuaggggguaagaaaacaggaaggagagggcugggaaauggccaagaagauuggagucaaauggacaaaacugccccaaaacuuaagaacaguaauuuuuuuuucaauugaauuaccaggcuuuacaguaauaaaaaccuggauacuucagagaaaagcuauaaaauauuuuuuaaugcaacuugggaaugacaagauaaguuauguguauauuuaaacaccuuucauuauuuaaagcucaacaaaaaaauuuaauuuccuaaaaccuaaucagaccaacaucaguaucucacauugacaaauaacaccaauucuaaugguaaugucucccaguuggcauucauacaggcaaacaaagguaaacauuuauagcuagaccuaaaaacaccaaacauuuccuaauaguuuaguaaaacaaaugggcaucuuccuuccaaaaacaaaacaaaaaagccacaaaaaaacaaaaaaagcccccaaguuguccugaaguugagaauuucuaucagauagaucaucagaucacaacaugcuuagugcauugccaaugcugccugucugcccgagcucaacauaguaucgauaaagaaagcaauucacucaguaagacuaaucauuacagaaaaaaagucaacacaauuaguuucuaacugcaaucaugcgccacuagcuaaaacccaaucaccccauaaguugaaccacucucagagaccccaaaugaacacuaguuuuguuguaugaauguucauuucacuugucuacauuuuccuuuaaagggagagggagggguggagaacucacccaauuuggcacccaaguaaaaaacugucaacuacuuuugaagcaggcccaaaaguuacccuuuuaaauacacaaauucaaggacugaagaauucucauuaucaaccaugcucagucagcaaauguuaacaccauggugacagauaagucaguguucccacacuggcacaagcacauauauuauaaaaacccacacuucagagccaaagguuaaaaucugguuuuaagcauucaggaagaaaagaauauggggguuuuugcuauuuuugugaaugaaaaauagauacaacuguucaacaguuaaauaacuuagacaacuacaguucauuauacagcccuuagaauuuuauauuuccauauagguaacuaaccucgguuggguaaguugaagauaauuuauuucaaguuacuaaguuaauggaguuagcugauuauccucauagcacaaucuuuuaaagcaacugucaacagcaaauucaacuuacuauggcuuuuuaaaagauugaaaaguuuaccaaagcaauucuugucgaaacuuuacucuuuguucuuucaugcaaagagcauuugacuaaccuuauuacagugacgcccaauacccauuaggaaguuaucugguuuaaugucucuguguauaaaauucuuuguaugcacauauucaauucuacugaucaucuggaaaaaaaagaagggagagauaauugaguuaaguaguaaaugaaaaucaacacauuucuuaaguauuucaguaucucaauuauuuagaguucacaaagacagcgcuaaagaaaaugaaauggaaaggacaacuaaguucuccauuuauuucuagguuaauggauaucuaagcauauaccugcuguguccuuuggcuuuaccuucuaguauuaauaauuaaaaccauggcagggucuaaccccauaggaagacuugguguuugugauuuucaaauaauaaaaggaauaccuguauaauaguuucaguugcuacaauaaaggaaauaaaauaaaaacuuuccacacucaauccuaggccuucuaaaguaaccuguuaaaauggccuuguauuacccagaccuaauuccauguuauaagauauacauaugcacacaaacagauacacauauacuugggaguggaggauguugacagauuggcagauuaagcuauaaguaguuguuauaauucuuauauaaucucauuccaaaaguuaaauauuaaacaugccauucuuaaaagcuuuccuuaauuucuuggaaauuaugcaaagucaaacgcuauagcucaaauauccuuuuuaauggcuacaaauauucugugguagagauguuaugucuuccccaacucacaguauucucacauuguuuuccacuuuuuccuacuauaaauaaugccauuaauagacauguaucuuuacccacuagugcuuuuauuucuaugggcuucaaaucccauauaauuauggggaguugcugaguugaaggguguauuuuucauuuugauagauaauaucacacugccuuccacaauaggcuguaacaauuuggauuuacucuucuuuuuuuuuuuuuuuuuuugagacagggucucacugucaccuaggcugaagugcagugaagcaaccauaacucacugcugccucaaccuuccaggcuccagugauccucacacuucacccucuggaguagcugaaacuauaaggugcaugccacuacaccuggcuaauuuuuuugugucagcuaauuuuuaauuuuugguagagacgggauaucguuauguugcccagcugcucuugaacuccuggguucaggagauccuccugccucgaccucccaaugugguaggauuacaggugugaaccaccaugcccggccucgauuuagaaguaauccuuccaugaggauuuuuuuuuuuuuuugagacagagucucacucacucugcugcccaggcuggagugcaguggugcaauuuuggcucacugcaaccucugccuccuggguucaagcgauucucuugccucagccucccgaguaguugggauuacaggcacccgccacaugccuggguacuuuuuuuuauuuuuaguagagacaggguuucaccauguugguuuccagcuccuggccuaaaaugauccaccugccucggccucccaaagagcugggauuacaggcgugagccacugcgccuggcccuucuaugaggauuuacucuucuauguacugucaagcuccacucuuugccuauuuuucuuucggccuauugucuucuuguuagcuuuuaggaguucucgucauaaaacaaacaaucuuuuaucugucauuauguaaacaaauuuaaauuauuuuuuauuuugacugcuuauggcauuucuuguauacaauagaaguucuguguuuuuuuguuuuuuuugagacagagucucacuuugucacccuggcuggggugcagugacgagaucacggcucacagcagcuucaacuuccggggcucaagugauccucucagcucagcccccugagaagcuggaacuacggacaugcgcguuaccaugcccagcuaauuuuuguauuuuuuguggaaagggggguaucguuauguugcccaggcugcucucgaacuccugagcucaagugauccuccugcuucugccucccaaagugcugggauugcuggcaugagccaucacacccagccucuaucuuuucuauaagacacuuacuuagaaguuguauuuuuaaauagauuacauauccaaagacugccaacauuaucuuucuguccauauguucuugcucuacccaguaguaucuguuaggauucuauuuuuuauuuguccccauuuuccccagagcuuuuauuaucaugaauacacagauucuaaauuguacucuucuaccuugacaaaugucuucugaagccaaacuaguaaucucuggcuugaacaacuuacaccuguuaccugucaaccacagagcaagacuuaggugucaacuaccuuaaaugaaagcuuucuuguaucucccuuccucagaauuauauuuuuucacauuuguuacccguguacccaacagagacuucuacaacucuacaacaaggauggaacaucuuauuuuuccaucuuucuuuauuagacucuaaguuucuuucuagagggaagagacuaauucuuauuuuuuugccaccccaacccccagcacuaaguacagugguaggcucucaauacauguucaauguauggaugcuuacguguuacugaacaaacaaaaacauaagccauaacucuuuuauuaggauucacucauauauguuaguuaaaacauauuaaaggcuuuuuuuuuuuuugagacagagucucguucuaucccccaggcuggagugcaguggugcgaucucggcucacugcaaucuccaccuccuggguucaugugauucucaugccucagccucccggguagcugggauuacaggugucagccaccacgccuggcuaauuuuuguacuuuuaguagagauggguuucacuauguuggccaggcuggucucgaacuccugaccucaggugauuuaccggccuuggccucucaaaagugcugggacuguaggcaugagccaccaaacccagcccacauuaaaggcuguuaacauaaaagagauggggucuuugcucuauugcucaggcuggagugcaguggcauuauuauagcucacuguagccuggaacuccugggcucaagagauccucgugucuuggucucccaaagugcuggauuacaggcgugagccagugugccgcgccacuuuuaaccuuuuaaugcuugaguuuguuuugugccacaaauaucacaauuugcucacauuugcuugagccacugaguacuuuuaagguuaagaagcuuggggaguaucaggugcugauuacagaaaaugggcacuacuuucuaauccuuggaauuauagacaaaguuuuuucauugaucuauaauaguuguauauauuuaugggguaugugugauauuuuguuacauguauacaauguguaauuaucaaaucaggguaguugggauauccauuacuucaaacauuuauauuuuguguuaggaacauuacaauucuacucuucuagcuauuuugaaauaaacgauaagcuauuguuaacuauaauuucccuacuauacuauguaauacuagaacuuauuccuccuaacuguauuuuugugcccauuaaccuacuucucuucaucccucugaauuuacaaacuuacuaaaauuccaccucaaauaccaugucuguuuaucucauuuuacuuuaugacauuuacuugaaagaagcucacagugaugcuuuggguaauacauaaauaauaguauuaaaagguaagugauaaaguaaauaaagguaagugauaaaacaaauaaccuguguucuccuuucccuuuuccucauuuuauuuucuucuguuauuuucccucuuccuuuuuaugugauaggcaaaucuggacuagagagcugucacaaacccuccauuauauuuuuaaaugucauucucuucauaguauuuuuauaagcacacugaguuuaacuuaaagcauuuccagcauuuuccugcccuuaaagguaacaaauacugaucaaaacaaaaaauuauacaugucuugauauuuaccaaucauuaccuuaauguauuaucuuuucccuuaagguuuguuccuuacucaucuuucucauuucuuaagaucgaaauauccaaacuuuggcuguaaaaaccauuuaaucuaaccuacagccaaugcaucaaucuaauucaugacaucaccaaaauuuccuaggucuuaaguaacacaaaugguugagaauccauuacuccaagcagcaucuacuuggucaaaaaauucuuccuuauauuacuucaggaccuuuuuauccucaaaaauauagcuuuucuaagagucccacacauaauacauaauauucaauuuugcuuaauuuaaccaaaaugucaauaaacauuuaucaacaauuauaugcauacauacacucuaaacucuccaaacaaaaucuuacaauaaccugcuacauaugacacuaaaacuucaucugaaggagcagauugaaaacuacuagucuacagaugaguaagaaaccaagauaauuccagguuuugucuuauucccauaggaaaauaucuacaagucacauuauuauuuuuuuucugccuaugcuaagguuaaauagugaugcacaggauuuuaauacucugauuuaugaauaaugaaauuccagucaacaguacuagucucaguuuauauucuaaucaaaauuucacauaccuggucagcuaacauaaguacaguuuucauugugaaccuucuugaacagaaauugaagaggucuucgaggcuaggucccagaagauccaugacuaguacauuguagucuuuuuccugaccauaccaccuaacgaaacaaaaggagaagagaggauauuacaaaaagcuauuacuuaauaucaucaacccuaagaauaauauaguuuucuuucacugacuagguauuauauaaggcgaauguuccccuacucagaagacaaacccacuaauuaacuacaaggcccaaagacaaaacaaggguaaugagacuuuuuuuuuucccugucaugcaacuccauucuccuauauagauaggacaugcauaguagccuuaacacuccuguuaccagggcagcugaauuuuauacccacuggccacugauuccuauggccuuuaccaaauuccuuaaucucaccugaauuuacuuuguaacugaagaaaugaagaugacucuaucagucauuccaaaauguuucagaaagcaaagauuucuuuuaucugaacuucgauuccaguuccuaccaaauugcauuuaaucaauaauuacuuguccuuauucaaaaaggagucacauuuuuccuuggcuucagaucacagaaaauaacccauauaacacaagguaaugacauuuauuugcuuuuaacuggaaucauguuuuaauuauccugggcuguauuacuguauacaaugugucccuaauaagaaguaucaacugccaauuucauuuaucccaaggacugaaaaucacugcaauaaauuauuucaaauuuugaugccuaugauucugguaagaguacuuuccuuaaaauaagcacuaccacuuuucuuucaaacuuuucuagauauuaaauucugcuaagaaaaucaggugauacuuaaaauuuuguuuaaaaaguuauuuuaaagcuuaaacugcagucauuucuuuguuaacuccaauaagaaccaaucccaaaauuuaccauaucuggaaagcuuauguuuuaaaaauauucaaaaggggagaacaggcuuuucuuccuuucccuuccuuccuccuuauuuaucuauuuauuuauuuauucauuuauuuuuagacaaggucucgcucuguugccaggcuggggugcaguggcaaaucacaacuccugcagccuuugaccuucuggucucaagcaauccuccuauuucagcuucccaaguagcugggaccacaggcgugccaucaugcccagcuaaauuuuaaaaaaguuuuugguagagacauggucuuucaaauuucuuguaaaggcagagucucccuacguugcccaggcuagucucuaacuucuggacucaagcgauccuccugccucagccucccaaagcacugggauuacaaguugaaccacuguaccucaccagcuuuuuaagaaaacuaaaaucugugucaaaauuauaacaaguaucagucaaguaggaaacuguuuagugccauuuccugcuuugcugauaaaugccaaugauucaagaaaaucaauauuaaaacuagaguaugaggauuuaaucuuuuaagaauauuuuucuagaaaaugcaaagauaacuauacagaugugcuacucuuguggcucuucuuuaagaaaagagucuauucuaacuagugguccugggcacccauuaacccuugauggcaucuaccaaaacugcagaaauuucaggcauagcaccugagaaaggggggggagccucaaaucagucagcuuuaauuucagaucuauucagauaggucucauagucagguauaauaaauaugcucccuagaaucuuauguugagaguaagagauccuaagaggauuauaagccaaaaaguucaguuccuuccuacgacuuuugcuucaguuguucuugagaacuacuucccaaaccugacacauggauaacugccaagcacacaaaaucaaauccauuuccacauccucuuugcagaaaaagauaacccaguaagggaaaaguucugcuuaacuuucuagaggucuugcccacuaggcuaggaaacaaaugugucaacgugacagcaaaagagccauuuuuuuuuuuuugagacacagucucuugcucuguccgacaggcucgagugcaguggugcgaucuuggcucacugcaaccucugccucccagguucaagugcuucucaugccucagccucccaaguagcugggauuauaggcgccugccaccacgcccagcuaauuuuuguauuuuuaguagugacggcguuucacaauguuggccaggcuggucucgaauuccugaccucagcugauccaccucuuggccucccaaaguccugggauuacagguuugagccaccacacccggccagaagagccaguuuuguccuuauugcuuaaaacagcauacuaaagcugcuguuauuuucccucuuccacucuuuauucucccuaugggaauucaacaccuuucacauucgcugaaacauuuacuugaaagaagcucacagugaugcuuuggguaauacauaaauaacaguauuaaaagguaagugauaaagcaaauaagcuggguucuccuuucccuuuuccucauuuuauuuucuuuuguuauuuucccucuuccuuuuuaugugauaggcaaaucuggacuagagaucugucacgaaccuaccauuacaaacguucaacacuuguuuaauauaaauauaauuuaccuaggcuuuuaagaaaacgagaacaccaaauccagaaagagcuaaggaaguaagaaggcgcaaaaagucaaauaggcaaaagggaaggcauaaaucaacucuuauuuauaagaccaagucucagcucuagacagguuuccacugauggcucagauguaaaacuacaaaaaacaagcaaauguuauaaccauccaucuaagcccaaacacaaaccugaaauguaaaaggcacaaauucagacuuuauauuuucaugcaauuaacaugauuucauaaagaaaucaucugcaaaguaagccucuaacaaaaucaccugcauguaagccucuaacucccuuaauaguuagaaacugggaagaauuagaugaauugagaagcacacuuaaaacacacacacauuauugggcauucuucauccuugcuuaaauuuaugaacacaagacauauucacuauucucaaagucaggaggauuaaauacuuccuugaaaauagcuaaaaaaaaauaagcgucucaaaggcauuuuaccuuguggagcaaccaugcaguucuaaaacagcuaggacuuucuuuucuauggacugguacuauaacuccuuaaaccuaagagacaggaguuuacaucuuucacacuuccuuuggucucaaggaauauauagcuuaauucucuaaagcuagaacgucacacccuccaucugugcucuuccaucuggacuaacucauucagacauuaucacacacagauucagaaccagaaauggucuucugcuuauuccaaucuuacuuauucuuaguuucuaccuucaccuccaugcuucccacgucuauucugagagcuuuucucuaccuucaaucccaaccuuaaaacccagaugccaaagaaaucuuccuaaugucaccuaucccacauuggucuccuauuuccuagaauucccaaagccauuaacuauugcuuguguccacagucuuaaccccuugacaauacucaucuacuguaacuuugguguuugucucuauaccugguaggauagagcuuacagcuuuauuuuuauuugaauagccuuuucacagaaccugagucaugaacaagcacuaacccgauucucugaggccauuuaaguuuauagucugaaacaccaacacaaaaaccucacucauuuacuuucuaggccuucaaacuagaaacacaggucuuaccuuuagacauuuuuaaguacaagacguguugcuacuaaguguacagugguaaagugaugugcauauugcagguacucagguaauuaugagacuaaaaaaaguauuccaguugauuuggaccuuauucuuccuaaguuacgaaacauuaaaaaaaaucaaguaauuuaaugggugaaagugaaaauaauaauuuuaaaaagauaaaauguucggggaucucauuuuccauuuguuucaaaucuauaccuuuagacuucaguguuaccuaaaacuaggcugaagaaugaguucauaauuuacacaaccauuauuacuuacuuacagcauaaaaaaaguaucuaaggucugaagauaaugccaagagaaggcaaggucuaucucucugcucuuauguccuuuccucuaaacgcauauccaaauuaaauccaauuuaaaaauuaagacauacacaaaaagcacaaauguaagacaauacaugcaaaagucaaugaggcugacaaaaaaugcuaacaugauucacacaaaagaucaaugagaacuaaaucugucuaaagagguauuaggaaaauagucugcuaccagucagauccugaaggaugaacaguguuuugauaaguaaggcagaaaagggcuuaccaggcaggggcaaaccauuuuggggcaugggcugucauaaagggaagagucaagguggcagauagauugaagcugcaguauagguucuucagugcaaggcuuaugagcuuuacaugcuguaaauaauugggugaacuauuacuacaguuuguggcugagacauaauuaaaaucaguaauuauuagccuuggcaucaguauacaauauggaaauggaggaccaggggaaggaaugacaaugacaugguuaccaauuaggaaguguuauacuauagccggagauuucaagcuagggguuugcuuuuuucugaaaaaugucuucaugaaaaugggaguauuugagaaaaaaaauacauauuuuucauauaaaaauauuuaaguauuacuaugagacccagaauauuccagaauaaaucaguguaauuauuguaauaugcacuuuacccaaauauauguuaguuccaucaccaugaccaggacaaaauaacaguaaaaaaaaaaauuuaauguagaucuuccccuucagacuauuaacuuaauuaggggcaaucauuauauuugucuuguucacaaucuguauucccagcauacacaagagaugcucaaaacauuugcugaguaaaauaaugaaaacucauauuagaagcuguaacaguguagggagugcuugauuuggcagauaaggaaaacaaaacaagaaaugcaaaaacacucccugcacuccaagugaagacaucaggaagcaucuauuuaucccuaguucaaauaagccaaauaauuauaaaaguuaaaaagucguuugccaaucuuucgguuauuaaugucagagucuucagugaacaacuaaaaaguaucaacacugaaucagugcuauaauauauccaauuuuaauagcaccuacaagauauccugaagauacugucucucaaacuuagucucuugccagcccaucauuauccaaccuuuaugcuccuuuuuaaugggagcagaaaaggaauuuggccuagcaagaucuugcugaaccguaagaacuaacucaaauugucucuuuaggauacuacugcuaacaguuccagcuacucaggccaggcgcgguggcucacgccuguaaucccagcacucugggaagccgaggcgggcggaucaugaggccaggaguucgagaccagucugaccaauauggugaaaccccgucucuacuaaaaauacaaaaauuagcugggcaugguggugggcgccuauagucccaccuacucaggaggcugagacaggagaauugcuugaacccaggcagcagagguugccaugagcugagaucucgccauugcacuccagccuggaugacaaagcgagacucugucucaaaaaaaaaaaaagaacacauaaacaaaaaaaaaaaguuucagcuacucuguucccuuuucucuaaaauccuuucaauuuuccuauacauucauauuuguauaugccauucuuaacagcuauuugccauucauuauacacagauguauucucaaaaccagauaccucuucuccccauacaucucuucucagaauguuuuaaaugcauaaaauacaaggcauuauaaagaaaaucaauuauagcgaaauugaacuagcauaaaauuacuucuaaacaaucaauuuuggggccaggcacaguggcucaugccuguaaucccagcacuuugggaggccaaggagggcggaucaccugaggucggcaauucgagaccagccuaaccaacauggagaaaucccaucucuaauaaaaauacaaaauuaacaugccuguaauccagcuacuuggaaggcugaggcaggaaaauugcuugaacccgggaggccgagguugcagugagccgagaucacgcuauugcacuccugccugggcaacaagaacaaaacucugucucaaaaaaaaaagaaagaaagaaaagaaaaagaaaaaaaaucaauuuugagccaggugcaguggcucaagccuguaaucccagcacuuugggaggcugagguggguggaucgcuggaggucaggaguucgagaccagccuagccaacauggcaaaacccugucucuacuaaaaauacaaaaaaaaaaaaaacaaaaaacaaaaaauuagccgcacauggugguggggaccuguaaucccagcuacucaggaggcagacgcugcagugggccgagcuuaugccacugcacucaagccugggugacagcaagacuccaucucaaaaaaaaaaaaaaggaauuugggauauaguaauauacauacucuccuuauuauuauuauuuuuugagacaggaucucacugugucgcccaggcuggagugcaauggugugaucuugguucacuacagucucugccucccagguucaagagauucucaugccucauccaccuguugggauuacaggcauaugcgaccacuccuggcugauuuuuguauuuuuaguagagacaggguuucaccauguuggccaggcugauuuugaacuccuggccucacgugauccgccugccuuggccuccuaaaauguugggauuacuggugugagccacagugcccagcccuacacucugcuuauuaaugcauuaaauauaggagcaggucuaauaaaugcuauaauuuugauguaguaaugaguguaaacuauauuuuaagauaccugcaacaauaaugugauauaaaauaccugugauuucagccgggcggaguggcucaugcugagaucauacuguugcacuccagccugggccacagagugagacuuagucuaaaaaaaaaaaaaaucugcgauuucuagcugggugcaguggcucacaccugcaauucuagcacuuugggaggucgaggcagauggaucaccugaggucaggaguuugagaccacucuggccaacauggugaaaccccaucucuacuaaauaugcaaauaucagccgggcguggcguugggcgccuguaaucccagcuacucaggaggcuaaggagaaucacuugaaccugggaggcaggagaugcagugagccaagaucacgccauugcacuccagccuggcgguaagagcaaaacuccaucuaccccccacaaaaaucagugauuucuauuggugacaaagucaaagguucugcuaaaacucaugagguuuccuacuuacacuuaaaaucaaaaagaaauacuagauuugagugagaagcucaugaaaauaaaaauguaauuuuccuuaccugucuaaauacauagaucucaugggggguggauaugguuaugaaccagguuaagagccccuguuccaaaccaacuuuugagauaaauagccuguagaauaagaucuaauauuugaaaaucauguauguuuugcucagcaauaacguagucaacuaagaugauuuguuuucccucuucuugcugccuuguuacuacuaauccuuugcuuacaacauuacccccaagauccuugaauuaccguacauuuucauauucuccaccuuuguuccuugcccuuugccuucaaagauauguagauguuccuuaacuccaaaaauuauaaaaacaaacaaaaaaaacuuuaccacuguucauuaucaaaguuacuauucauuuauccauucaauauuuagaguagcuaacaagacaaaacaaaauaauugcugcuuucguggcuuauaguggggaagggugauaaacaccaugaugaaggagagaagagugcuauugugggggcacaaauuauggggaucugaucuuuuuuuuuaagggaggcaucagggaaaguuucucugaggaaguaagguugauucucaaaggacagauggcagagacccagguuaagggguggauuggcaccaggcugaagucuggugcucacaagaaacuaagugacagcauagguugguauaguguguaagaucaccuuauuuucuucuucagguaauuuuuugaaaaccugguuuauauuugcaucuuacucucauuuuuucuugguucccaguaacauaguuauuuuccccguaauacccaaaguguuauuucaaagaucacaaauaauugagcggggacguaguugcaaaaaaaaaaaaaaucacaaaugaccuaacuuuugucagcucuugucaucacugcuccaacauugauaguggugguauugagggacagcauguggagaacuggaagguccagggagauacaaauguuaaaauacacuuuuucauugggaaguggaaaauguacuuauagucuucauaacacaaauuacaaaagcuugaucaaauguuuucuaauaggcaaauauauaaaagcagauuaguaguugccuagggcugacgggaaauggagugacugacaauggguucaagauuuauuuuuggcaugaggaaaauauucuaaauuugaauuaugguaaugguuguacaacuuuguacauauacuaagaaacaaacuguacagcuuaaauagguuaaccuuuauguggguaaauuauaucaauaaagcugaugaagaacugguagaugacaaguguaauauaaaggcaaccauaaauacaaaauacaggaauaagcaauuuacuuagaagauaaaaaagaaggcuucuggccaggcgcgguggcucacaccuguaaucccagcaccuugggaggccaaggcaggcgaaucacaaggucaagagagaucgagaccauccuggccaacauggugaaaccccgucucuacuaaaaacacaaaaauuagcugggcgugguggcgcacgccuguagucccagcuacucucgggaggcugaggcagaagaauugcuugaacccgggaggcggggguugcagugagcugagauggcgccauugcacuccagccuggcgacagagcgagacucugucucaaaaaaaaaaaaaaaaaaaaaaaaaagaaggcuuccuaaaaauguuagcaccugggcuaaauuuugaaagaugccuggauuauuguauuagcuucuuaaauauucuccuaguuccaguuaccccucuaugguuuuacugugucauuucucuguuauaaaaacuaaaggagccaugcgauagcucacaccuguaaucccaacacuuugggaggucaagaugggaggaucacuugagcucaggugguucgagauuagccuaggccaacaaagaccccggucucucuaugaaaaauaaaaaauuagccaggcgugguggcaugcgccuguacuccccaggaagcugaggcaggaggaucacuugagccucggcuguugaggcuagccacuguacuccauccugggugacacugagaccuugucucccaaaaaaaaaaaaaaaaaagccccuuaccuacuaaaaaagcaagaguuucauauaucaaaaaauuccuaaauauggccucugcuuauccuuucaauucuauauacuuaacucccucuucggauuauccucagacccaaucauugagucaaguuacuuuacugagcaccuguuggguacugagcucuaacacagccaaaccccaaacgcuuuaagucucauuucuuuccuacuucuuggauacacauuaccucuuccuaaaaacuuacuuucuuuauucaacagcccauuauccugacucuccuccugcuuuauuaauuccgaauuuccaccaaggggaugaguccucaccucucaauuuacuuucuccacuaucacuuacaugcugaucuugcuuagaucuaaccccaaucccaguucccuggccuaggcucaguucuguauuugcugcuaacuuuacuacacaagaguaaaacacaauaugccauucaccuuaauuucaacauguccaaagccauuaccacccaccauacuuguaaaauacuaaaauugggcccccuuccuaacucccuaauucaaaccucaaauucuuaaggcucaagugacuuaccuccacuccuuaaaaagggauaacauguacauuaaaaaguuucagaaagaaaaaaagaaaucaaacacacuccuauaaaauaucuccuaauacacuauuaagagaccaaauggcuuucuuuuuguuuguuucuuuguuuuuguuuugaaauggagucucacuguugcccagacuggaaugcacuggcacaaucucggcucacugcaaccucucugccucccagauucaagcgauucuccugccucagccuccugaguagcugggauuacaggcacaugcugccacacucagcuaauuuuucuguguguuuugaguagagacaggguuuugccauguuggggggacuggucucaaacuccugaccucaagugauccacccgccucagccucccaacgugcugagauuacaggggugagcuaccacacccagccaccaaauggcuuucuuucuuuuuuugagacagaguuuugcucucguugcccaggcuggaauacaauggcaugaucucagcucaccacaaucucugccuucuggguucaagugauucuccugccucagccuccugaguagcugguaucacaggcacgcgccaccacgccugacuaauuuuguauuuuuaguagauaugggguuucuccauguuggucaggcuggucuggaacaaccaaccucaggugauucgcccaccucggccucccaaagugcuaggauuacaggagugagccaccgugcccagccucaaaugguuuucuuuaggguaauuuuugcacuauaaguuagcacuuguauuacagacaauguuucuguaugaagauacuaagagaacaaauaacuggaugaagggaacacuucccccuacuuugcauuaauuaauuugcuuagaaaauccucuuuaaauggauagagcuaaguauucuagauaagaaacuguagacaaaaacgauacaaaaaggcaaaauuaaauuaucuucauuaguggagaaaaugaauacaaaaagaaaacaaugaacauuccaaaguuugauauguuuguuuuacguagcaaauacagaagaaaggacacaaugccugggcugcaaacauacagcaaaggggaaaaggaaaauggaagaagcaacacaagcuaccagaaaggaaugauacaaccucaaagaaagaaaagauggcuauucaaauacaugaauagcuaucaagucugugcaacccugaauaauacagcacuaaguaauauucauaaaaguaaguccuucagugaccagaccauuaaaaaguaguccaguaaaucugcaguuagguuuaagaaugggaagcuggcuaaguugacaguauauguaacauaguaccaagaauacuggaccagcagccagaaacauagguucuaguccuggcuuguuauuuucuugcucugugacucuguguaagugauuucugcucacuggucaaagauucuuaauauaacccuauuuauuuaucaaaagguguugugguaauuaugagaguuuauguaaaagcacuugauaaauuacaaagcauuacauaaauaagggauuauuauucuuauuacaaaaagcagucgccuggccaggugcaguggcucacaccuguaaucccaguacuuugggaggcugaggcagguggaucacuugaggucaggaguuugagaccagccuggccaacauggugaaaccccaucucuacuaaaaauacaaaaauuagccgggugcaguagugggcgccuguaaucccagcuacucagggagcugaggcaggagaaucgcuugaacccaggaggcagagguugcagugagccgagaucgugccacuguacuccagccugagcgacagagugagacuccaucucuagugaaaaacaaacaaaaaacaguugaccaacaaugauaaaaugccaacaaccaagacaauaccauuuccuacaacagccauagcacucagcaaaauucacuaacuacccucaacagcuugauacaauggagugccaaaaccucagcacagaauuucucagugugguucucuggucuuuaguagaaauuccuugugguaauuacauuaaaaacaaacaaaacaaaacaaagaaaaaaaauaacucuugguccccacuccagaauuggucaaacaaaaaucugaugguagagcaguguaaccugaauuuuuuacaaacucuauaagugguaauuauuuauacacagcugagguuggaaaaaugcugacuuagaaggauacacaugaauagucuuaacgggguccuacuguugcaauuaacuaaggcaaucucuaaauguuucaggguacuguuuggggcucaucucaauaugcuacccucuuaaguaaacauuuauguccucacauaguuugagauuuagacauccuuccuaauuuucagcaggagacaaauucacaauuacaugccaggcucacagcagaugcucaaaaagaaugcaagccucacaaaaucauugucuguucaaugaagugugcccaguuuuuuuuuuuuuuuuuuuuuuuuugagacggaguuucgcucuuguugcccgggcuggagugcaauggcgcgauccuggcucacugcaaccuccgccucccagguucaagcgauucuccugccucagccucccuaguagcugggauuacaggcaugugccaccacgcccagcuaauuuuguauuuuuaguagagacgggguuucuccauguuggucaggcuggucucgaacucccgaccucaggugauccgcccgccucggccacccaaugugcugggauuacaggcaugagccaccgcgcccggcuguccaguuucuuaaacugugacuggcacaggguagguacccucaggugaaugucaacugaaugaaagaaaugguuguucucuucaacguacuguacaagguguuguauguuaaauucaccaagagagucucaaacuaucagagcucucguuugaagaauagaagcuaacaacacucacuucucuaagagggauaaaaaauaauauuauggagguucaaaaaugggaacacuaggauuucuguaaguacagcuuggugguaauaauuucaaucaagggcaaacagccaaacacaaaaccaaacucaaccuaacagugaauggcugggcacagcggcucacaucuguaaucccagcacuuugggaggccaaggcagcuggaucacuugagaccaggaguucgagaccagccuggccaacaaggagaaaccccgucucuacuaaaaauacaaaauuagccgagugugauggcgcaugccuguaaucccagcuacucaggaggcugaggcaggaggaucacuugaacccaggaggcggauguugcggugagccgagauugugccauugcacuccagcuugggcaacaagagcgaaacuccgucucaaaaaaaaaaaaagaaaaagaaaaaauuaaauguauauagauauauaauaaaaguagaauuucauuauuguacuuggcacaauaagaaacacaagauaccucuaugaguaagacaguucucuccuucaaggaguuucuagaaugcauuauuguaggaaugcaucugaaacaugugaagagguaaaugguuucauacaucgauuuuagacacuuuccagaaaucaaagcauuugauuacaugggauuauauguacuuucugguacuuuccaguaucaugaugccuauuacaggauuuccugaauuaauucuaagaggaaauauauaaauuaagaacacagccuuacagccugagcaacacagugagacucuauuucuaaaaaauaaaaauaaaaauuagccaaguauggugguguaugccuguagucucagcuacuuagaaggcugagauaggaggaucacuggagcccaggaguucaaggcugcaguaagcuaugauugagccacuauacuccaggccuaggcggccgagcaagaacccaacucuuaaaaaaaaaaaaaagaaagaaaagaguauagccuuauuagguuguaauucuaggaaaagauggggguugaugggggugaguagcaaagcaaaaauuauuguuauuaauuauuaauauacuauauuuuggggauuaauaacaauuauuaauuguuacauaucagaaucaccuggggagcuuuuaaaaaucaugauaccuacgucauaucccaauuuaauuaaaucaaaauacuugcaguuagggauuaguugucuuuuuuuuuuaacuuugccauuugauuccauuugcagcaaaauuugagaaccacugguagagcugaaagaugcaguaggaccuguacaaaucacacaucagcugugugacuuuaggcaaauuaaccacuuugacucacauacuuuauaagaaacaccaacuuacaagauugguguaaugauuaaaugagaccguaugcaaugccuggauaauauuggacucuuuuuguugcaugcagagggaaaaaagaauguuuagccacacugaauucaaccaauuauucccuuauuucaaaaguacuuaucaacauuacaaauaaauaaaaggcaauuauaccuuaaaauuagaacaaaucauuacaucagagaacaagaggcaucuuuuguccuacugauuccaucaauauauacuacacauuaaaaaacccuuaagaccuuguugggcuuucgaaaacccuuuuacaaguaagaacugacuuuacaaauuauagaauucauucuauuaauagguucaaaucuagauggcaucacaggcagaacccugacucauaauacaaugcucuuuccauuucccuuuauguugaggauugaaauguacucucuucagcuaaaccguuuuguguagcacuuccaaaauccccauuaaagggccauaacauaccccacugcucacaccgacaagaaaaaggcaguauuuuaguucuucaaaggagagcaagguaaagaucucaauuaucacugaauaccauauuuacuaccaucaccugcaacacaaccaccaucugauaauuuugucagauaaauccuauaauguaccucauggugauaaacagacuauuaaucuauaguaaaaccaacaccaaaauaaugcuuaacuggggacuggggagaaaaauaaggcuuagcuguaauccaaaagacagacuuaaaaaauaaauaaauaaaauaaaacuaacacugucacagaauagaacuuaccaaggaugagcaaugugugcauacaaaaaaaaaaucaaauaguccuuaucucaacagagauguagguuacaccaacauaugcauuugucaaaacugauccggcaggguaugguggcucacaccuguaaucccagcacuuugggaggucgagaugggcggaucacaaagucaggaguccaagaccagccuggccaauacggugaaaccccauuucuacaaaaauacaaaaaaaauuagccggguaugguggcgggcaccuguagucccagcuacuccagaggcugagcaaggagaaucacuugaacccaggaggcggagguugcagugagccaagauugcgccacugcacucuggccugggcaacagagcaagacugcaucucaaaaaauaaaauuaaaaauaaaaaucccacuaaaacaugcauuaguuuaugcuauguuaauacuggucaaccaauuuuguuuuuuuuuuuugagauggagucuccaucugucacccaggccagagugcaguggcgugaucucagcucacugcaaccuccgucuccugggaucaagcaauucuccugucucagccucccgaguagcugggauugcaggcaccugccaccauggccagcuaauuuuuguauuuuuaguagagacaggauuucaccauguuggccaggcuggugucaaacuccugauuucaagugauccgcccgccuuggccucccaaagugcugggauuacagguguggcaugagcuaccacacccggccagucaaccaaaauuuuaagagccaucugagauugaaauuagaaacaaaaacaguaacacaauaaagcaucauuuuaccugugugcauacacugaacaccaaguuaaaugaugaaaguuaugaagacacucauucuugacagcaaaaaucccuggugaacagugacagaucaugagaaaaccaagacuuaaugauauuuuagguacagcuuaaauauacuuuaaaacaaaaugaucuagccaggugcgguggcucacgccuguaaucccagcacuuugggaggccgaggcagguggaucacuugaggucaggaguucgagaccagccugaccaauauggugaaaccucaucucuacuaaaaaaaauuagccaggcauggugguauaugccuguaguccuagcuacucaggaggcugaggcaggagaaucacuugaaccugggaaguggagguugcagugagucaagaucacgccauugcaucccagccugggcaacagagaaagacugcaucucaaaaaaaaaaaaaaaaaaaaaaaaagaucuagguccagaaaugacuaaagccaaggauccuugaucccugggccacugaccgguauccaguauagaagcgaagugaagcuucaucuguauuuacagccacuccccaaagcuggcauuaccgccugagcucagccuccugucagaucaacagaauuagauucucauaggaacgcaaacccugcugugaacugcacaucagagggaucuagguugugcauuccuuaugagaaucuaaugccugacgaucuguuacugucucccaugacccccagauggaagcagguaguugcaggaaagcaagcccagggcucccauugauucuacaucaaggugaguuguauaauuauuucauuauauguuacaauguaauaauaauagaaauaaagugcacaauaaauguaaugcacuugaaucaucucaaaaucauucccacccccaccccacccccuacuugcuccagucuguggaaaaacugucuuccacgaaaccugucccuggugccaaaaaggcuggggaccacugacuaaagccaaggaauaacccacauacuuuacauggguucaagcauuuacuccgaaaugagauacaaauuuauauauauauauauauauauauauauauauauauauauauauauauguauauauauauauauauauauauauauauauguauauauauauauauauauauuuuuuuuuuuuuuuuuuuuugagacagaggcucgcucugucacccaggcuggagugcaguggcaugaucucagcucacugcaaccucugccucccgggcucaagcaauucuccugacucagccucccaaguagcugggacuacaggcacacaccaccaugcuuggcuaauuuuuguauuucaguagagaugggguuucaccauguuggccagccugguuucgaacuccugaccucaggugauccgcccgucuuggccucccaaagugcugggauuacaggugugaaccacugcgccuggccacaaauuaauaauuuccagcaaguuuuuauccugcaauccacagauucaaaagggagaauaagaacacccugaaucguaagcaucuaauuaaauacaaauagguuacuuauauuuauguaagagcucuucagcuugucuaugaggcaaaaugccaacaagugaagaaguacaggauggcucuccaguaucaaaugaaacgauguggagugugugagagggcaugauuugaccuugacauaagggugauaaugauucucagaagaacuggaaguuaggacacuccaguaacuccccugagauucaacagucuaauuuguauuaguaggaauagggcuauauacaucucuaacauuuuguccagcuuaaaaugcuaccuagcauuauuacauuaucucauaagccaguauaaagcagcucuaguauaccaugaauucaguuucccuucaaguuaaaaagcacauuucucgugaucugugacguacguuuuucugguuuuuuuuuuuuaguccaagcuaagcauggacacuguaauauaucuuaaugaagacauauccaaugcagcgucaucuuuauucucugauaacagccauuauguuauucacaggauauaugcucagugccaaagauaagauuaagcugcuuuuaaaagugaagaguaaggauuaacuagugcuuuauaaauacguucuaaaacauuugaccuucagacacagagggcaaaaauagugauuaaaacacacuaggcagcugggagaggugguauucaucugcaguccuagcuacucaggaggcuaagaggcaggaggaucauuugaguccaggaguuugaggcuguagugugcuauuaucauacuucugaauagccacugcacuccgcccgggugacagagcaagaaccugccgcuaaaaauaaaaauaauaaaagaugaaagaaaaauaggaaaaacaagaaaggaaggcaaguaguagacacaauaucaaacugcuggaaugcuuuuuuucuagcuacuauccuuugaaaauaggucuuaaaauuccaggacuaaaaguccuuaggaucaaugaggccagugacacuuuuaaguagggaacccuuguucaaacaaaacccuacccaaaagcucaguaugcaaaggcaaauggaaaugaguauuuagcuggcaaaagaaggguaggcagcccuaaaucuuucuauucagcacucuccuucccauuagaacaauccuuuuuuuauguucuaaaugaggaaacagaugggcuuacacacauuaaggaacugacugacuguagaugacccagucaauaucacauggcagaucuacagcucaaaccuccaaaaccuaucuagauaaagaauuuuucgguaugucauaguuguuucuugggucauugcacgguggcugaugccuauaaucccagcgcuuugggaggcugaggcaggagaaguacuugagcucaggaaugcaagaccagucugggcaauauagcaagagcccaucuauauaaaaaaaauuuaaaaaaauuuuuaaauuguuccuuuggagaacuuaauucaauuuagaauggaacacacaaaaaaagguuuuaacagaaacucaauacagcugacccuugaacaaaaggggcuugaaaugcacagguccacuuguacacagguuuuuuucugccucugcuacccaaacaagaucaaccccucuucuuccuccucagcccaaagugaggaugaugaggguaaagagcuuuauauauauauauauauauauauauauaguuauugaccaaucauguuauuggugaagcuuccagugaacaguaggcuaguaguaguuaagcuuuuggggagucaaguuauacuuggggccaggugcagugguccaugccuguaaucccagcacuuuggcgggccgagguggguggaucaucugaggucaggaguuugagacuagccuggccaucacugugaaaccccgucucuacuaaaaauacaaaaauuagcuggguguggcggcgcgccuguaaucccaugaaccugggaggcagagguugcagugagccaagaucacaccauugcacuccagccugggugacagagcaagacuccaucucaaaaaaaaaaaaaaaguuacacuuggauuccugacuguggggcacagugggagugggcugggguucagugccccuaaccccagcacuguucaagggucaacuguaauuuuaagugagcucucacauauuaauugacaagguccaagaauuuucuuucuuuuuuuuuccccugccucagguuuauuuguacuaauagcacaggaggaccccagccccauaaagacggcagcccagggggguugcaucaguccuucuguccucacguuggcagacagagauaccuacuccgaagccuuuguaggggccugagagccuuugggaggagccugagcuggaacugaagcuggagcugcagccugggccuugguugauccuuggccuuuggcccacacagucugagccccuuggcaaugcggacacaagcacacuucccaagcuugggguggacaauguaggcaagucaaucgaguucgcagcugacacccuuugggaucuugggcuuaaccuccuugggcuuuacgagggcccugcuagccucagcaagugcacucauugccuuggcauuguuggccugcaucuucuuuaggcccuucuugugcuucuuggcaaagugcauguuccucaggaaccuggagcccaccauuucugugccauuuucaggacugguuguguguggugugguucguggacuuggccaugucuguaccuuaagccgcggcucuccaagugccuagaaccggaagcuucauuucuuaaaauaucaagaaaauggaugccauucucuuauccuugcuuuuuuuuuuuugauacggagccucauucugucgcccaggcuggagugcaguggcacgaucuuggcucacugcaaccuccgccucccauguucaagcaauucuccugccucagccuccugaguagcuggcacuacaggcgcacgccaccacaccaggcuaauuuuuuuuuuuuuuguauuuuaguagagacaggguuucaccugucucuacuacccaggcuggucuccaacuccugggcucaggcaaucugcccaccucggccucccaaagugcugggauuacaggcgugagccauggcgcccggcuuauccuugcucuuuacucaggaugcuaugcuucuuaacaauaggucucucaaauuacacaggaaggaccugauucagcaggucaucuacgcaggccagguaauuuucagucucuguuguaagauauaccaaaguaucuuaaagaaaauccuggcugggugcgguggcucaugccuguaauccaagcacuuugagaggccgaggcgagcagaucacgaggucaagagauggagaccauccuggccaaaaugguaaagccccaucucuauuaaaaauacaaaaauuagcugggcguggcagcacgugccuguagucccagcuacucaggaggcuaaggcaggagaauugcuugaacccaggagguggaggcugcagugagccaagacuguaccacugcacuccagccugguaacagagugagacuccaugucaaaaaaaaaaaaagcaaauccuauagggaauuuuguaacagaaaacauagggaagggauugaacaaauuuguauaugaaggauaaaggcagcaaaaucuaaauuuuuuaaauuagugacaauacuucuaaaacaauagauaacacauaacuuuuaucuagcuaacacuaaauagucaacuuaauucaauacuuuccgaguaaauauuuauuaaguauguaccauguauaggugauacagaaauaguggggaacaaacugagggggaugggaagaugcugcuacccaaauaaagaauguuuacauaaaucuuuauccuuuuugcuucaguggaaacaguuuuuuuuuuacauuucacuuuaaaaccaaugaaccacuuuuguuuccauguaccugacccuaccacuccuaaagcaaauuuacccuuuccacacucucauccaauuacuguguucuccuuuagagacuacacccagaagccacacucuauucuuggaugccuuaccaaaccaguucaccaagcuuucuuccuuagagccagauccugaaaucccaucucucaggaagccuuaacuugaaagucagguuaaucuguuuagccucacccacagacagcuuauaacuaccauaacucucucugcacucaccaccuuauaauaggcaccuauuacuauaauucugcucagaaguuaauuuauucaugugcuuauucaguacauuacucauugcccuuaugggucuguaucaggucuuaaauaaaagcuaccagauaaaaggacauguacuguacuuggguuuagcacugaaaaaugacaaugcuuaaugcuuuuugaaacugauuucaaauacauuaaauuuaaccugauuugugaaauuuauaaaaucucccaacauagaugaaucucaaaaacauuauguuaagugaaaagugccagacacaaaugaccucauaucguaugauuccauuuauaugaaauucuaggaaaaacuauaguaauggaaagcaaaucaggggugaggggccuuauuuucccacauaguagguuuuuuuuuuaaaggcaagaaugauuuaaaaacuucaaaucuauaucaucucagauuuaaucuucaccucauaagauaaauuugcaacuuucuuccaaaugauuuacuugcucauuuacaaccaauagcacauuuuaucacucaauucuccauuaaaacuguaaaucagcauuggaacuuuguuuuuuuuuuuguuguguuuuuuuguguuuuuuugagauggcgucucgcucugucaccaggcuggagugcaguggcgccaucucagcuuacugcaaccuccgacucccggguucaagcuauucuccugcuucagccucccgaguagcugggauuacaggcacgugccaccaugcucagcuaauuuuuguauuuuuaguagagacgagguuucaccacguuggccaggcugguguugaacuccugacuuaaaguaaccugccugccuuggccucccaaagugcuuggauuacaggcgugagccaccacgccuggcuggaacucuuuuuaaggacaguuuuauuugaguuguuuccauguaaagacuaugcaacccaguccuuaauucaagacaugaaaaauacaaacuggaauagaaaaaggggcuaacaggcugggcccgguggcucacgccuauaaucccagcacuuugggaggcugaggcagguggaucaccugaggucaggagguggagaccagccuggccaacacggcaaaaccucagcucuacuaaaaauacaaaaauuagccaggcguaguagugcagcucugcaauuccagcuacuugggaggcugaggcaggaggaucacuugaaccugggaggcggaggcugcaguuagccaagguugcgccacugcacucuagccugggcaacagaguaaggcuccguuucaaaagaaaaaaaagccgggcacaguggcucaugccuguaaucccagcacuuugggaggccgaggcaggcagaucaccugaggucaggaguucgagcccagccuggccaacguggugaaacuaaaauacaaaaauuagcuaggcgugguggcgggcgccuguaaucccagcuacucaggaggcugaggcacgagaaucacuugaacccgggaggcagagguugcagugagccaagaucgugccauucauugcacuccagccuggaccacaagagcgaaaacuccgucuuaaagaagaggcuccaguaaacaguaaguaccauucuuaccuauucugaauaauuuugcaaauguuauuuuagauuauugcuggaaaauagcugggcuuuaaacuauauuuuagucuccauuccaugaagaggaucuuuaaucccaaaaguuaaaacauuaaaacccuccaaaguaaaguuaaccauuugacagaacaaugucuaucucgucaucuuuuauccucguuacugcuauuugcacucaccaauauuccacaccaacaaaggccccaauuucucugaugugaagauuuacugacaaacucaacagguuaaaauuacuuaucaaaguguggcuaagugauuaagauuuuuuuaaauacaacugauaugaguaaauuuuaacauaguuggugcugcucaaacugccuuugccacuaccuauacaaauuuagucccgacugaaacgugccaaauaugaccauucacgaaaagaaagaguaauuaacacuuuuaaaagaacuacgaaggauuuuacauaguguaauucaacaauuucgugucacaucugcugcagagaucacaaacacugucacuaugccaucuccuuccucgaaccuccacaccgccuccugcagcuuuauucuuggcuuuucaaagguuuaauccacucggggcugcuaaaggaggaaucaaggaagcauaauuugugaacucaagcugagaaaagggcaggaauaugggguugagucacgucguuccgccauuuucuaagcggaggaggaagacauguuggaacaaaaacacaacaaaagagcagccauuucccaagccagcuccaauagcaacucgaacugacacugccgggucgcuucggcaccuucaaauccacuucacuggacaaaccuaaguacaucagaagugccgccguaaaaaaggcagcagccaacccuuccgcguagggaucaaagaugaccugcacgcauaacugcaaaugaaagccucgggaagagugagaaugacggaagcgaaauggagcaguguaauacaaugaaauaaguuggcaaacugaaauuuacucaguaauugagaugacugacuuacaggaaaccaccagcuauagggaacccagguaacuaaaacaccaagacccggauucagcuggucucauuaccugccucuacccacuuccccauuccgugcuucccucagcggaucgccuauaugcaccggguucuuaccguaugugggggaugccaaccccaccuugaagaaucuuauagagcuugcucucguacagcaacuggggaugccuggccuucugagauucuagcuucacugccacuuccugcaggggaaagaggggaugauggcaucaacaucccuacggauucaaugucacuuaggaaaggagggagacauuagcaaaacuccaagucgcgacuacaagaagaagugaaaagcuggaaagagaaagcucucgguaauuauaaaacgaggcaaccagccucaaaggccucuucaggggguagugacgaaauccguacguccucuaaagugcaggaaaaugauucauccagaaaaaagaggcaaccucugaacguagugagagguuuuuaaggaacuaggcgaucggaaacuguucuaauuggaacaagaggcccaguagaauuaagaauuaaaaaaaaaaaaacaugggaaucacugaaagaggauuuugccguuuccaccuuaaaagacgguuaaaaaaaaaaaaagcucgacuaagggacauuuaugggacguguuuaacaaggugggaaacuaguucccccaaccuuucuaucggguucuugacccuuuuagggagacagcggacgagguucguaagccaggaaaacuagcucccuggacucccuggcgagugcgugcgaugaggagaggcccgagcacuuugggggugcacgguggugguggggggaaugaguaaaagcgcagcguuaucgugaaccccaccccagaugauuaccucgccguuggugauguugaucgccaaauagauguccccgaaggagccagacccgaucuuccguaccaguuuauauuucccuccgacaaugaauucagccuuggagccgcugcuacucgccauccugagagacgaagauggaggcuggggccaagccccgacaccucugggaagaggacggaggccucggggcuccuacacuaggcaaggcuacggaggagggcggcaggaaacggaacacggaggccuuuaccgggguucggggcccagaaucagcagaggggaaccugaucaccgccgcucagucagguuucuuuuugccaggccgcaguuugugaagggcuucucggcgguuaccaggcugggccacuuguuucucggcggccgccgcugccucgcuugcgcggcgacgucgcgggcuggaaaaggggcgcggugagcuagggcggcgauaccgcugccaccacugccgccggcuccggcccagagggaccccugucacuccgcggacgacgccaucuuguuacuccagcuccagccaacacaaaaugcccccaguccccgggagccgcuucuucacggcgcagagcacucugggaaagggaucucgggcgcucgcuccgaaggaucggcagcgagagggcggaaccggauccgugagagucgcggcccacgcuccgagcguca

SEQ ID NO: 18571 - RNA, 10189 nt, Homo sapiens
aaugagcuugaacugaugcagcauucaagaagccuggccugggaauuugggcccaggcacaaucgcagacaugcuaugugaccucuggcagggagcuuagcuuugcugagccucaguuuccaugucuguagaaugggcaugagaauagcuaccucacagcaucauggggaggauuaaacaugagcuggcacuggaggcaucccauaaaccacaagccacuaauaaaggugagggggagauauuauugcccugggauuagcgguggcccaguucaaccacuaggaggagagacgggaaggacagacgcagccggcaggagcccagguuuuuccaguuagggugugugcauguggguggggagagguggaaaggagcacaggaaggaagguggggccucuguugccagcugcugagucacccuccucuuuauucuuccuuuuacguuaaaaaaaaaaaaggucuuaauuacuuuuucugcuuacaaaaguggcacaugcucaucguauaaaguucaaacaacaucaaaauauacaguguggaagguagcucguuucccaugcuuaugcuccccagauggaaccacaguugacauuuugguguauguucuuccagauuuuucucuggaugaacagaugucuauuuacuaauuagagaagcagauuccuugaagauaauuuaauuuaauuuaauuaauuaauuaauuaauuuauuuuuugagauggagucucacucuguugcccagacuggagugcaguggcacgaucucagcucacugcaaccuccaucuccuggguucaagugauucuucugccucagccuccaaaguagcugggauuacaggugugcguugccauagccagcuaauuuuuguauuuuuaguagagaagggguuuugcccuguuggccaagcgggucucgaacuccugaccucaggugaucugcccaccuuggccucccaaagugcuaggauuacagaccugagccacugugcccaguccuuugaagauaauuuaaagugaggcagaacuguguaauggguagccucucaccaccaucucagaacuaaccacuguuaacagcuuuguagguauaugcuugaauguuuuauaugcauuuguaucuacaagugggcguaaagguggggggaggcguuaaugauuauagacacaaaggccaagacaccagcguacaacucccaauaggucacuaguuugggcgagugaccucucugagucucauuuucuuccucggaagaugagaauuccaccuuguuuagaguguggcugagaaaaugaaaugagauaaaguaugcugagcucagcacaaugucuggcucagccaggauuagcuauuguuauaggcccacacaaagagucuuuuccuccugcaaaaaugggaucauacuaugcauacacuccugcuugguuuggaggcagaauuacggggaaagauuagucauagggauccugaaauuuacauuggagaugagaagucuugcauuuaaauucacagaauugguugugcaaauguagacugggagaaaccuggauuucacaagcugaaucauggccaacucugccagguggcugcauccccagaugcugagcucucuaaggagggagaugauggggcuucuguagccuggguugcucagucaucugaggcuuccauucccccucccuugccaugcggucuuccaacuaccuacuugaaacauuuugaaacuucuaaaacuuuccucccuucccaauccccaccuccugcaaacccgcuuuguccuccaaucuccccagccacagcagaggcaccaaaaugugccauuugcuuaaaccagacaggggaggggugaggaaugcuacauucugacuuuucccucccacagaucacuuucucuuggccuuuccucccacacgugcccacuccgccuccaucccaccacccuauaguucauuccccaccccacagcuagaagaaauguuucaguuuacuucggucuuuuugaguagguagcaugauggguugaaugguggcaucccaaaagauauguccaaagcuggauuccuaggaucugugggacugcgaccuuguuuggaaaaaaggaucuuugcagauguaauuaaguuaagaaucuugagacgaagagaucauccuggauuauuugaguggguccuaaauucacugacaagugucuuaaucagagucacauggggaagauuugacagaaggggccaggugugguggcucacgccuguaaucccaacauucuggggugcuuugcuugagcccaggagugugagaccagccgaggcaacauggcaggacuuugucucuacaaaaaaauauaaaaguuaguugggcacgguggugcgccuguaaucccagcuacucagguggcugaggcaugagaauugcucgaacccaggaggugaagguuggagugaucagagauugcaccacugcacuccagccugggcgauagagccagaaccugucucaaaaaaaaaaaaaaaaaaaaaaaaaaacagagagaaggggaggaggcccuguaaccacacagacagagauuggagcaauguccucgaugcaccaagaaauguguggcgccccagaagauggaagagacagggaagagaagcuccccacagccuugggaggaaauguggcccugcccacgcccggauuugaacuucuggccucuggaaaugugagagaauaaaucgcuauugucugaagccacccaguuugugacaguuuguuauggcagccacaagacaggaauacagaugauaucuacauaugguuaagaugucaaaaugaugcaagaguggguauugagaaguuugcuuucauagguaaacacuuuuauuagguccuuuuguauuuuuccuggguuucuuuauauagauauaaaaaaguauacaagaggaauacauuugcuuucccucccugccccguuuaggagugaucuuuuaauuuuacuuuuuuuuuuuuuuuugagacagagucuuguucuguugcccaggcuggagugcaguggaacaaucuuggcucacugcaaccucccgaguagcugagauuacaggcaugugccacccugccuggcuaauuuuuguauuuuuaguagagacgggguuuugccauguuggucuuaaacuccugauaucaagugauccaccugccucagccucccaaaguguugggauuacgggugugagccaccgugccuggccaggagugaucuuuuaaaauguguaucugacgcugucagucacgcacuuagaugagauccaaacuccucaagugggcuacgcggcuccacccaaccuggccucugugccccucugaccccaucccauggucuccucuuguccucuaggcuccagccccacuguccuccugcaugaagaucccacucuuuuucuucuucuucuuuuuuuuuuugagauggagucucacucuguuacccaggcuggagugcaguggcguaaucucggcucacugcaaccucugccucccggguucaagcaauucuccugccucagccucccaaguagcugggauuacaggcucccgccaccacacccugcuaauuuuuguauuuuuaguagagaugggguuucaccauguuggccaggcuggucucgcacuccugaccucaggugaucugcuugccuuagccucccaaagugcuggaauuacaggugugagccacugcacccggccaaucccgcccuccuucugccaggucuuggugccauccuugcuccugccuggaccccccagacccuucaguccccacugucuuccuguaauuccuacugaaauuucaucucccccgagaaguccucccugaacucccaauuuaaaauagcuccuuuguuuuuggcucuucuuaucauaccacccuguuuacaaagugugaauuccugcauuucaccgaauguaugccaauauaaaauugucuugaugauguuuuauguauuuuuccuucuaccuaauacuauaaauacaucugucucuuuguuuguuccuguuccccguacccuacucuagacuguaaauugaacuggaaucuguuuuguucaccccuccauccugggugcuggaaauggugccuggaacauagcaagccuuccauaaacauuugucaaauacauaaacgaauacugaaggccaaguacuuuauggaaaccaugacauacacuaaagaaagaguucuuagguuuucucuaaaauagcucucaaauagcgggcagcauuuugugugugcauguguuauucaggaccacggcauccuauuucaccuccuuugugugggccauugagccauacccugcagccauuucagggugcccuuccugcuguccccuucucagagaggcagcucucagggagccuugggaaccuuucuuucugaagcagaaaaaaagucucucuccugagccaacuucuucagggcacagaaggagguggaagauggugccuccagaggggcugcugguuccaaggccaauggcaucuugggauccuuguugggaacccugagucaauucuggugggugacaucucccagggccuucuuccuggccagaggcagcugggggaucucccauaggcuggaggaccagauugaacacugcucuuaccaagcugguauggaagguggcacccuggguuugcuuccugauguagcuacuuaccaguuagggggcccugggcauguuucuaacacuuugaacuuguccuccaucuauaaggaccagaauauauaccucacagguuguuuguuguucuauaaggaccggaauagccaccucauagguugauaucacaaaugagauaauauguguaaaauaaauuaacagagcugggcacagaguuaagggcccaacaaauuaucguuacuuuuguuauuauuauuauuauuuuuugagacagggucucauucuguuggccaggcuggagugcaguggugugaucacagcucacugcagccuccaucucccaggcucaagcagucuuccugccucagccucuagaguagcugggaccacaggugcauaccaccacacucugcuaauuuuugcauuuuuuuguacagacaggauuuugccguguugcccaagcuggucucgaaauaccgggcucaagugauccaccgccucggccucucaaaguguuggaauuagaggugugagccgccgcaccuggccauuauuaucuuaauaacaaguauugucugaccucucuggcucuuguaaaagcauaaugacaauaugccucucauagcaaggaucaaaugaggucaugggauggaaagugcauuuugugcuggguuuggguuugguggcucacaccugcaaucccagcacuuugggaggucgaggugggaggauugcuugauugcccaggaguuugagaccagccugggcaacauagugaaaccccaucucuacaaaauacucaaaaaauuagcugggugugguggugccuguaguccuagcuauuugggaggcugaaguggaaggauuacuuaagcccagggugugggggcugcagugagccgugauugugucacugcacuccagccugggugacagagugagacccugucucaaaaaaaauuaauugaaaguucauucugaaaugcaaaauccuacagaaauguguuagguaauagucccugauaacauuaaucauagaaagucuuuguaagcaaggaaacguguccuuucagggaagaccacaagagggcacccucucccccugccagugccaugccucaucacccacuacuccaggagggucugguccaccccucccuguaaguaaaaggagguacagcuccuccaucugggaagagccugggcccuaggcucuguccuggggacuuuucgcuggacuugucacauggggugcccauuccuucucuauagaauggaggcccaugugguggcauugagggauguguuugaaaguguugcuacuuauagagcugugcucagaaauggucucaacccugcauuucugcacguggggugcaggaucucauauuuacaugcgaugauggaguuucuucuccaaugcaggaguucucuggcugucuuuuucacagcugucucuccagccucaagcacagguaggcaugcguaagugcuuuaguggcacugggugaguaaagaggcugcuccuuuaccuggauauuuaccauuauuccugcccacuuccaaccccgauacccccaggaaucucaaaccacagcgugccaccugucugugggauucgagaagccccaucugaccuggugauccauuccccaagcauguggaaagggaguucuggaaggaaccauggcaaggacaaggacugugagcuuugagaaagccccagugucugguuggguccuguuucaaagcugaaaaaggaagaggugcaguggccaguggauggggccuggagugccccggucugucccugcacucccucccugggcuccuugguggccuguggccuuguggaaucucaggccccucaguagggaagugcugcuacccaggccuccucucagcuccugggaugcacaagagagaugcggggacgcccuuugcauuugaggaucaucaggugagaggcaguugauaugguuuggcucuguguccccacccacaucucaucuugaauuguaauccccaggugucaagggaggggccuggugggaggugauuggaucaugagggcaguuuccuccaugcuguucuugugagagcuggugagagugaguucucaugagagcugaugguuuuaaaguguggcacuuccucgcucucucuccccgcugcugccauguaagacgugccuugcuuucccuuccucuucugccaugacugcaaguuuccugaggccuccccagccaugcagaacugugagucaauuaaacuuccuuucuuuauaaauuacccagucucaggugguauucuuuauagcagugugaaaacggacuaacacagugguuuuucaggugguguuuuuuuuuccccucaaaauauggcaguuuggaggaucacgccaaggcagauaaccaugugaaaaguguccucaugugcuggccacgcugccuauggcacagcuaauguccaguguuacugcagggccuggcuaauguccagaggccacugugaauccaaacaccugugugagaugugaacuggcuucacauuucacacucuuucuuauuugaccuggucagucacaccauugugacugacagagagggguugccacauggcuagaucccaagugccccaagaagcccucacugagcuucaagggacacucuccauccccuaacccuccauaccagggaagcauccccagacauggcugcuuccuggggccuccaacugccaggauguggguccugacugcuaucuauguggccucccaaaguggcuguguggagccacuuggggguguucagcugggccugucagguucuuucccugccuucgccaccuccccccuuccccaaauucccagaaagaaacaggacaggagccaagggcuggaacuuuauuauugucacagagcacaggagagaccgcuugggucucaaugaagguuugcuuuuccucuucuccaggggaagcuacugcaagaaggcccaccagccaggcuaggucaaaugggguuggggccacaacaugauaguuaaacccauaaacacagacuugauucgaucccagcuucacgacuucuuagcugugugaccuuagguaagucuguuaaccucucucagccuuggcuuuguggaguggagugaagagcagggccugcuucacugggguguuaucaggauggagggggacaaggccuaugaaaguguuuagcacagcgccuggcagaucgugaccagucacggaguggaagcuaucaugaucaaaucugauuucuccacggucaggccagcccugucacuacggaugaggaagagggggucucauuucauaaaugccuucaaugcggccugugagaaagacagcuugggacaccugugugagcugccuagucucuggcaaugugggagucggacccaaacaugaggguucuggggccuuggcacuuacuaccauuucuacaucuccaugaaaagcccuagcaagaguacggggaaaguucuaauuuuuuuuuuuuugagacagaguuucgcuuuugucccccacgcuggagugcaguggcgcgaucucagcucacugcaaccucugccucccggguccaagcaauucuccugccucagccuccugaguagcugagauuauagguggccaccaccaugcccagcuaauuuuuuguauuuuuaguagagacgggguuuugccauguugggcaggccggucuugaacuccugaccucgugauccacccgccugggccucccaaaguguugggauuacaggugugagccaccgcgcccggccggaaaguucugauuuugcaccuggauuacauuaggucuucugucauucaguuaguuagcauucucuauaggcagucagagaggcugacuuuuaaaauuauuuagguauuuuuuagagacagggucucccuaucuugcucaggcuggagugcauuggcuauucacaggcacaaucauagcucucugcagccaggaacucccaagcucaagugguccucccccgucggccuccucaguagcugggacuguaggcacucaccacugugccugacuuuuuauuuuuguagauuuugcuuuuggcuaagaaauugccauaggccauuggacuugaaaucagcgcuggcccugccuuuugcugucugggcgaccuugggcuggccacuuuaccucucugagccucacugaucccacagaucuacguaaggagggcuuugaggaugaaccagccuguggaaguaaaugagaggaagugaugggggcauugcugguggugcaacaauggagaggguuucaguagucacuggcucaaaagugagggggcaaaaggaaccucaguguguguguguguguguguguguguguguguguguccaacgucuuguagcaagguuagcaaucaccauguguaggggaagagccauaguguuccuaggguggguagagaugccacaagagggcguucugaguuuucaucuucucuaccuugaaaaauuuuccauuuguucucuggcugcauuccaaaucgaacgaagacuuaagguuuuuaguuuaccuaacugauugaauacacuuuuaaaaugaauucauguguguuuacuaguuuaucagucauguggaugcaauaccgcagccccugucgcaaggcgcguugggaaguggguugagggugugguggagacaagaaacgcaugccugaugguguccugguucaaccgcugcucagccggguggccuuggacaaauuucccaagaguacggcagugcugaaguucccacauccagccucacagggauguuaugaaauagacacgauggaaagaaaagcaacgcaaagguuuggaacaugguucauaagcccucuuaccuccagggacagccuucuucuugaacccucauccugugagccagccgaggccccauuggggggcaacuguggggugggaaggaggcaaauccagcugugaaaccaugaccucaagaacaguauuuccaggaauccccaucuuagcaucuaagggauuccugggaaaacuggaccgugaggacaaggugggagcgaguggccuucagcgccaaggccgccgugucccuaaggaccagcuggaguucucuucugcauccagccccaucuguagcagccaggguggggugccacacgucgccggauguggcuuauugcucugggggggaguagugaccggaacuucaauugcccugaaaaguaccggaaacccucuggcgcccccacccccaggacugcccucugcugucugcacggcucauguguauuccccagucuccugccagagggguggauuuaaaccaaccauucaguuccuagccuggguuuggcaacuuccucucugauaaccuccaguaagucacuuaaccccugagccuuggccuucuuuaauuauaaaaugcaugaguccacgaccuacuggagaggugagaugaauaagauugggggaaggggguaggaggaaggaagccugua

SEQ ID NO: 18572 - RNA, 11627 nt, Homo sapiens
cggggcggggcggagagccgagcgccaacccgcuagcgccugaauccggcgugcugcccgcucgccgcccgccauggcccgcgcagccccgcugcucgccgcguugaccgcgcuccucgccgccgccgcugcuggcggagaugccccgccgggcaaaaucggugcgggaaggacgcggugggguucccagcuggggagggccggcggguaaaggguucucaguucucagcuaggugggguauaggagggcggcugggugagggagggguccucggaaaaggagcuggguggaggagaggcgccgaaggggacgcggcagggaagguccugauggggccggggcauggcaugugaagagggccaccuaggacggaaaagaggccugggcaggacuggccgcggaucucaccgggagguccagggucgcugagcaucugccaugguccuggcuguuggcuaggcgcccgggugacagaggacagagaggcugggcgauggcauucacagagguugguugagggcucucuguguagcagacguggugcuguaguuccugcugggguagagcccucacaguacagggaaguccgugcugagcugaggaaguacggugcaugcagaggaggggcgcuucacccugucuuugcggcccugggagggcuuccuggaaguaacaucuaagccaaaccacccccaggucgauaggagacaguccuggcagagacagaacacuagguccgcuggagauuugcugacagaacggggaacuuuuaacaacagucuuuuuguuuauugugugugugguuuccccaauacuuuauuuugaaaauguucagauguacagcaagaauuuuauaguggucaucuguauacccaccaccuacauucugccauuaacugcugcuauacuugcugugucacauaacuaucacgcacuguucuagacauccacgaauccagccuacauuuugaugcaucuccaaauaaauugcagacaucaggacaccucacuaaauacgucaucgugcauaucauugacuagagugucauauguguuuacaguugcuuuuuuuuuuccucccucaacaacugucauuuuaacuacaugacucgugaagauuuucaagucccucacacgugauauucccacaggcagagauccugggcuucggggugggaggacaaagacucuauuccgcuaggccacucuccaugcaccccaguuggcaggagugccuggaacaucugauagaagcaucacaaacuuacaggguccagugcagugcuaaagcuucuuguguagcagaaccacagcccaggccauacaggguuaagaagacugaagcaugccagaaaccaguuugagacugagaguuuagugcuugccaagaaaagagaauccugaggcuagaguagccagagaagcccucauggagaagguggaguuugagccaggcauugaaggauguggaagaguuaggcaggcaguauccaugagugaccauguguucucucucuguccuuagaucguuugaauacaguguggcuaggaguaagcagagugugcugugggaauaugcagggcacuccccguuuucuuaggaacaggcaacaggacaggacauuucucaccauuggggaaggagcaggaccuccacccagcagaauugcugcauuguggcaacauggagcucucugccuccuuccucccagcuggcccuucuggccccauccaagagucauccagagcaggacacuuggcaaugccucacugcccuucagcuuucuagauuuuccucagcccucugacgggagccucuguucauccuuggugguuuggacucuacccacaacaagaaugcggauuccuguuaggauggcuuaaugcuugugcuucugcaggaccaaaucugagaacccccaaguggcaucaggacccucuaaacccacccauauaguuccauaugcugcccuucucaugcuggucucuuugcagagugugcguguccucucacugacaaagcugauuguccuccagcaucuugcaugaaaucuuauuuccccaagaaggcuguguccccacacccucuggggcagaauucacugcuuccccuucaggacucccuggaacccuguugcacuucaucauggguugucguugcuaauugcgcaggagucugucugcccauuccaugcugggguccugggggacagaagccuguuugauuuuucuuugugccccaggacaucuuacuguaaauuagagaauuggugucaguuguguuaaaugagcugguucacaaugaaguggugucuucugcuuccugaucuugggcagcuucuaggccuuaauaucaauuucucuggaaaaauggguaauuugggacucuuugcacauggaggggaugggagcacacugguuaaaauaaaauccaaagcugucuuggaaguggcuuuguaaguacugugagaggaagugguuuauucuuucaacacagaaaaaauacuucaugaacucuacuguccaccaggaucuggggacauagugaucaugcacucucucucuguccuuaaauaacuugacuacaguacggcuaagcagagugugcugugggaauaugcaggaggaacaccugacucaccucaggugggucagucaagccaaguuauaggugacaucugagggcuguugaagccagugagacacagggugauggcacuccuaucaaagggaacagcucggacaaaggcccaggcaugagagaacaaagcuaugugcccacaauaagagaagccuagacagacaagaagguggcaucuugggaggguaaagcaggaaauggaauaaguaagcagaggccagaucauagagaaccuggugcugucugaggauugccugugacuucuggcaggaacugguacucuguggguccaaauggguccaguaaggacaaauuacaccagauuuauuuaauuuucuuuugggguaaggccucuggacugucugaugagaagagagugguguuucagauacauggugagcaaaaauuauagguagggugguaguccaguucaguagcuucauagcugguuuauaguucucucacaggacuguuuaaugauuagugucaggugaggcacaguggcuaaugccuguaauuccagcacuuggggaggccaaggcaggaggaucacuugagcucaggaguucaagaccagccugggcaacauggugaaaccucaucucuacgaaaaauaugucgggcaugguggcaugugccuguagucucagcuacuugggagccugggagguuugcagugagccaauaucaugccacugcacuccagccugggcaacagagccagauccuguuugaaaaaaaacugauugaugucuguccaggcagugguuuccuagcagcaccuccaagcccugucccaggaaacauucuuaucagugacuucgaugagaauagugauggcauguaaaccaaguuuacaaauaacaggaaggcaggagguacaguaaagacaguguaugauaagacccaaaaaagcugaaacuuuguaacaagauuucaaacuggaauauaguguccuguaggguaaugaacaauccaucauagaguacauuccagucucuuuuuuuugagauggaguuuugcucuuguuucccaggcuggagugcaauggcacgaucucagcucaccacaaccuccgccucccagguucaagcgauucuccugccucagccuccugaguagcugggauugcaggcaugcgccaccacacccagcuaauuuuguauuuuuaguagagacaggguuucaccauguuugucaggcuggucucgaacuccugacuucaggugaucugcccccgcuaggccucccaaaguguugugauuacaggcgugagccaccgcgccuggcagauacauuccagucuugacaaacacagacauaaggaugauuuagguguccgauaguagguuggacuagaccaggaguuggcauacuuuuuucuguaaauggccagagaguaaauauuuuaggcuuuucaggccaugcagucucuguugcagcuacucaacucugccuaaaaugaaaacagucauagacaauaauugaaagaaagagcaucauggcuguguuucaauaaaacucuaguuugcaaaaacaggcaucuuucuggauuuggccugcaggcuguaguuugccaaucccuggauuaaggccugguuuccaaacacugaucacugaacagaacuggucaguaacuuuuaacaauucauagggaaauaagaaaguuagaagcaagguagugaguuuuauauaaaacuaaauuuauucucuuuaauuggucauccugacuuucaguauucuuugcuggucuuuugcugcaaaauaccuuuuucuuuaugaaacgaaaguauaguaggcagcaguuuucagguuugccuuugcuuauuaauagcucuacugacaacucaguccgcagauuuccuuuuggaaauguuauaagccuaggaaauuuaagcaccugggaaccaccagcgcaggaggauacaaagugugaacuacagccucucacucucauguucugucucucuucuucccuaccucccgggccugcugacagcggugguuggggcugggauugggggcucugcuguggcccauuuucuccagcagcacuuuggaccucgggugcagaucgacguguacgagaagggaaccguggguggccgcuuggccaccaucucagucaacaagcagcacuaugagagcggggcugccuccuuccacucccugagccugcacaugcaggacuucgucaagcugcugggugaguggucaguccuggggcuccagugcccagcgcccuggggcuggugacagcacugggcccuucucagacuucccagaccaucaaggccagaaggucauguggcccaaucucauuuuacagauggagcaacagaaacaagagaggggaaggaacuugccugagguuacacagugaguuaguugcagagccgggauuagaacucagguuugacuccuaggccaguuucuuucccuuucaauuugcugccucuaaauaaucgugauuauaucaccuuccacaugcuagugcuugccaggcaccuucugggugguauguaggcauuaccucagcuccccucuaccaaccugcaagaugaguguuauaucuccucuuaaggcaacugaggcucagaaaauguauagauuuaagcuaaagccauuacagcgagaggugggauucaaacccagcagcaucuguccaauacacguucuguuugaugcagaaacucugcuucucagaagugaugcuacagguggucuuacagaugugcaaaguagcauagauaccaaguuauucacuacagcauuguuuguaauagcaaaaggcugaaaguauccuagcugccuauccacuaggaccugggguuaaacaaauuauuguauaacuacacaauaggcuguucagcagucagaauggggaagucuuuaugcccagauacagggcaaucuccaagauacaguguauuguuaaaguggagagcaguguguguaguauguggggguggggaaggaacaagucauagcagcucugucuguguuuaggaguccacugcucugucaaguugcagagugcaggauggcuguaaggagcuaggauaacuuccaagugaucucagugcccaaggccaccaucuccaaacaagcccaguggcugucacccccuggacauucugggauaaaaucugaauuucccucacuuguggauccuccuggggaaaaaaaauguaaaauguuacauuauuuucauuuucauuuuuuuauugacuugguaguccaaacauuuucccagugcaucuguuuacuguuuauuaacaagcagcacaaaugaacaaaccauagcauuuguguuuccuuuaauggaccaguccauuugcaucaagagggccccaagucuuggaggggaccugaggggcuccucuuugucucugcagggcugaggcaccggcgcgagguggugggcaggagcgccaucuucggcggggagcacuucaugcuggaggagacugacugguaccugcugaaccucuuccgccucugguggcacuauggcaucagcuuccugaggcugcagauguggguggaggaggucauggagaaguucaugagguagggcuggcagagcuguggggauggcguuccaggggaaccgagaagaggugggggaggaaccagcuugccuguacuuugugaaaaaggaaaagguccuugcugaauugagccagcacaauucagugcaggcucagagcaagccccuggcaugaggaauggccguauuugguccaguaauggucucccuaguauugucacauugacucucauuuucuuacccucuacuacacugauacuaauaaaagcauggguugcaaacucagucgcuuaacaagggcugaacugggaugcgagucagugaaucagcagguggaagagagcagaacaaggcccccucugaaggaggcagccagcccuccaccgcagccaucugcagccagccguguacaaugcccaccucauguggcuagaucuacucacuuuucagaagaagcuggaaauccagagucgugugugaaaucuuuucaguuuuucaacauuugcaaccaauucaucuuguaagccaaaugaaacacuucugcagggcagaugcagccuguggaccacucauuugcaaacuuuguuguccucauuuuuccaucuagaauaaacaccuuucuucaccacuccuccuaucccugggcuccagcccccuccccaucaccuuuggucccagauguggagggcaaguggucuguucccucccuguucaccaagcugucacuccaccuuuccccaaagucccuccugaaggugcucccugcuuccagccuaaggcgcaggggcugcuccccggaccccaucacugucugccucccuucagugucacucaaguguggccugugcccuccugcccugguuccuggcacuucuccacucccuucccauucuauaacucugcuguuuauagcacuucuuccuuauauucuccagaugucacccaaagcuuauuuccuuaccucucuuucugauauuuuucucccuuaucaauuauauccagaccaauaauguugacuucuacguuuuaugggaaaugacuucucccucucagcccuaguuuccucuucacuuccagacccacauuucaacuuucuggacaccuccaucucguguccuauugauaaccaaacucaacauguuuacaaaagaagcccuagaaugggcaacauuucaaaggccagccagucaggaaauccaucgaugguuccaauccaugcuagugagauugcaugagugauagagcgacaggacaugagccugggggugagugggagcccugucagaugaagcgagaggagaggacaggcuggacuggcagagaaggugacaguaucagcaugaaguugcagugugucaucagguccuagaagcuguggcagaaccgacacuguuggagaaggagaugugucagcaggggugggccguagccccagcugggugaagaaaggguuaugaacuaugaccucaggcagggaguggcucagagcagugauacaguuguuacucagcacagccgugaugugaagccaggccuagaaggauuccauaccuucacacucccuuuaggugggacaggcccgccacagucagagaacaggugccagggaacaugaccagccucuucugccaccacuccauguagaggaagugauggguuccuggugggccucccaggcacuauaacccaggggcagguggucaggcaaaaagccuuccugcacaaggacuccagcucuaugugucuucuaggaucuauaaguaccaggcccacggcuaugccuucucggguguggaggagcugcucuacucacugggggaguccaccuuuguuaacaugacccagcacucuguggcugagucccugcugcaggugggcgucacgcagcgcuuuauugaugaugucguuucugcuguccugcgggccagcuauggccagucagcagcgaugcccgccuuugcagguaagcguccaacccuuggccugcccaccugccccuccuccacccaaggugcucagaaugggcuggggguccccauaauaaccucacuuuuauccagcucauugcagucacauaggcacucugcugccccauccugccugauucugggacuggccaugaguuggcaggagauaguaucaccccacuucacagacagugaaagcaaggcucagaucacagguccaguguguuucuaccacucccaauugcuucauaaucccuugcauguguguaaauguuagagcugagauaaugcucugcucucuacacuuugguuucaagaacugcccuguugaggccuuugagccacugugagagcaccuccucuucccagcucuucacgggaguggcugggccuguguguagcucacugucugcuagcacagaccacaggaguggagaauguaggcuucacaagagcaggaauccuugucuauuguucccugauacauugcaaacacagaacagugccuaagucauacuaggcacuggguauauuuuuguuaaauaaaugaaugcaaagguuuacaauaacaagcaccucccucguacccucgauacuguucaucuggcucugcacaugcuggcuccuucgcagccuucaggcccugccucaguguccccucaguguuccuugcucacucuuucaguaucuugugugucuccuucauagcauuuuuguguagagauauauagaauucacauaccauauaauucgcccauuuaaauugcacaauucagugguuuuuagcacauucggaguucuaaaaccaucaccacaaucaauuuuaggacauuuuuaucaccccagaaagaaacccccuugcccuuuagcccucaccuccccaacaccccccggccucccagcccugggcagcuacagaucugcuuucuguuucuguggauuugccuagucugggcauucugcauaaauagaccucacaauauguggucucugggagcuggcucuuucguugagcacagugucuuccccccauagcauugugcacuuuguuguacuuacuuguauguuugccaucuccccaugcccaugguugggagaguuuugcucuggcagggaggcccagucgaauaguacuggacuccccagcccuccugccccacggcccugacaaccuaucagcacccacuucccgcuuugcccaggagccaugucacuagccggggcccaaggcagccuguggucuguggaaggaggcaauaagcugguuuguuccgguuugcugaagcucaccaaggccaaugugauccaugccacagugaccucugugacccugcacagcacaggugaguagacagggcgggagugggcaggcaugccauucccagccaguggacagacacuucugccuccuuuguaccucagcccuggucugugaucccccuggggaguauuuccgaaaaagcauugagaagccccaacccugccaggugacacuagagggugcuguuuccccaauucagaugucagccagaaagcugagacuuccaucgacccagccuuuuucuguugaccgaugaggacuuugaaugacauccuugcccacgcucccccaacuggccagcggcggaagcagagcagaaacugagucuccugacuccaugccccuugcuucuucugcagccgcaucagcauggagaggccaggacccaccauuuagacagcccugcugcacccugagcaccagggucucguuguaccucaaugcuggaccccaguagggaguucaguggguagaagccaagggaaaguugacuuuugugcucuuuucuuuccagaggggaaagcccuguaccagguggcguaugagaaugagguaggcaacagcucugacuucuaugacaucguggucaucgccaccccccugcaccuggacaacagcagcagcaacuuaaccuuugcaggcuuccacccgcccauugaugacgugcagggcucuuuccagcccaccgucgucuccuugguccacggcuaccucaacucguccuacuucgguuucccagacccuaagcuuuuccccuuugccaacauccuuaccacagauuuccccagcuucuucugcacucuggacaacaucugcccugucaacaucucugccagcuuccggcgaaagcagccccaggaggcagcuguuuggcgaguccagucccccaagccccucuuucggacccagcuaaagacccuguuccguuccuauuacucagugcagacagcugaguggcaggcccauccccucuauggcucccgccccacgcucccgagguuugcacuccaugaccagcucuucuaccucaaugcccuggagugggcggccagcuccguggaggugauggccguggcugccaagaauguggccuugcuggcuuacaaccgcugguaccaggaccuagacaagauugaucaaaaagauuugaugcacaaggucaagacugaacugugagggcucuagggagagccugggaacuuucaucccccacugaagauggaucaucccacagcagcccaggacugaauaagccaugcucgcccaccaggcuucuuucugaccccucauguaucaagcaucuccaggugaccuacugucugccuauauuaaggguccacacggcggcugcugcuuuuuuuuaagggggaaaguaagaaaagagaaggaaauccaagccaguauauuuguuuuauuuauuuuuuuuaagaagaaaaaaguucaucuucacaaggugcuucagacuugguuucuuagcuagaaaccagaagacuacgggagggaauauaaggcagagaacuaugagucuuauuuuauuacuguuuuucacuaccuacucccacaauggacaaucaauugaggcaaccuacaagaaaacauuuacaaccagaugguuacaaauaaaguagaagggaagaucagaaaaccuaagaaaugaucauagcuccugguuacuguggacuugauggauuugaaguaccuaguucagaacucccuagucaccaucuccaagccugucaacaucacugcauauuggaggagaugacugugguaggacccaaggaagagaugugugccugaauagucgucaccauaucuccaagcuuccuggcaaccagugggaaaagaaacaugcgaggcuguaggaagagggaagcucuuccuuggcaccuagaggaauuagccauucucuuccuuaugcaaagauugaggaaugcaacaauauaaagaagagaaguccccagaugguagagagcagucauaucuuaccccuagauguucaucccagcagaagaaagaagaagguguugggguaggauucuucagagguuagccugguacuuucucaucagacacuagcuugaaguaagaggagaauuaugcuuuucuuugcuuuuucuacaaacccuuaaaaaucacuuguu

SEQ ID NO: 18573 - RNA, 2198 nt, Homo sapiens
ugcagcuuugcagcagcagacucaaaggcaaaugaaaggguuaagcaaucugugcaugucauucuuguaucauucuacauuaagucaugggcaguaauuacaaguaguuaccugcgguuuccagugggggaggcaacagcacuccagucaagggguuuuggagaaacaggugcaaugaaggcauggucaaacaauuuauuuacuguaaacuuuagacuuugcucgggaaaacaacugaagcugcuccucaaaucccugccuaaaauaccccgugugagcaaauaagaggagugggggaagaguccauguucacagcugaaagguccgagauacucaaaauccucaaguccaaggguguaggaaggaaaaucuccuucagauacaaauuaccagcagcaauauauuaccccuaauacuugaauagugagguagauacauggaaaagucaugaaaauauagcagacucagguccucuaggacuaaagcucuuuagacauaaacuuacaaauuccaugcaaagaggaacugaacuguacaaauaacaaauaaucacucaaauaaguuuucucucuuuuuacagcuuaaaaaaauaaaaaaggcagaaggaugcccuuccuucugcauaucucuauacaauuuuacaauuuuauucuaaguuuauuacccucaaguuaaauagucuguuuaguguucuguugggggggggggucuuuaaaaguagaaaaacugcuuuacagcagugagucauuuguacuacaauuccucccuugugaaucaauguuaucgcuaggcacaguaccuugauggcccacaaagucuuccgugccugggaggucuucacacagcaguuuauuuucuuucuccuguuccacgugauauccacucugcuccccuguguugccguugcuggaguagccauucccauaggccuucaaagaagaccugcgcaggcacagaagcuccuggaaggcaauccugaaaucugggcuccggcaguagauaaggggauugaaaccagaauugacauagccuauccaauuuaggaggauguaaacuuccuuacggaugagguuauccuggaucacaugcacaauguuaacgaugaagaagggcagccagcagagggugaaagugcccaugaugaugccuaacgucuugagggcuuugugcuccuucaagcagaacuuggaagaucugcggaguccaugccccguccgcccauccugcuccaccuggcuaagguucuggacauggaagcggcccucagauuugucaaucuucuggagcugccuuuuggccuccugaaagacccuggaguagacgaagaccaugaucaccaggggaacguagaaggacacgauggaagaggcaauggcauaggcuugguucgugaagaagucacagcaggucucauuggcauagcaguugauggcuuccugguggguggcccgguaccagugcaucugaaugggcaagaaggagguaaggccugacacaauccacaccaucagaaugaucacccgggccuuauucuuggucagcaggcucugguacuugaaaggugaaguaauggcaaaguagcgauccacugcgaucacgcacagggucucaaugcuggccgugacgcacagcacaucaauggaaguccaaaacucgcaccagaaguugccaaaaguccacauuuucauaagaauaugggcggccccaaagggcaccacugccaggcccaugaccagaucagcacaggccagugaagugaugaaguaguuggugaccgucugcagacgcucgaacuuggcaauggcugugaugaccagcacauugccaaacacgauggccaggacgaugagagacaugacgaugcccaugcccaccacccacaccucgucccuuuccugcgugacgucgugguccggcgcauggcuuccauugggugccagcaagaaggcgcugccguucccggguugccccauggcgcgcagucuggcaggugagcgcacuggcugggggcgccucagcgggcggacccacggcggggcucugcgggccgcgagcggacgccuggaagccucauucagcggcuguggugugggugugguggggacucguccugcacacucagcuugucgggugcuaggggcucgcggugccugccaguuccagcccgugcucugaagaagccgcuucgcagugcguuc

SEQ ID NO: 18574 - RNA, 2198 nt, Homo sapiens
gaacgcacugcgaagcggcuucuucagagcacgggcuggaacuggcaggcaccgcgagccccuagcacccgacaagcugagugugcaggacgaguccccaccacacccacaccacagccgcugaaugaggcuuccaggcguccgcucgcggcccgcagagccccgccguggguccgcccgcugaggcgcccccagccagugcgcucaccugccagacugcgcgccauggggcaacccgggaacggcagcgccuucuugcuggcacccaauggaagccaugcgccggaccacgacgucacgcaggaaagggacgagguguggguggugggcaugggcaucgucaugucucucaucguccuggccaucguguuuggcaaugugcuggucaucacagccauugccaaguucgagcgucugcagacggucaccaacuacuucaucacuucacuggccugugcugaucuggucaugggccuggcaguggugcccuuuggggccgcccauauucuuaugaaaauguggacuuuuggcaacuucuggugcgaguuuuggacuuccauugaugugcugugcgucacggccagcauugagacccugugcgugaucgcaguggaucgcuacuuugccauuacuucaccuuucaaguaccagagccugcugaccaagaauaaggcccgggugaucauucugaugguguggauugugucaggccuuaccuccuucuugcccauucagaugcacugguaccgggccacccaccaggaagccaucaacugcuaugccaaugagaccugcugugacuucuucacgaaccaagccuaugccauugccucuuccaucguguccuucuacguuccccuggugaucauggucuucgucuacuccagggucuuucaggaggccaaaaggcagcuccagaagauugacaaaucugagggccgcuuccauguccagaaccuuagccagguggagcaggaugggcggacggggcauggacuccgcagaucuuccaaguucugcuugaaggagcacaaagcccucaagacguuaggcaucaucaugggcacuuucacccucugcuggcugcccuucuucaucguuaacauugugcaugugauccaggauaaccucauccguaaggaaguuuacauccuccuaaauuggauaggcuaugucaauucugguuucaauccccuuaucuacugccggagcccagauuucaggauugccuuccaggagcuucugugccugcgcaggucuucuuugaaggccuaugggaauggcuacuccagcaacggcaacacaggggagcagaguggauaucacguggaacaggagaaagaaaauaaacugcugugugaagaccucccaggcacggaagacuuugugggccaucaagguacugugccuagcgauaacauugauucacaagggaggaauuguaguacaaaugacucacugcuguaaagcaguuuuucuacuuuuaaagacccccccccccaacagaacacuaaacagacuauuuaacuugaggguaauaaacuuagaauaaaauuguaaaauuguauagagauaugcagaaggaagggcauccuucugccuuuuuuauuuuuuuaagcuguaaaaagagagaaaacuuauuugagugauuauuuguuauuuguacaguucaguuccucuuugcauggaauuuguaaguuuaugucuaaagagcuuuaguccuagaggaccugagucugcuauauuuucaugacuuuuccauguaucuaccucacuauucaaguauuagggguaauauauugcugcugguaauuuguaucugaaggagauuuuccuuccuacacccuuggacuugaggauuuugaguaucucggaccuuucagcugugaacauggacucuucccccacuccucuuauuugcucacacgggguauuuuaggcagggauuugaggagcagcuucaguuguuuucccgagcaaagucuaaaguuuacaguaaauaaauuguuugaccaugccuucauugcaccuguuucuccaaaaccccuugacuggagugcuguugccucccccacuggaaaccgcagguaacuacuuguaauuacugcccaugacuuaauguagaaugauacaagaaugacaugcacagauugcuuaacccuuucauuugccuuugagucugcugcugcaaagcugca

SEQ ID NO: 18575 - RNA, 26825 nt, Homo sapiens
cagcggcuugggcccuccggcccuccguagccgcucgacugucgcgcugcaccagcuuccuccucggcguucccacgccuauuugggcggauucuuggcgccggaggaagaggcagggucacccucucuccacgucagagaccugacuguggagauggcggcucagaagauaaacgaggggcuggaacaccucgccaaagcagagaaauagugagugagaaccuuccgggggccuguguguagacgccggguccgucucucacuggcgcggccuuagcacccggggggggcgggagggagggcucagggcugaggggccucggcgcgcuggugcccgcagggcugccggggcucgguguccucugggucacacucccggggucggggucagcucugcggcgccucgggaagcgccguggguccaccccgccggaaguccgcuccccagagccggugugggcggggacucggcgcagugcugcggggcgagggcuucucuacuugggcgcucugcuccugaagauuguggugggggcugucugugcaucggaggcucguuagcagcauccuuggccucuaccugcugggugccggucgcaucucuuccccauuuguggcaacccaaaaugucaucuggggaacaacaucgcucuguugagaaccaccgcccuagaagagcccccuguguggaggggaccauagguuuaccccaaaaacuccucggugaaccuuugucaucuggcauuuuacugucccugugggcagggacugugcuucguucguccuuugauguguauguccugccaccucugguacaguacguaguaggcacccugcaaauguuugugggacugaacugauaauccuuaauucauccuuuuggcagccucuuccccccguuucauuacuccagugcauuuuuaucuggcaguuacaguuaauagaaagucagcauugugggccgggcgcgguggcucacgucugcaaucccagcacuuugggaggccgaggcgggcggaucacaaggucagaagauccagaccauccuggcuaacacggugaaaaccgucucuacuaaaaauacaaaaaauuagccgggcgugguggcgggcgccuguagucccagcuacucgggagccugaggcaggagaauggccugaacccggaaggcagagcuugcagugagccgagaucgcgccacugcacuccagccugggccacagagcgagacuccgucucaaaaaaaaaaaaaaaaaagaaaagaaaaagucagcauugugcucuguggugggugcuucacauacauaauuucauaagcugagaucuucacaauaacuuuccaaauagagauucuaauuuuucguaagaggaaaugagacucagggaagccucauaacgacuugcccccaacugcacaggugaaagaucgcagagccaguuuucaaacaguggaaaaacucaagcucuaucacaugacucgaggcagucagcguguaaggugcuggggcucuccuggugcaggagguucccacaacauucugcuuucuagugggagcaaacgcaaaauuuguaauaagaauaguguguggaauagggaccacaaaaaagcuguauuaacugugcauagguaacccagagggagaaguuuauucugccugagaaaauuugaggaggagaugauuugugagcagagcuugaaaaauacggaauguuuuagacggagggaaaaucuugugaaagagauucugugcgcaaccuguaguauguauuauacgcgggccugaaaaugugcucugggaacagugaauguaguguagucacagugccaggggacgagcuggagugaaaaagaguuggggccagacugugaagggacagcuucucacauggcuauuguaggcauccaaccaguggacucgguuagauuugcuuuuggugaaagaaauguggcagcaggcugggcccugucgcucaugccuguaaucccagcacuuugggaggcugaggcggguggaucacuugaggucaggaguucgagaccagccuggccaacauggugaaacccugucucuacuaaaaauacaaaaauuagccggcugugguggcgcgcaccuguaaucccaauugcucaggaggcugaggcaggagaaucccuugagcccuagaggcggagguugcagugagcggagaucgcgccacugcauuccagccugggagacagagcaagacucuguaucaaaaaaauaaauaaauaaaaaggaaaagaaaaagaaauguggcagcaguguggagaauggacuuugacauauucaguaaacgaacauuuacaaaguugucucuguguaccuguaccagccacagaggauacuggaguaaccaaaaguggucccuucuucaagagcuuagaauucacaggugggcagacaaguuaacagaggacuaaaaauaggauguucagugcuagaauagaaguauucagugugguaugguagagauaggaagcaaggaaaagguaauaugcucaggauguggggaauggaagaggaggaaaggugacucucccaugaagguacugccagacauguuaguggguugucgacuucaggggagagguggugauggccugaauucaaauaacaguacagggguaggacugggugauguuugucaguaagguugacaugcuuuaaugaggugccugcauguagagaugaagaguuaacuccuagguuucuaacuugggagacgagugggagaggccuucagccaagauaggggauauagauuaauggaugugauugguggguaggucuggggcagggagguggggcggggagguguggaguucaggcuugaaguguuaguuugaaaugcugcuagacagaguuacucagugggugguaggaaaaaugggccaggagcuuaggagauauuugauuuuucuccauuuucuaaugaugacguaguucaauauugcugaguaauuuuguaaauugauccccacacagaugguaauuuugcuguuuucuuuuuuucuguggaaauuggucaguuuccuuauugauucuuuggagaaaaaggucaaaaggacuaacagguauggcugcuaaacccaaauuagcuguauaucuuucuuccuuauuagugguguucaugugacuugggaugguuugcccaguuuuaaacucucugggucuuuccguguauagcacauuaggugacggagugauuguaucuuguuuuuagugggauuaaaaaaauuauguuaauauacagaauguaauguuuguuaugggauaggaacagaggguuagcauuuugcauauugcauauuuccucaauuuuguagauuugaguagacacaccacaauuuaaggauauuauuuuucugaacagugaaauucuugguaagcuugaaaaauugcuuauuuuaauuugaaucuuguaacacuauauacacaaacaaguuuuagaugcuaaauauguugaauaaauuuaauuggcaaaaaauguuacuguagcuggcuggguacaguggcucaugccgguaauucuagcucuuugggaggccaaggugggcggaucacuugaggccaggaguucgagaccaccuggccaacauggcgaaaccucuucucuacuaaaaauacaaaaauuagcugagugugguggcacaagccuguaaucccggcuacugaggaggcugaggcacgagagucacuugaaccugggaggcggaaguugcagugagccgagauaauaccacugcacuccagccugggugacagagcgagacccuaucucaagaaaaaaaaagaagcuaugacuuuguggcaguucccauggcugucacauaaugaaggcuguacuucugagugcucauacagaugccucaucuuucaguuaagauacuccccugagucauuugaagcaagcaguguucugugcaagcaggccuucacuaauugaaugacauuuagaauuuacgaugguuugggcaauuucuaugcacacccaaauuugacaguuacugaauuaguuuaaacuaagucugaaauuauuuuaaaauaagaaaauaaauauugaggaaaaggcaaguaaguuaaggauucaaaauugauuguccuuugguuuggcauccaagaagccaguagugauccuagaaagcaguuucucuuggcuuuuguaauauccuucccuuucugauuauccuucuuguuuauggguggcgaguuuucacuuuuuuuuuuuuuuuuuuuuuuuuuuuuugccuacuuccucuguuguuucacugaaugauuguauuccuuagucuuucuguucucucucugcagucucacuaggggaucugaucucaucuaugcucuugacauaugcuuaugaugccuccauuuaugucucuagacucuugucugugcgucaguuucaugaaucccucugcugucgauacugugcuucagagguucuaaagcuuuaaugcaccuuugagcucguuaaaccucagaggugcuguaggcuugggauggggucaacaauuuacgauuuuaguaaguucccaguuagugcugauggugcugguccagggaccaugaauugagaaccucuaggaggaaaaccacguaccugugacagugggagugaaagaggugagguuguguuuguuaggccuaaguuuggauggaggcgggugacacagaguuugugccugaugguuucuccuuuuuuuuuuuuuuuuuaaagaccuagaaggucauuacaagcagagaucugacuuauaaaugugguugguaacuccuguuaacuguguuuuuuucauucuagccugaaaacugguuuuuuaaaauggaagccagauuaugacagugccgcuucugaauauggaaaagcagguauuuuugacuauaguccaguugcuccaguauguaaucuuaaaauagucugauaacuucauuucaccauaauacuuacucauaugcuuucuauaaggcuuuaauaguuaaaaaacaaacaaaacaacugugcaagcccuugaguuuuuuuccacuuguuauuuucagauguguugagagcugagucagaguuccugguaccugcugucuaugacagcagggauggggcgggguuggugauacacaguaguggguuuuuagcguugcuuauauauucuuuaacuccaguuauuugaauaccauauccaugaguuuugccauauuucucuauuauacuuucuauugaauuaggaguuuguuaaauuuuuuguuaacuuagccucaucuuaaccugauacgcaaaucauauguuugcuugguauuuuaugucuuuuaugaaccucacuuugaguguaucuguucaguguucaugaaguguuaagcuauauacauauuuuaaucaauuuaucuuuauauaagauauaaacaaucuaaaauaugcaacagaaagggaauuuacuaaaaauguagcauucugaauuacagaaugauagcuuuaagcauaccugugauaauuugcaguauaaauauaacaaaauuuugaaguaccuugaacacauuuucaguuguauuucagcgauagcccuuaucacauuuguuagccuagcauagagaucaucuggggcaagugcuuuugguuaaacagcaaaugagucuucaguacuuuuauuuaaaucugaguaaauucuguuuuuuugcaucaugcaaauuguuuaucuuauacuugaaaauuauuaaaaguucaaacuuuguaugaauuuuguggacuacucaugcaaggaggcuucuguagcagaagggaacaacauuuugcaaguuuccucugugagggaaauuuaacacagauuuguuuucugccccucugagaucaugaauuacauucaaaaauaaauguuuuagaugaaauuuucccccugaagcauccuuuguuuauuuucuuuaagggcuuauggaaaaccuauuuaaucagaauaaauuuuuuaaaaagcaacauauggaaaagcagggaggggaauagcuucaguauuugguuuucacauuuuauuaaagagaauuuuaagaguguuuuuaacaaauagcacuuuucuuaaagcauuaugcuuuuugcuucuuuguaagcaacccuugauaaguuuuccaaaauuuguaagaucauauguuauaagcacuccuguuuuguuuugaugauuacacuuuuaaaacagcuuucaguaugcuuuagcuguuugaacagugagacaucuuuuucauagauaguaaacaguauaaaagauuguuuuuuuaaaaaaaugcauuguuagacauuuaaagauugugccaaaaggaagguuuauuauaaaaaacuguuaaaugugcuuauuggcccucaguuucuaccuaaucgaaugaccuauacccaaaauaccguuuaaagguaaaacuggugaaguaaggugcugucuuuugugacugaagaaucugccgguuacuggggaguauuggggaguguugguguuagaaagacuucuugauuuugaguggaagaaacacugauuuguugccaguagucaacaauuaaaaaagaaaaaguuuuaaaaauacucguaaguuaccaauaauuggaaaaguuguaaggaaauugcuuuagaaaaaaguaauauuuuauaguuuuaggauacuuccuaaguauuugaaguaaguauguuuauaauacuucauauaaaaugcagauuucaguaaugauucauuugagguuuuuaaugauggaaauagucaauuuuuuuuucuauuucagcuguugcuuuuaaaaaugccaaacaguuugagcaagcaaaagaugccugccugagggaagcuguugcccaugaaaauaauagggcguaucuuuuucaacuuuuaaaaagaaauuaaacaauuagaugauuuugacaagcuguuuucucuugcuguaaauuuacuuuacuaccugugaaguaaaauguuuuuaaauuagaaaaugauuagaaaaauucuguauuuuuaaacuaugaaggagcguuuauaaugaaguuugauuauaagguccacacugguucgcagagcuacaauacuuacuuucuauuguuugugauuuuacuugaugaugguuuuacuugggaugaaguaaaguaaaucuguagacaugugcugaagaaugaagaaguagcacagguauugaaaacacgugaacuacuguaucaauuuuuuuaaauacaguuuuccuuagguauuugaaauaaaaauuauaaguaguuuaaaacaguacauuuucuugagguguuugcaaacuuaucaauaaaaaauguuucucuuauuugcaaacuguagucauaauaacuuuguacuucaguaaaacuucagauuauugcguaauagaaauaguuuaaaaucugugcaguguuuuguuagugguuuugggaauuauguaguuuuaaacuauauugacagguauugaauuacuucuuuuuuaccuguuuguaggauuugucuuuuggaaccaacugggucagugauuuaguuaacugucuuuaaauaguugaucuauagaaacuauugauuuuuuucuuuuuuccuuaacuuugacuucguuacuuccauucagucuuuuucaugcugccaaguaaguauucuucauguuuucauguauuugcaaauuauguuuuaaauguugcuguuuuucuguagguugguaauuuuuucccaaauuauaaauuuuguauugauuuaaauaauaaucauuucucuuugcuucaguuuuuaccuaaaccuuaaaaaccaagacuuacuccuaacuguaagauguaaagaguuuaaauuaaauuugccauaauauuuuauuaggagcauuuuguucaguagccuaugggaaaaaaauaaguuaggaucucuuuuuuccucuguuugauaguuaauggugccuguggagaugaagcaggaagcuuucucuugccuuguggagaguaguuauuuguuggccgaggcaggcggaucacuugaggucaggaguucaagaccagccuggccaacuuggugaaaaaccucgucucuacuaaaaauacaaaaauuaacuggaugugguggcacgugccuguaaucucagcuguuggggaggcugaggcaggagacuugcuugaaccugggagauggagguugcagugagcugagaucgugccucugcucuccagccugggcgacacagcaaggcuccaucccaaaaacaaacaaacaaacaaaaaaacuuagguuuagguuugucagauggaaauuaauuuaaccuuacugagccuuacuuaauuuugcaucugcaaaauaaaaucucuuuaacucaaaugucugauguucuaagccauuauuccccacaaaaaaagaauaaaaaauuauauugugugguaauauaagccugaagugauauguugugcaugagcccauuguaauugaagucacuuuccuuaccaguaguuccucaccagaaaguuucuucuaccccuuauuucguuaagaucucaucagagaaauuauauucucuuugcagagcuuaugagcaagcuggaaugauguugaaggucaguaauguuaugucacaauuguuguguagguaaaaugaauuaacuacaagguguuaaacaagaauuuuuguugaaguugaaaagcuuccuuacuguaaggcaagaggugcuaaguuaagauuuucuguccacgguaacguuaauuggacccauagaauacauucuguacgucuuaaggaauguuaaaagugaaauuuaagagaaaauguauuggagugaacugggaacacuaauguucuaagcucuauaaccaggauagauguguauugcuauaaaaagagcucuaugggaaguuucucuacuuuugagaaggacaucuaaauguaguaaaauuuuauaaauauuaaaaaauuaucauacauggguuauagaagagauuuuuacuuaugugaauaacaguuggcagcagaaacaaccacagauuuaagcuuuugcuacuuuaauucauucugcauggaauauuccaacuaauguaccugugccacuguuuguacuucugcuccucaaaagcaggccaggaauuaauguccugcuguggugagacagaacauacuacuuuaugaugcugacuuucaaaguaugccagcuggcaguugaaaugaaguauuugucuuucuuuuuuaaaaauguuuuuuucuaaaaugguaaaagcuacuuucaaguauuuauuauaaagcuuuguuuuuaagaacuuuuaccuuaguaaagcuuuuguuuuuaauuucuaugacuuuuauaaugugaacuuacucauuuuuuuagugaacacaugcucauuguagacaauaaaaaauaccgaaaaguuaaagaauguuaguaauagcuguuaacauacuuaguuuaaaagauuuuauagucuuugacccaggaauuucaauucugugagucuaucaucgagagagagagaucaaagauuuaugcaucagguuguuucuugaagaaaugccaauuaucuaaauuuugaauaauaggaaagugagguuggauguaguggcucaugccuguaaucccagcacuuugggaggccaacguggguggauuaccugagaucaggaguucgagaccagccuggccaacauggugaaacccugucucuucuaaaaauacaaaaauuagcugggcaugguggcgggcgccuguaaucccagcuacuugggaggcugaggcaggagaauugcuugaacccaggaggcagaguuugcagugagccgagaucgugccauugcacuccagccugggcaacagagcgagacucugucucaaaguaauaauaauaauaggaaaguguuuaaauaaauuaugaugcuuccuuauuauaaacuauuauauauccauugaaauaaagcuuuucuggccaaacaugcaacugaauugguauuuggugccgcaaguuagguuauuaaccacaguuccuuugaaaccauagaguuucucuuacggccaaagaagcuggggaucugcucuggucuucuuaugucucauuuuccucugagaauuaggaagcucccagguggcuguuacauucuuaguguacuucaugccuguuuaagaaaugcucaaacacucuaauucucacagccucaguuuauauuacaacagcuguacuaagacuugaaucuucaucaaaaguuauuauucaggcaucauuuccauugcucaaguaucuauuuaauuugaggguuggaaaggcacuacuuugaaugaaagaaaauuaacuuaguggauagggaaacagaugaaggaaaaugcuuucuggcauugucuuauauuuaaauuaaaugccuuuggacacuguugggagcacaggaccccugagcuacgugguccacaauucugugggcuaaaauuucuaccaauuugucauacaaaccuucacacugauucaccagaaaggcuuggggagugccauuuuguagacauaugcacaagggaagccacagaaacuuguuggaucaaccuuugguucugucacuugaugacugcugugauuucauauccuguuugcuccacuggcacacagccauugaaaauaggcauauuuaugguggaggguauaacuuucaaguaggcagcucaucauuuuuuauggagaaguaucaauauugugguuggaccucuuacucacagccucacuugauuuuacgcaaaaacaggaagauguaguugcuaauuuuuaaacaacaaauaggacucggaugccauuuuuacugccuucuaauguauuuuuugcucuaucuacuggguaaaacucaugacgaauaguuccugugguuuuuuuauccucccaaaugcuuuuauguuguagauucacauuauauauguaauuaguggguagguauauuuggggaggaaauacaguugacccuugaacuacccaaggguugggaugccaaccccuugugcaguugaaacucuacauauaacuuuuuacuccccaaaaacuuuacuaauagccuguuuuuguuuuuuuuuuuugagacaggaucuugcucuguugcccaggcuggauugcaguggcacaaucauggcuuacugcagccucaaccuccugggcucaggcgauccucccaccucagccuccugaguagcugggacuauaggugcaugucaccaugcccugcuaauuuuuuaauuuuuuugguagagacugguucucgcuguuuuucccaggcugggcucaaacuccugggcucaagugauacuucugccucaaccucccaaagugcugggauuauaggcgugagccacuacccuacuacugacuggaagucuuauaaauaauauaaacagucaguuaguacauauguuguauguuguauggaauauguuuuauacuguauucuuagaauaaagcuagagaaaagaaaauauuaagaaaaucguaaggaagagaaaauauauuuaguguucuuuaaguggaaguagagcaucauagggcucuucauccucaucauagucuucacguuugggcugaggaggaggaagaggaggaggaggaagaagagggguugguuuugcugucucagguggcagaggagcaagacagucugcguauaauuggaccagcacaguuuaaaucucugcuguucaagguucaguuguauucuuuaaaagccaaaaugacccucaggacuaaugugucugagagagauuuuguuagguuuaccuccccuguucauucagauauuuuucagcagauauuguagacucggauucuuucauugacuuuugguuuuauaacaaaaaaaguauuguuuuuauuuuuucacugagguuuggaaaugcauuagcauuucauucugcuugagugaaugauagcagucuuauuucauacagugucuuucagucuguguuauuguuaguuuccauagcuaaauaauaaaguuauguuuugggguuggcgaaaaugagaccaguuuuguuaaggguauccuaaugaauuugucaacuuagcaagggacugaauaggcagauuuguaaaccacccaugagaugucaguguggagccuaccuuaagauacagcaagucaacacuaaauaaguugcuuauguaaacuuuauaacuagcuuuuaaacgguguuuuuuuuuaaguuuauuuuuaaaauguuugauuuggagauauuagacauuaggacugcaugauccugagauguguagauuaauaguaagauacagaauuuauuagucauggaagaggguugcaaacucagaugaacucaggguguagaggaauaacuaaaaugaaugagcagcugggacguggagggcauuuggaagugaagagcggggagaagcgccaggaggugcaugcucauguggcgggacagugcugcccagccccagccuguugccauacagggaugcaagccugcugaugccguagcuuuugauauuuuuuugaagaaagccauaaaacaauuuucaugaaaguaucuaauuuaaaaauacugcauggaucaagcaaaacacacuuggaagugagauagagucauugggcugccaguuugugauccuuggcauaggucuuguauguaguagggacuugguaaauguuuaaagaauaagaagugcuuagaaaacaguaaagagcaagguuuuugguuuuuucuauuuucauagauuucccaaaggucugugaagugaugaugaacucuguguagaaauuaccugguaccuuuuugauuggguuuaaugaagcuugauugggagaguaaucaugugaagcauuucauuuuaaauaucuuuauugcuauacaauguauuugagucauuuacuuucaugaauuagggauaaaauaauuguauuucauauccuuugcccacuuuuugauuggguuuuuuuuuucuuguaaauuuaaguuccuuguagaaaaagaagacauacagccaagaaacaugaaaaacagcucaucaucauugaucauuagagaaaugcaaaucaaaaccacaaugagaucucacgccagucagaauggugaugauuaagaagucaggaaacaauagaugcuggccaggcuguggagaaauaggaaaguuuuuauacuguuggugggaguguaaauuaguucaaccguuguggaagacaguguggggauuccucaaggaucuagaaccagaaauaccauuugacccagcaaucccauuacugggcauaugcccaaaggaacauaaaucauucuauagaaacguauguuuauacaguaaacacguauguuuauuguagcaccauuuacaauagcaaagacauggaaccaacccaaaugcccaucagugauagacuggauaaagaaaaugugguacauauacaccauggaauacuaugcagcuguaaaaaagaaugagaucauguccuuugcagggacauggaugaagcuggaagccaucauucuuggcaaacuaacaaacacaggaacagaaaaccaaacaccgcauguucucacucauacgugggaauugaaccacaaggacacauggacacagggaggggaacaucacacuccugggccugucgggggcuggggaauaaggggagggagagcacuaggacaaauaccuaaugcaugcggggcuuaaaaccuagaugauggguugauagguauagcaaaccaccaugggacauguauaccuauguaacaaaccugcacauucugcacaugugucccagaacuuaaaauaaaaaauaauugcauuucagauuguuaacucuguuuuucuuuaauugaugcauuugcugaccugucuacuguauccuuugcccaaaggagaugcagaaacuaccagaggccguucagcuaauugagaaggccagcaugauguaucuagaaaacggcaccccagacacagcagccauggcuuuggagcgagcuggaaagugagugugagauggacaagucucugcauagaagucuugucuuuuuguuuuaaagaggucccugaaaaacaaguuuuccauuucucauauaagacauguuuucuugucugauucaggcuuauagaaaauguugauccagagaaggcuguacaguuauaucaacagacagcuaauguguuugaaguaaguuugaaucuuauuuuuuucuuuaauuacuuagaauguuuagauuaauaauauauaggaaaauagagaagugcaguggcuacuuuuaaaacuuuucccugcucacaguugcacgcuauuucuuuucuguuagagaguagugaaaugaacuagcagcuuucguguuccccccuugauccagugccauuacuucuuuacaaaauaaauauuaggggauaaaaacauuucaacauuaaagcagccaacacuuguuuuucuuugauuccuucagaaugaagaacgcuuacgacaggcaguugaauuacuaggaaaagccuccagacuacuaguacgaggacguagguaugucuuuaaaaacuauugcuguguguuuaacuauacuuugaauccacauuuggaacuggaaaguaauuugggggauagcuuguuaauuuuuugguauaagcuguagacacaccaggccacacaauagaauauuaacauuuacuagacaguaggcacacugaauuagauauuaaaagaucugcuguuuuuugaaaguguaaugcccaaauuuaucaugcacugugcuuuuauugguugaacccuggcucagcaacaugaaagggaacaguuuccuucaucuguuacuugguuggauuauaauaucucucucaaggaaaaauaagaauauuaggauaaaugacaaagaugcauaaacacucacccaugaaaacugacagguucuugacaaauagugucauuauuagaauauuuaccuuguuaucguuucacauaugaccugaagcacaaauaguugaaccucagaaagcuaaaauccuauugggauuuccuuuuguuuuuuuacuuuaucucaguuuacuuuuaguaaacaauuuuuuucauuaauaaaauucugucucaauaauauuuaagauaaacaucucuaggagauuguaagucugcagauaucuuaauugaaauuuguccaaagcuucccaguaacagaaaacacccaagauccauuuaauaugucaaggaaucaaaauagaaaugacugaugaaucuauccuaucugagacugaauuaaauuuuuucuucaugaagacugcagauucugaaauacaauuuaaaccggucuagaguaauaugagaauaaauuaaucuagaauuaacuauuaaacaaucucauuuagauuaauuuguuuauaggaccuuccuucacugaggaguauuuuuuugucuaaauggaauagaaauuucauuuuguuuuuaaauuaggacuuuaaucaugaaggaaaguuuaauuuaaaugucaguccggggucauuaucuuuauucaucuuauuacuuacucgucgcuucccagaaaucagugaaugaaaugcuaacucugacaaaucccaacuuaaaaaugguucacuuuaguuucugaaaguguuuguuacagcagcagagcuguucuuggugauggcguuauggcuguggcaaaauagcugaacugugaggugauaccaagguucugacuugugagcaggggccccaugucuuagaaacaguguccuucauucuuuucagggcagcuaggaggcaaguuuuagcauaguuuaccuccuuucucuucuguucucaucuccugaugcuccccgacaagacucccagugccuuucuagagcgcuaagccccuuacuauaagaccccauggaaggugaaggaagugaaguugcaggaaggggcagaaguuaaggacagcccugugugaaaguccagacugcaucagcuccccugaaguauuucugcuuuccacaucuucuuuccuuuuguuucucaagguauagauuaucuaaagcuguguuguagagggaguagcaggaaaggagagaggccaggaucuuuucgggggaggucagaugaggaacguuuuccagcugccugugcauauuccuuuagaaagcuccacuagggaugggggccaccaucauccucaaaacauuaccaguguugccagucgguuuggacacaucugaugaaagccauuguuuuaaagcaauuacuguguuaaauucuucaaagccucagcagaggggagaaugcuaguugagugagcagcagaagugagaaugcugcguagaugugcucaaagggcacauuuauaaauccagggcuuuuauucgugacuuuguuuuauugguuuuuuuuuuuucuuuuuaggaaaaauguauuuuaaaaugguacuuucuacugugcucaacaaaaauguuauggaaauauauuuuugaaguguauuaacaauauaaaaauuaauuuaaauuugugcaggaacaugaaggaauuugaucuuuugaaaaguguugcuggguaucuugguaugaaaaaauuaagucuacugucaugguacuucuauugggaacuuaaauagugcaggauaagaaaaaacaugcaguguuuauagugauggagacauuauugagaugauuuaugugauaauugaaaauauuaacuaugugcuuagauuauuauuugauugcaucuguugccuaaaagaacuaaacaggugguaauuuuaugcuucacacaagcaacaucuacuaauagacuguguggcauggagucuaaaguuuuauguuuguuauauuuaguuagugcacuuauguuuuuacauuaacaugaguccauaagauguccuaauuuaauacuuucuauguuaguguagcaaagaaucuauuuaauauauuaaucucuugcuucuccuucaguuuuggagagucaaaauucagaagugauucguaguuucauuuagauuacaucugggaaaagucaguccaaggccagugcccuuguuccuuuuuagaaaaggccuuuccaggcugggugcaguggcucaugccuguaaucacaacacuuugggaggcugaggcaggcagaucaccugaggucagaaguucaagauuagccuuggccaaauggugaaacuccuucucuacuaaaaauacaaaaaguagccgggugugaugacgcacaccuauaaucccagcuacucgggaggcuggagaaucgcuugaacccaggaggcacagguugcagugagacucccaucucaaaaaaaaaaaaaaagaaaagaaaagaaaaaaagaccuuuccagcaaguugaucaugaccuugugccucugagagaaggucuaugccucugagacaagguguguggucucagugaacccaaaucccuccuagaagacucacuuagcaaagaaaagagcugcuucucaccaguugucugagacagucacuagauccuaaacacaaggaggguuggguguguauauguucaggggugggaugugugcuauuaaggagaaucacuggguuucugucuugcauaacuguucuguccauggugccaucaauaacugagauaaggaauauagaaacaaacuuaucagugaugauaauaaacuuagcugggaauaugacacauaaacuaaacauuucuguagguaguuaaaaauagguuuuggaguucaggaaauaguuggggccagaggaacaguuugaguugugguguagaaggugucuguugaaagcuuggggaugaaugagguucugugacaguuuucugccauuugcacauaacuucugugggguuucaauuuuguuacauuuggggaagauaaaaacaauuuauucuuuuuucagcaaaaccaaauucuugucauuuuguuaggaauauuaaguauuaccugauggaaaaguugaaagcaucuguguuucauuauaauaaguaacuaauacuuuucuggauacauuuaaaaauagauggcuuuguaugcuaauuucauggccuuuuagcaaagucgaucaacuuuuucgacuacaaacucauguaagggcuuggcucuuuuguuagguaacuauauauuagcacauagaaaugcuaauauuaugucaaggaaauaaacaguuuaugcguaaagaaugcacccuuuauaguuaaauauaugaaaaguuuaaaauacugagauugcuaauagaaugauauaaucuagacacgacgggcacagaauauucugaccauaauuuauuuuauaaaacaggaucuguuauaagcucagggucacaauuauaaaugauacagauacauguagcuguaguccgccuugcauuaauuuuuuauuucugcauagcagauugcuacaaacuuagcagcuuaaaacaguacucacugauuagcucacaguuucaugaggccagaagucuggauacaguguagcuagguccuaguguagcuagguagcagagcuagggucucaccaggccgaaaugaaggugucggagggggcugaucucaccggaggcuuggguccuuuuccaagcucauugauuguuggcagaauugauuuccuugcagcuguguggaagagauuccuguuuucuuguugccuguucgccaggaacugcucucagcuuugaguuugccuucaguuccuggccgugugcccccauuggugguucacagcauggcaguuugcugcuaauucgagacaucaggaguacucuggccucuaacuuaaggaagggcccaccugauuaagucaggcccacacagacagugauucacucgaagucagcugauuuguguccuaaucacaggauggcccaucauauuccgagggucacaccuacacuuaaagggggauuauagaggaaauguuuacaaggggcaagaaucgggagcacucuuagaauucugcuaccaaacccagcuuauaaauugacuuuguuccaaaaauuuaucaaguugaccuguggaaauucagaaugcauuucuccuaugagugucauuuuauaaggcacuaaguugccagcgugcaucccauaaagauucaguuuaacucaugauguaaguagccauaauagcauaagccaagccacuguguguguggugugugugugugucuguguauacaugccacuauuuuuaaaaagauaacauacaggcugggugcgguggcucacgucuauaaucccagcacuuuggggggcugaggcagguggauccccugaggucaggaguucgagaccagccuggccaacauagcgaaaccccaucucuauuaaaaauacagaaauuagcugggcgugguggugggcgccuguaaucccagcuacucgggaggcugaggcaagagaaucacuugaacccgggaggcagagguugcggugagccgagaugucgccacugcacuccagccugggcaacagagugagacuccgucucaaaaaaaaauaaaaagacagaaaaauagagcauauagcauaacaagcauaacauuuuuguauuuuuacuuugguuuacaauaccacuuaccucccuuugaaucccgauaguacagacucuugccccuuuuggcuguugguuguguguauucccaaugcccagacccugguaguuucucccauaaccguggacuguuauugggaugagagcaguggcuaaagacuguacauuucacucagucucaaguuguacuacugagggaguccuggcauuuggaguauacuacagcuuugcagggaggggagguucaauuaggguuugauggaauuagggcugggggaaugagaaagggguaagggccuggaggguuugggggaaauguuuuggugaccccuuuccuugcuuucgucuucauucugccauugggcaaaauggaagaaaaggagaauguaugagggucaauggaaaagaugaauguugaagacugaagaugcaggaaggcuuuuguuuaggucucuaacuugccuccccucugcugcccuuuuaggcaccucagagcuugcuagggccacuggggcagcagcggaguaugugauggagggacacagucgggggaaggcaccgagugccuugggugucuggauguucuuucagucgggaggaaagaaaucuugggugauuuaaucgaagaucgucucaaguacguaucacgaagaagucgugacacucgcuauuggacaguccuuacuaagcuuaaaacuccccguuugaccuaacccauccuugaguucuuuugcuuuuucugucagcgugcagccugaaaguggggagucagacauuugaaagguaagccagaugagcagagcauguggaaaccuggguccuggggcagcugcuaauaauaccuguccuccuggugucucuacaaucuaugaugucaaguacauuucacaggggaccucugcuauagaucauuuagaccugcuuuuuuuacauuucuguguuuuguuuuagguuugaugaggcggcacucucuauucagaaagaaaaaaauauuuauaaggaaauugagaauuauccaacuuguuauaagguauucuuugaaaguguuuguuuuugguauuacauuagaugauuuuuuauacugguaugaauaaguacuuaagaaaggauucuauggguauuucuauguuuuuguaaaauaauacuucaugggccucuauuuuugaccaagauagaguaagcccacuacagcuuguuucucugcugauuacagcuaaacuacuggauaaaauacaaaagcaaccacccuugaacucugaaaaguaaauaaaaagagacuaaggagaggagcaaacacguggagaaacaaccaccaugggaaugaguuucucggguuuuuuuccauuuccucuugcagcauucauugcccugcccugagagaagcccacaguuguggagcugggcagcaaaggcugcaacaaugaaaacuccaaaagaaaccccgccuuucuaaccagcaaugggagaagaggucccauuguuuuccucuccuuuggcuuugcuccaagcuugucccaggcauggagcuacacugugaugauggcucagguugauaaaacuccacaaggaccccagucucuuuugccagaggaacuaggaaaaugagcuagagagcaaggagaaaauuccggaaaggagagagcuggaaacggaguccccugaguguggauguggcccacacaagucuuggguuuacucuucagcugugcugagacaggccucaaaguagcagugcagcgcaaagcuuggagagcuaagauuucaucacugucgaaguguugcacugcccucugaagggcuuaugcauggaacaggcccaaagccacauagcaaaggauuugaauuaaguguagaacuuccauccaccaaaaacaaggcaccacauguagucugaaccuaacuggggugauuaccugcugaaaacaucuguacucuccugaaaauuaagcagaggcugugcagcaucacauucacaguacaauccagaauuacucaacaugcaagaaccuggaaauaugaccaguuuucaggagaaaagacaacugauggcaacccggcagugaccaggguuguuggcauuaucacauaaagacugaagcaacuauaaguugcuccaugagguaaagauaaacacaauuaaaaugaauagaaaagaggaccuguuguuuuuuauaggaaaaauuauuuuuauagaaacuauaaaaaugaacuaauugggaauuuuaggacuggcaaauacauuauugaaguaaaauaauuggauaagcuuaaucucagagaugacagaaggaagacuuugugaacuuaaagauagaucaguaaaaguuaccuaaacaauagagacaccaaaagauggaaaaauacuucaugaagaccuauuuuuccaguaauuuaucagucauauccuugaucuuauuacuacuuuuauuguugacuuaucaauacuaucauuguuucuguuaucugaaguuuucacucauacaucuuuuuccuaguuucuuuuuaaggauucuaaguaucauugugguguuacgggucccccccacuucuuuuuuauucacuuuucaagauugaaucuguguagauauuugaaagagaucucuuuaaaacgugguugugaucuaaggcuugugucaaagugcgguccccagaccagcagcaggagugcccccuggaauuuguuagaaaugggugaaucccaggcuugccccuagcagccaaauuccaggacaugagaauuggaaaaguacuguucuaggauauuuccccucaggugucccguggaaguuacuauagcauuuauaaaucucuguuuauacaaacaaagacucugaaaguuaaacuccagguguuuucaauacugccagguuauugacuuuauuaaacagauguaaauuugaccaugauccucucuuuuguuuuagaaaacaauugcucaagucuuaguucaucuacacagaaaugacuauguagcugcagaaagauguguccgggagagcuauagguaagacguugucugggcccucuugacuugcaguggcgacaccucugugucuacaacuaagauugcugcuaggacacauguuccuggccaugaaacugucauuucuaaaucuuaggagugcucaucuaccauuucaucuuuuacaguggguguuuuacaccuuuuuuuuuuuucccuuuccuguauuuuucucuaggggaccuccauggaagugaaugacuuuagucauuuuagucauuuuauuugccuucuaagaaaaaaagaacaagaaaaagggggaaaaaauuaucagauuuauguuacagaaaucaaaaugaggaauuuucucgguguuuaacaugagcagucuuaaucucaacacuguuaacauuugggcuggauaauucuuuguggucgggccuguccugugcacuguaggcugguuagcgggauccccggucucugcccucuagaugccacuagcauucccacacuuuuaaguaccaaaaugucuccagacagugucacaugccaggggcagaaucaucccugccugagauguguucuuuuaaggagaaggugaagacgugugauuugugcuuacugcagcaucccuggguucaauggcagugaagacugugcugcccuggaacagcuucuugaagguuaugaccagcaagaccaagaucaggugucagaugucugcaacucaccgcuuuucaaguacauggacaaugauguaaguggacccauuugcauagcuuucaucuuuucucuugaaagaaagagguuucuagugagauuauuuuuuacccauguacuuaagagauuuuuuccuaccucuuuuuuucuucucaagcuacuacucauaaggaaacugaccacuugcauugaauuucaccauagauuuagauaaaauagauguuaguugugugguguauagccauuuacucacccaucuaacucuguugaccauauacauauuuuaaaauugaggcucauuucuccacuuuuccucuaucuguuguccucuguagguugcuuuuauucauuucuuuuagacggacucucugaaagagguccauucuguaguggccuuuguaauucaguagaccuaugaaaaucugugaggacuagcuguguguugcaggucauuaauuaucucuaagccucaguuaauucauuuguaaaaaugaagccacuaguaccugucuugcuggacuguugugaagaauacauuagucagugugugagaaauauccucacaugaugucuugcacauaaagugaaccaugacuauaaguuuuuauuuuuucucauuugucuuuuucaguagauuuguaaguaccuguuuggccuuaggccuuuagaguaucaucauaguaucagaucaacuuaaggccuucaguuguuuauuauaaugauauauguagauaauuuuuuuucuaaauaacgucuuacauagguuuugaaaauauauauauuucuaaaguuuuaauuaaaaaaaauuuauaauugaaacuuuuacuaguuguguaccugucccaccauggucaugaggcaucuggggagcagcauuguugggcuuuguuuuuccaucugaaugguagaauugguguuccugaggguggggagccaggcugugucuuuuuagagcugaguaaaacauguuaggauucuaguuauccagcuuuuaagaacauguucuguuguugacaguaugcuaagcugggccugaguuuggugguuccaggagggggaaucaagaagaaaucaccugcaacaccacaggccaagccugauggugucacugccacggcugcugaugaagaggaagaugaauacucaggaggacuaugcuaguauuuugcuugcugaaaagaaaagggaaacaaagguaaaauccugacaugccauuucaaggacuugggaauagauuagggauauccguacuucauuacagucaugauuuuggauccuaauaaagacuaguuuuuaguuaccaucuucccaaaucacucauuguauccauuaccugugaagcauaucuuuuucuuuccauaagagcuuuucuaagacaccagcaggaauuaacagaaaauguacugucauguuuuaauacauugauuaaaaaauuugcaagccaaauuauacauaaauuauguucuaaacaaaagggguaauaagcauagguauucucucuuggacacuuguaaguuacuguuagugaauuguuuuuuacguuucauuuaauaauugcugcuaaaggugauguuuacugauaaaucauuuuaaaauuuuuuuguuuugaaaaguaaauuuaucccccaugauguuagauacauuuaaauuauuaagucuuuucagagaugagauggggacaggaaguuauuuugagccuuacaauauuauuuagcccaauaaaagaugcauugaagcucuuauauauuaugaguuugaaaaauuuugaagguagcauauugaagugaucuauaaauaucuucaguccucucugaaguguggguauuucuucuaucuaaaaaauacauacagugacugucuucaaaucuacuugguucuugaccaaauaggagcuaauggguaaugaauaccuuuuuguuuguuuguuuguuuguuuuguuuuuuguuuuuuuuuuuaagggucucacucuuuugcccaggcuggagugcaguggcacaaucacggcucccaggcuaauguuuuuauuuuuaauuuguaauuuuuuuuuuauuuuuuuuguugagauggaguugcuccauguugcacaggcuguucucaaacuccuaagcucaagccaucugccugccuuggccucccaaagugcugggauuguagacauaagccaccucacccagccuaugaauaucuuucuaacauuguaagaaugagguaauguuuccaucagucuaauacagauauauuucuucccuccaaaacaguuuauuuugauuguuuauuuuauuuugauuguaacuccgucauaacuugacauggaaaaugcuauauacuaugaaaacuuagcugaaagggaagaauuguuuuagaaagacaauauuuaaaacaccgcacugccaauauauugauccuuuauaguuauuuccuaaaaugcuguuuucgaaacauuccuuuuucacccuguuguguggcuuagacccaucucguaaucuguuaauuggaaagaggcuacagacaccagcagugugcguucugcagguacacgcugccaaaguaauuccugcucauccaugcccugucucugucucuuuuagagucauaccuuauuugaguauagguugcuuaauuuugcuagacuuccugaaaacacuaagguggaguaucagaagugauuuuagucacaguucugcgggagagcuuagaauaacauccuccuuugggagguggucucgggugcguggauguugguauacagucuuuauuguaagucugauacaaaaugcuaauaaauuuaauguuuuucuuccuuaauuuauuggcauaguucuucagguagcaccucauuuuuauuaaugauauugggauuaacuaugaacaagcuauauguagacauuugcauuuaaggacauugcaguguuucaaagaucccaucauugcagcuuguauccuuuagauccaaucggaaacuucuggagucuuacauuaaugcucauuugagcuaauuaguaaucuguuuaaacagauuuggcaauacuuuaaagauacuguagacuauuuauguauagauagaucauauuacccauuaaagucugggggaaaaaauuuuuuaauuuuacucuucuuauguacugaaaacuuuuuuuaaaaaaggugaugaugaagugcauucuguagcagcagcgcagcuaugcuuuaaaccacacaaaaggcuguguccaggugcagccuccuucacccuuccugcccacggugaggauugaauaaccaggacuuggggauauuguuuguugucaggguuauucugugugguaaggaauauuuguuucacauuuauacauuuucuuuuuccacucacguaaguuucuaucuugagagcauaguccaaagugcaaaacuugguguuuacaaggaaaauugucuuccagaacuccacugucaucacuuucaccaaaguggaaguuugcaugaauaugcucagaaucuaauauucaauguucuguuacauuguaagugaaguccagcuacaaaauagauuuaauauauugaauuuauuuguacauaugcagaguacgguauuucuguauggaaucugcuuuauuccuauuuuucccaacucugaugaguagaauauuaaauguguuguuauggaaauacagauuauugcuucuauaggaagauaauuaugaaaauaaaaccugaaacuauauaaauauaauugu

SEQ ID NO: 18576 - RNA, 487 nt, Homo sapiens
cucuucugaggauccggcaagauggcagaaguagagcagaagaagaagcggaccuuccgcaaguucaccuaccgcggcguggaccuggaccagcugcuggacauguccuacgagcagcuggagcagccgaugcagcuguacagugcgcgccagcggcggcggcugaaccggggccugcggcggaagcagcacucccugcugaagcgccugcgcaaggccaagaaggaggcgccgcccauggagaagcaggaaguggugaagacgcaccugcgggacaugaucauccuacccgagauggugggcagcauggugggcgucuacaacggcaagaccuucaaccagguggagaucaagcccgagaugaucggccacuaccugggcgaguucuccaucaccuacaagcccguaaagcacggccggcccggcaucggggccacccacuccucccgcuucaucccucucaaguaauggcucagcuaauaaaggc

SEQ ID NO: 18577 - RNA, 21196 nt, Homo sapiens
gaguuuuuacggguguucauuuauugacugcugggaauacagccuauugagaauacaugacaugcauuugguggagaaaucaacuaaaucugaaaugaagccauucaguaagccugcugugaguuaauaagguagcacagauuagaucuaaggacauggugggggcaacucaaacagccacucacaauuguuauuaagauuccagcuacaauuucuuuuggaacuuauuuauucuuaauuacuuaggaauuaccaggaaagagggaaaaucaaucugccucuuuaccuuaaauuaaugcuaagagggauacugugaaucacuaaaaaacucuccccaaaauuauguucuuacuucaaauccuuuaaggcaauucuauuuuuacaaauucuucaauuucuaugccucaggauuauuagcagcuaagcagaguuagaaaagauuaauaacugauacaaaaggcuauucauuugauucuaguguuuacugcugaauuauacuguguucuaauaugagcagauuuuuauacgauauugccaauuucuucccccaagauuuuuguuuuaauucauugaugcaauaaaauaaaucaaagaauucaagguacacuuaaaaggacagaaagauaaguuacuggaguaucuuacaccauaaucuaaaauuguugaauuauacauacauauaacuugaauaaaaugaauaacuuggauaaagugaguaaaaugcugaaauguaucccuaacuacaguuucaugccagguauuuuccccgaacuuuguuucccgaacuuaagaaaaaaauggauauuuuuucuuaagaugacaaccuuaauaucacuugauguucaggugauuugagauaguuuuuaugguaguagaaagaaaaacagaaagagaaaccccaaugaaacaaaaaaaggaagauucuggcuuuuuguuuucuuuuuuaaagagccuguuccuuucauaaucuuuccuccacgcuucuggagaaaaugguuauggcgugcaacgcuggacaaaucgaggguauaagcacacgucucggaugugauaccuauucagaauccacguuaagaaucguuccaagcccaagccauauccuccauggggacauguaccguauuuucucuguuuaaaaaaagaaagaaagaaagaggaguaaauacuuaaguuaaaacuuucaucuaagacaguuaaaauuuuccaccaugaaaggaguuagcucacugugguuaagaauucaacuauggccagauucaguggcucgugccuguaaucccagcacuuaaucucuaugccuucaugaaccaugcauaaagaaauaauuugguaugaaaaaaucaaccagggaauaaguacuacccuggaaagaagagauuuuuaaaaacuuuuaaaauaagucaaugucuauuuauaagaggaaaaugaagaaggguacuagauacugguaggaucaauuuuuuaaaacucaguugcaaucaacaagccggccguuaaacagguuuucaaaugaaauuaacauauaacuuggccaaaacaaagcuggcaauauucacacaccacauuauaaccugcaaacugaauauagcucauucaaauaccaaaguacuacccugaauucuccccuuuuaaaaauuucaauauauacagaacgauuacaguggaaaaaaauguugaguacuuaaaaaauugguuuuaccugauccguauaccaguaauagggaguggggucaaucccuucccuuuuauaaccugccaguauuucuucacuaucaaagauacgcauugagccucccacaaucucaccaacauugggcaucaacacgucgaccuuuaaauauaagugaaagaagauacacaauuacuaucaagcgaucagacacagcacugcccuagaguuuaaaugaaaauuacaauuaagcuccaagggcuaaaggagccacuaugaucauguaauauucaaauguuuacauuucucuaauuuaacaaagcaugucaacuucaaucaggggagggugaaaaaacccaacgucuuuaaauauuguuauucuagauagagaaugaaauauuuggcaugagcuguaccugauuccagaugacaguccccacccccuuaaaaagcaaaauuauuaauacucuuugaaacagaaacugacagauucaguaagacgggaauccucaggacaucgcugcauguagaaggacuugaucuccacaggaaaucgacacagcaagauugguucauuaauggugucugucaucagucucucaggagcuucugggauauccugaggucaaacaagacuucauuaacauuuacaacuuggaucgcaacaagacagaagcagcuccuucacccuguaccaguccuuccuccuaucaauucaacagaguagaggauacacaccuacccuuaacccauacacauuuguguaaagaauaauuucuuucaaaaagaaauaaacauauucuuaaaacucaguuauuuaaugaagcauaaaagaucugucucccuuuacagcauaucucaagcaccaugcuguuugaugaaggaaaauaaaaaaaaaaacaaaaacaaaagccagccccaagcugugacuagacacagcucaguauuuuucucaguggcccguuuugucuagcucugaagcaaaugagguccacuuagucccguaaggcauacgguaaucaugaaugcuccagaacaucauugaucuacacacagaguauauuacuaaugacacuuaucuuuaaacucuccuguuaucuacccuucuuuccuguuguaaucaaucaguuaugccuucgaugacagacacaaucauaagacaaauaaccaaugucaaacugguaaguguaagcacaccuggaauaguuacccaaacaauguuagaugaugacuuaagcgcaucaguuucucucucaaaacauccuucuauaccacacauaaauuaaaguuaacacagaaguuaaaacugacaacucucgucccaguaaaaauggauugagagaacuggagaagacucauagauuuguuuaaugaagaagugaaauggagguagcaaucaccuagcacaccuguuuucaagcuccaggcucuggagcccuugcguccucggagacgccgagagguaacaggagaugagugggagagcucuagucucucagcuugcaucugcuuuacacagcgggguucugcauaagauuuaguuaggggaaaacaggucuuauuucauaccccccaaagccugagggucauguauccacucuaguguccucauguguguggaacaguagcaauguauaguaaaugcugacaggcucccccugccauuguccugccuaggcauuuagcuccgguaguccccacaaucuugcaaaacagauguuacuuccaagguagagauaaggaaccugagagggggucacuggucuucaguuacacagcacaaaagaaaagaggugggagcuaagcccaccuggggggccuucugacuccacagcuuguguucuuuccacucaacuacacuauuuuacuaaguauuaggaacacuaaaaguaugcaaguucucaauacaaaauuuugucauuauacaucauaaacugaauucauaggcugggcacaguguggcucaugccuauaaucucaacacucgggaggccgaggugagaggacugcucgaggccaggaguuugagaccagcccagucaacacagcaauaccuccaucucuuuaaaaaaaaaaaaccaaaaaaccaaacugaauucacagaaacaagagugcuuuacauagacccaguauauuguuucaccuauuaauuccuucuaaaacccaaaacuaguuagcagcaucuacacacauuucaacuguaaaacaauuagaugugcaaauauuauguaaguaaugguuaaaugcacaggaaagagggccuagcauagucuuggaaacuugagccagaugcaguggcucacgccuguaaucccaauacuuuggaaagcuggggugggaggacugcuugagccaaggaguuugagaccagcccgggcaacauagggagacgccaucucuacaaauaauaaaaaauuagcugggcaugguggcucacaccuguaaucccagcacuuuuggaggcugauguaggaggaacacuugaacucuggaguucaagguuguagccagcuaugaucgcaccaaugcauuccagccuggacgacagauggagaugcugucccaaauaaagaaaauuugcaacccaagugcaugcugggagagugguucucaggcaaaaccgaaaugcuaaguuuaccuggggcacuaggcuaccuucuccaagaccuucucucuugguuuugcauuuuuaaccaauggcuaucuucuuucucgccuuccacauuaagaaguuuuaaaucacuguuuugggggaggggaugaaccucuuuuuaaaagcacaagauacauucuccagaaaaaaaaaaaaaauauauauauauauauauaucuauauaccaacauuuugcaugugauuucaaaggcuucacaaccuucuaaagcacuccuaccagccuagagaaugauaaagagagcuuauaagcuguggccaaggaagaacaaugaaggaagagggaagaggcaaagcaugagacaugaaggcagcuuagaaacucacacuuggccagaagcgguggcucacgccuauaaucccagcacuuugggaggcugaggugggcagaucacgaggucaagagaucgagaccauccuggccaacauggugaaacccugucucuacuaaaaauaaaaaaauuagcugggcaugguggugugcgccuguagucccagcuacucgggaggcugaggcaggagaaucgcuugaauccaggaggcggagguugcagugagccgagaucugagaucaugccacugcacuccguaggcgacagagcgagacuccgucucaaaaaaaaaaaaaaaaaagaaaaaaaaagaaacucacuuacgcuuacugggugguacagaacaggcacuguccuaaggcugacucuguuaacucagcgaaucugcaggcaacccaagaagcagguccugcuguuaccauuuauuugaggacaggcagaugccacccauguuacuaguucauuaaccagaagaagagaauuggagcccaaucccaccuuggaaacaaugagagaaagggauacauacuucuccaaauucauagaaaguuccaucuucuuucuuuacaucauguucuuuuagccaaacgauagcaucugaauaguucauccguuugaaaggccguuuggggggcugaaaguucuacagaagaaaggaaaaauauaauguguauauauacauaaauauaaacauuaacacuaaaauuuccauuaaaaaacuauuauaaaguauuacuucagugaggugugguggcucaugccuguaaucccagcauuuugggaggcugaggugggcagaucacuugaggucaggaguuugggaccagccuggccaacacgguaaaaccccaucucuacuaaaaauacaacaauuagcugggggugguggugggcuccuguagucccagcuacucaggaggcugaggcagaaucgcuugaagcugggaggcagagguugcagugagcagagaucgcgccacuguacuucagccuggcgacagagugagacucugucucaaaaaaaaaauauauauauauauauauauauauauaacuucagacuagaaaacuauguagacauuccuaaaauggaaaacaugagccuguuauauaacugaaaacauuauaaaauuauugacagugacuaacaucaaauucuagucuucaaaauaauuagucacuuauuucagcucaccaagccaucaaaucuacaaaaacugagggugaagacuucauugucuuccaaaaaaggacugugacuuuuucuuuccauaaacacugcaccuaccggguugagcucaugcacuaugcucccugcaggugacuucaauauucgaucuaccacaucacaaaccaaguccuccaaccgguucaggaggucgucaaaagucaggaaaggacacucagcuuccacgugaguguaccugaagaacgagacaauagcucagcacugcuuuucuccugcacugguuuuuuauccagcaaggcuuuuaacauugggaagcuguccauaaaaugccaacaaugcuaccaauucccaacuuugcaaauuagcuguggacuccccucuucuccacugaguagcaauuucuuguuugcuccuuuauauauaaaagaucaagucaaagugaaaaaagagaacuuagcuacgaucuaagguggcaaaacuuuguuauauguucuuccauuaaccacuuaauauaucaguugguuuuuuuuaaaacauaaacauaauuuaccuacacuaagauuucuucucuaaagauauuaccuagaaagaaauaaaacaaaaagacaacuucauacucagccaggugccuucguguucuggacugcucugcccgguaugacugagcaauacaaaaaacaucucccagggcugggaggcaggucuccaaguacaacugagaggauugagucaaaaaugccucuuccccaaaauagucaagcuugaagaguguggcaccaccuucuacuuguguuugcacuaauguuggaggaguaaccuguucaaaugcaaagaaggaauaaaucaaugcuaucgugagcaccacuauucaaguuucaaaacggcaaaaaacauauucuuugcaaaagcugacgaaugcauacuuacuucauaguacccccuaucaaagaagugaucucuaaagcaccuggugaccauggaucgugcuuuuaggauuuuggacauguuuucuccucggaucaucaugugucuguuguugagcuggacaucaacgucagacuccucauugaucagguugucagcuccuccagcaggggccaacccaauuaguucccagaagucacaacucagcucauggccaccuggagccugcauuuuuuaaaagugggguccagagaaagagggaaaaggaaauaaaaaauuaacaguauugaggauuuuaauuuaugucaaaguuuugguaagcugagauuuuuaagaaccuccuaauucucagcuuuaguuuaguuuuauauugauauuuuuaccaauguucuuucuggauaaauacacacucacauacacacaaauaucuuuuuuuuuuuuuuuugagacggagucucacucugucgcccaggcuggagugcagugacgcaaucuuggcucacagcaaccuccgccuccuggguucaagcgauucuccuaccucagccucccgagcagcugggauuacaggcgcccaccaccacgucuggcuaauuuuuguauauuuaguagagacgggguuucaccauguuggcaaaacuggucucgaucuccugaccucgugauccgcccgccucggccucccaaagugcugggauuacaggcaugagccaccaugcgcagccugugcguuuccauuuuuaaaagauauuugugucugggcacgguggcucacugaggcggguggauaacgaggucaggaaaucaagaccauccuggccaacaaggugaaaccccaucucuacuaaaaauacaaaauauuagccaggcaugguggcgcacgccuauagucccagcuacucaggagaaucgcuugaaccugggaggcagagguuguggugaguggagaucgcaccacugcauuccagccugcgcaacaagagcgaaacuccgucucaaaaaaaaaaaaaaaaaaaaacaauaaaaacaggcucaaauucuaauaagaaauucucugaacauauuuagguggguuguuaaguuuuuauuuccaucuggcugaaaaguaauucauauaucuacagcacaguggcuauauuauagcccaugaggaugauucaggaauuccguaaggcuggaaaucauuguauucuuuuuaucaccugaguuguacaauguacauauuucacuggaaaaggcauagugaauuugacauguacuucacauuuauuguauuuauaugcugugaugguuaauauuaagagucaaccugauuggaaugaaggauacaaaguauuuucuggguguaucuggguguugccagagaagauuaacauuuaagucaguggucugggagaggcagacccacccucaaugugggugggcaccacccaaucagcuaccagccuggcuagaaaaagcaagaggaagaagguggaagagcagacuugcuaggucuuccagccuucaucuuccuccggugcuggaugcuuccugucauugaacaucagacuccaaguuccucagcuuuuggacucuuggacuuacaccaguucuuugacaggggcuccugggccuuuggccacagacugaaggcugcccugucggcuucccuacuuuugaggcuuuugaacuuggacucagccacuacuggcuuccuugcuccacagcuugcagauggccuaucgugggacuucaucuugugaucuugugagccaauucuccuuaaaaacucccuuucacauauacaucuauccuacuaguucugucccucugaagaacccuaauacauaugccaaauguacaaacaaagacacuggaaaacaaaccaauaaauaaacuauucauucacccagugcgaaacucaauccacucaccugcuugcccuuugggguaagauuuagcauuccauacacugcaacacugcucuccguggacaagagaacuccauuguagcacugacacuauaaaaaggucaaagcucaaauuuaguuauucacauugauuuaaaaauucuaccauauagaaaguuaaagggauuguuuacaaacaaguuaucugaucaaauacuaguaaaauaaagagugagauggccacugauucuuaauauuaaaauagauauuuuuguggaagacagagguuuaucuauauauagacauauacauguaaauauauacauauacauguaaauacacauuuuacauacauggauaaaugacacugacccacaucacuuaaaaauaucuggacaguuuauuuauuuauuuuuaaaaaucuagacuauuaaaguaacauacagguuaggcacagugguucaugccuguaaucccaugaaggaggcuaaguugagaggcucacuggagcccaggaguucaagaccagccuggacaacaaagggagagauaaauaaaauaaaaauuggcuggguguggugguucuugccuauaguccuaacuacucgggaggcugaggugggagaauugcuugggccugggaagucgaggcugcaaugagcuaugaugaugccacuguacucuuucugagaaacccugugucucaaaacaacaaacaaacaaacaaaaccauacagagcccaucuacacuauaaucacuucuuacuaaagucauuaggaaaaaacugauggggaacuuuaaaaggaagaagucaggcugccaacaccugaacccacuagucauaaaaaagacaacuggccgggcacggcggcucacaccuguaaucccagcacuuucggaggccgaggcggguggaucaccugaggucaggaguucaagaccagccuggccaacauggcaaaaaccugucucuacuaaaaauacaaaaguuagcuggguaugguggcaugcaccuguagucccagcuacucgggaggcugaagcaagagaaucacuugaaucugggaggcagagguugcacuaagcugagaucacgccacugcacuccagcaugggugacagagcgagacucugucucaaauaaaaaaaagaaaaagacaaccacaccuuacaugccucuugacgugaugcaacuaaaagaacacagcuuugcccaugaaguaguugugccaaaaaacugaaccuaaucagaccuaaccuccaauuuauaaaaaaugcagacacuagaagaacaugcuaaaggacaccacaaggaugcaaacaaccaaauccauaaugugagaaguuccacaggacaauccaccaggguuuucccaagaaauacauaguaauggguggggagagggggcggguugcaaaagaagagagaaugcaaagagagcagcagaguuauaaagaaaauuucaaagucauaucacuaaacgcagcauguuagucuugucagaauccucguucaaaucaaucaacuauaaaaaggcaguacgaacugauaacaagaaucuggauauuagaugauauuuaguaguuguauuaauuugguggagggugugauaauaguaggugacuauuaucuuuuuuuuuuuuuuuuuuugagacaagguuucacucuguugcccaggcuggaaggugguggcaucaucuuggcucacugcaaccucugccucccuggcucaagagauccucccaccucagccuccugaguagcugagacuacagauaugcaccaccacaccuggcuaguuuuuguauuuuuuguagagauaggauuucaccauguugccaggcuggucucaaacuccugggcucaagcagucugcccacuucagccucccaaagugccgagauuacaggcaugagccaccaugcccagccacauuauuuuucuuagagaugcauaagcauguguaauuaaauaaaaugauaugaugucugaggggcaguaucauaccaggauuagccauauauaggugguuacagaagcugggugaugggcauuugaugauuuuuuauaugguucuauuuuguaaugugcuggaaauuuuccacaaaaguuuucucccucuagccuuauuaagguauaauaaacaaauaaaaauugcauguuuaugguauacaaugugauguuuugauucauugacauucacugucgacauaauaaauguuuuaaauaaauguauacaaaacaauaaaggaaucuacugaaaacaucuaauuuucaggcauaaauaagagaaaauauuuaccaacucauccgccaagacacacugaagauaaccuguaccaucucgcaacaccagaaacauuaaauucuuuccuaaaaaaugagaaauaauaauuuaggcagacuguucucaaggcauuaaauuuuauauauauauauaauuuuaaagauagggucucacuucgucacccaggcuagagugcaguggcacaaucacagcucgcugcagccucuaccuccugggcucaagcaaaccucucaccuuacccucccagauagcugggacuacaggcacaugccaccacaccuggcuaauuauuuuguagugacaagggucucacugaguugcccagacuggucucaagcuccugggcucaagcaauccuccuaccucagccucccaaagcgcugauauuacaggugugagccacugcacccagccaugacuuaaucuuaucuaaaggaaacuccaagguuaaacauucaaguucagaccucccacauggcucccugccccugaaguacccacugguaauaccacuacucaguauuuguaaaauauuuuauuuucaauguauuggacuuucaaauccuacaugauccccaagauccacacaaccaggggaaagcaggacagaaggcaacaugaguuaagggauuaugccuuaucuacccuugaguccccugcaaugccugggguaguacugugcacucggugauacauaaauguucuugaacaaaaucacuuuuucuuauuuauguccuaaagguccaauuacugaaauccgcuuaaaacauuucauuuguauuuuuguccccuccaccgucgcuuuuuuuucagauggaguuucacuuuugucgcccaggcuagagugcaauggcaugaucucggcucacugcaaccucugccucccagguucaagugcuucuccugccucagccucuagaguagcugggauuacaggugcucacaaccacacccagcuaauuuuuguauuuuuauuagagaagagguuucaccauguuggccaggcuggucuugaacuccugaccucaggcgauccacccgccuuggccucccgaaguacugggauuauaggcgugagccaccgcaccuggccugucccacuuuucaaugaaagauuugcuaaucccuuacaauaaauaguaaaagugacauguuuauauauuauaaaauauauaauaaaaggggaaagaggaaacaaaaugucagaaccaagggagaaugcaaauauacuguuuauaagagucaaaacuauggccaaguuucagacucagaugucaaccuccuauaguaacaucccuugauuuucacuaaauaauuaaaacucaacuugacaaauauuuacuggacgcaucuucaucacuauaauugcuaaccauuaaaagagcauuuaaaaauuuuuauacuuucaauagucauuuuaaacaagaacaaauuuaagauauaaaucacucuauccuuuaaagccaggugaggugcuaugugccuguaaucccagcugcucaggaggcugaggcaggaggauggcuggggggaguucaagucuagccagcauaccaaaaaaaaaaagagggccgggcgcagcggcucauaccuguaaucccagcacuuugggaggccaagacaguggaucaccugaggccaggaguuccagagcagacgggccaacauggugaaacaccgucucuacuaaaauuacaaaaaucagccaggugugguggcagguaccugugauaacagcuacucaggaggcugaggcaggagaauugcuugaaccugagaggcggagguugcagugagccgagauagcaccacugcacuccagccugggcaacaaagugagacugugucuaagaaaaaaagggggagagaaaaaaaccccugcaaaucuuuguauguuuuucuucaucuaagagcagggauauuuaaacauuaaaaagaaggaaaagcuuugccauuuaccuugccugcgcagccuguggacccagccaaacaccuuuacucuuuggccucuauauccuucuaacgcaccaaucuucaccugucaaauugaaauaaacaacauuuguucaauaaugucauuuauacacaccaacuuuuucacuaauauuaggcagacgguaguaaguguuaaaaaucacaaauggugcaaaacuggagacagccccucuacugcagcucagaaccaaacgcauuucacuguauuggcaugguuuaaaacaaaacaaaaaaaaauccaagucuucuuucuuaauguaaaacugauaaugagaaacacccagaagaauuucagauauugcuagauaaaauuaauuaauaaaugaauuccuuugucauaaguggagcacuugcuucccacaacagcaacaaucccaguccacaugaagccuuuuccaugaccccacaguucuucaauaccuuccagaacaugguacuuaaaaggcuagcuuuuguuugggggaugaaggagagaggagaugaguagaggaaggggcuguugcauguggccaaaaaaccccagcuccaucacuaaggaaauaauacaaaaauucaucagcaauaagaacuacuggaaaucuggcugggcgugguggcucaagccuguaaucccagcacuuugggaggcuaaggagggcagaucaccugaggucaggaguuugagacuagucuggccaacacggugaaaccccaucucuacuaaaaauacaaaaauuagccaggcgugguggcaggcaccuguaaucccagcuacuugggagucugaggcaggaggaucacuugaacccgggaggcggagguugcaaugagcugagaucuccccacugcacuccagccugggugacaagagugaaacucugucucauaaauaaauaaauaauaaaauaaaauaagaacuacuggaaaucaaaccauuuucauucauaguccagcaaucuauuuggguuccagaaagaacagaagaagagugaaucuaauuucacaauucacaaacuuuuacucuauuuaaauaaaacaugaaaaucauagauuucaaccucuucauuuuauaagcaaacugacacuagagaggguuaaaucacuugaccaacaucaugaagcguagccaggccugggucccccaucugcuggcauucaguugggacagaauucauucaacaugcauuuacuuaacuguguaauaaaaugaaccccuaaagaacuagccucauaacucuaaaacauuauuucucuaugucccuucugaaaggaaaguaggccaggcaugguggcucacgccuguauucccagcacuuugggaggcugaggugggaggaucccuugagcccaggaguuugaaaccagcccgggcaauaugggagacuguuucuacaaaaauuaaaaauaaauaaaaguuagccaggugugguggugcaugccugugguccccccuacuugggaggaucguuagagcccaggaggcagagguugcagugagcagaaacugcaccacugcacuccagccugagcaacagagcaagacccugucucaaaauaaauaaauuaaaauuuaaaauuaagaaauaaaaaauaaaaggaaaguaggccgggcgcaguggcucacgccuguaaucccagcacuuugggaggucgaggugggcagaucacgagaucgggagaucaagaccauccuggcuaacacggugaaaccccgucucuaccaaaaauacaaaacauuagccgggcgugguggcgggcgccuguagucccagcuacucgggaggcugaggcaggagaauggcgugaacccgggaggcggagcuugcagugagcugagauugaaccacugcacuccagccugggcgacagagcaagacuccgucucaaaaauaaauaaauaaauaaauaaauggaaaguaaaaacaaaauguaaaggaacaaaccaugugacaugccccucauacacagaaauaaugaucugauguagccaaguccacgguauuugaaaagauaaacaaacuuacacauuuuggcucugggagacuuggaucauuuuuaaugguaaucuucuuugcuucuuccagguucuuuucucuucguaaacuaucuucugccuaauuuuaaugaugaagcaguuuguuaacaugguugccagaguucuaacuuuaacaacguucacgauggcaaggucaggacucaccucuuucuuuucccgggauucacucuucauuuguucccuaugccacaucuuuuuaauguucuucaacugugauuuagaaauaacauuccaccucucauuuucuuuuugugaaucuacguaaaugguaggaaaugguucuuucccuacugucaucaaagccuuggguagggaggagagaaaagacaguucuugaacauuguacaauacuuaaaaucaaaauaacaucucaaguauaaggcaacuggaacaaucuaagcauaaagaccccaacagccaaaagcugauauuggcacagugacugguugaacauuuaagaagcacacugguuggcugggcgcgguggcucacgccuguaaucccagcacuuuggaaggccgaggugggugaggucaggagaucgagaccauccuggcuaacauggugaaaccccgucucuacuaaaaauacaaaaaaauuagccaggugugguggcaggcaccuguagucccagcuacucgggaggcugaggcaggagaauggcgugaaccugggaggcggagcuugcagugagccaagaucgugccacugcacuccagccugggcaacagagcgagacucugucucaagagaaaaaaaaaaaaaaaaagaagcacacugguuaaagcugaagcucugagguccucucacaaacaauuacagcaaguucggguauacacgauacaguuccccaggaaaagcagacuauaagcaacagaucuuaaguggcuguagcaaccagcacagguacaaggacaacagaagagacaccugacagcaaaacucaacugcaagugacaucuaaaagguuaguucucugugagaaaucagagaagugucagacauuuuugaaacuuucaacaaaacaaugguuaagaacacaaaaagcggccgggugcaguggcucaggccuguaaucccagcauucuggggggccgaggagggaggaucaccaggucaggagaucgagaccauccuggcuaacacagugaaacccugucucuacuaaaaauacaaaaaauuagccgggugugguggcgggcgccuguagagcuugcagugagcugagauggcaccacugcacuccagccugggcgacagagagagacucugucucaaaaaaaaaaaaaaaaaaaaaaaaaaaagagcacaaaaagcuaaacucauuuaaucugaaaaacucccccauguagaauaccucuuuuccccaaugggacauaucaagcauugcuguguuauauaucauuugauaaaauguauuguuuguaguuuuuaaaaaauaguucaaaguacauaaaagaugaauauuuuaaagccucaaauaaucuuucaaaaucucuuccaaguuauugaaucaaacaagaaaugcagugaauuauucucuguugcaagaucugcagccugcaaaaacggacuuuuucucaguucuacgacugcugcagagaaggagggaaucugaggccgggcaugguggcucacaccuguaaucccagcacuuugugaggccgaggugggcggaucacgaggucaggagaucgagaccauccuggcuaacauggugaaaccccgucuccgcuaaaaauacaaaaaauuagccgggugugguggcgggcaccuguagucccagcuacucaggaggcugaggcaggagaauggcgugaaccugggaggcggagcuugcagugagccgagaucgcaccacugcacuccagccugggugacaagagcaagacuccgucucaaaaaaaaaaaaaaaaaaaaaauagagaaggaaggaaucuggaucuuuugaaaacauucaagggcugggcgugguggcucacgccuauaauccuagcacuuugggaggccgaggugggcggaucaugaggucaggaguucgagaccagccuggccaauaugaugaaacccugucucuacuaaaaauacaaaaauuggccaggugugguggcacacgccuguggucccagcuacucgggaggcugaggcagaagaaucucuugaauccgggaggcagagguugcagugagcugagauugcaccacugcacuccagccugggugacagugugagacuccuuuucaaaaaaaaaaaaaagaaaaaaaagaaaacauucaauaguucauccuuuuaacaacuagacauuguaagaauacauguaggggccaggcgcaguggcacacgccuguaaucccagcacuuuaggaggccgaggugaguggaucaccugagcucaagaguucgagaccagccuggccaacacggugaaacaccaucucuacuagaaauaaaaaaaaaaaaaagaaauuagccaggcaugguggcgagugccuauaaucccagcuacucaggacgcugaggcagggagaauugcuugaacccagaaggcagagguugcagugagccgagaucaugccacugcacuccagccugggcaacaagaacaaaacucugucucaaaaaaaaaaaaaaaaagauagccauugaugaaaaugcaaaaccaagagagaaggucccaugaauacauguaggucguucggaauucacuuauuacccgacaaucuguacugaucccuccuuuuguaucauugaaauugaaagagccaaacuaucaguucccaaaucagaaugcuacacuuuuguuaacagugacauucuguuguuaacagugacauucugcaaacguucaucuaaacgguguugucaguuuucaggagcugcaaaacgaggcacccgauaauccagaaaugaaagauuuccccuuaagagugguuaaaaaguaaaacccagccaggaguggcggcucacaccuguagccccagcacuuugggaggccaaggcagcaggauugcuuaagcccaggaguuuaagaccagccugggaaacauaaugagaucucguaucuacaaauaagaaacaaauuaaccgcguguggugacaugccccugugguccgagcuacuuggaaggcugaggugggaggaucccuuaagcccaggagguugaagcugcagugagccaugaaugcgcuacugcacuccagccugggcaacaaauuaagauccugucucagaaaaauaaauaaauaaguuaaauuaaaaacaaguacccauguaugacacaccaaaguuuauaaccauaugguaugaccuaaaagagaggagaaugcucccagauuaggacuugauaguaacuauaaauguuguaacacaguuaacaaaaaaaggggaugcacagaaaaaggagugucaaggcacugcuuuuccuaauacaguucaaagaaggaacuuuuuuguuguugucguccaggcugcagagcagugaugcaaucacggcucacugcagccucaaccuccugggcucaaguaaucccccuaucucagucucccgaguagcuggggccacaggugcauaccauaccaccaugccuggcuaauuuuuuuuuuuuuuuuuuuuugguaguuggcugagugugauggcucacuccuauaaacccagcacuuugggaggguuaauauccugucucuauuuauuuuuuaaauuaaauuuauuaaaaaauuuuuaagaaguuaaauuuuuuguagagaugagggucuuaucauguugcccaggcuguucucaaacuccugggcucaagcaguccuccagccucagccucccaaagugcugggauuacaaacgugaggcaccaaagcccagacccaaggaaggaacuuuuaaccaucuuccuuauguggcaguuauagccaauggauucuagcauaugaguucaacagcuaaguccauggucuauuuuaagaagguugucuuaggccacacuuuacucugauauaaucaacuaccuaacacccauguugugaguccaagcccuuuuuuuguuuuuucuucugagacagggucucaggcuagagugcaguggcgcaaugguggcucacugcaaccuccaccuuccaggcuaaagaaauccucaccucagucuccggaguagcugggaccacaggcacgcaccaccaugcugggcuaauuuuuauguuuuuuguagagccaggauuucaccaaguugcccaagcuggucucaaacuccugcgcugaagcaauccaccugccccggccucccaaaguguugagauuauaggcgugagccaccacaccaggccugaguccaagcucuugacaaaccccuuugagaaugagcuaaacucauucaaggauucuagauccugagaaauaacagcacuguuaauucauuaacagaauguuaauaaauuggcauucuagcuugaagcuccagacucaugagucagcucugacaaaugaauccauucuugguggucuuggagucaaaucucaggaucacacucuggauugugguaaauucaccaaaagcccucucaggagcccccuggucaugagcucacuguaacugaggaaagguaacuuuuaucuuuacaagaauugaaaacccagcaaucugacucaauggagagaaaaauuccaagaagcaaugccaugugguaagaaagaagagaccuuuuuucaaaauguuaaaaaguaaguuuagacuuugaucaucuaacaaucuuaaagucacauaucuguaugcauuccuuacuuucccuuuucugaaaauucucuuuggaaccuaguguuugaaauuaaguucuuggcaagucacaagaaaauugacauaacucauuaauaaaugcagucucauuuuccuaaugagaagagacucuaccuuuagaccuguuuuaaaugguuucuccuugguuccaucucccguggcaucgcuucccucucggucagagacguacagcucugcuguuugacaaaaugaggguaaguuauggucuggccauuaacuauuagucaccuuacuacuuuauucauuccuuaucuuuguaaacagaacaagcaucgauuaauaaaaauugagguccauaaguaauuaauauccuaguuauuuccccacuccauuucaauaacauccaucucauaaaaacauuaguuaauaauccagguuuucaaaaugaacucugaucauuuuaauuugugauauuuauucuaucuaauugggcacccaaaaauaaaauaugggcuuugaaguugaucagacauacgcuggaauguuggauuuuguaccuuaaaaggcagggugacucuggagaauuuacuuaaccuuucugagcuuauuucuuuaccuauaaaauaggaaaaacaauccccaucuugaaaggcugugcugaggaugaaauaaaauaacacauacaaaucagauaucccagugccaguuuuuguagagauggcaaauaaacaccagcucccucuggacuuuaaaggaaacagaagcucugagguuagaaaauuucagaaggccucacaacuaguaggucugaacaguuaacauccauccaggucucucucuuuuuuuuuuuuuuuuuccuacugcacaguauggucuccccggaaaccucaauaaaaaaaugagggugggagaaaaacaacuagaauccuaaagccccuuccugacgaucacuuugaagaacugcaggaguaggggcuacccugugucugaacccgucccagcgccugagucucagcgcaaucgggagguuucgcagcggggcaggggaagggcccggagccaccgccaucgcagcccgggggaacgacggacucggggaagcccggccuggcccuucaagucccgggcccagcaaaggccagcacccucccucccucccucccugcaaucgguccccaaacauucgcggggcgcccacucugguaggcacuaaggaaagcgccgaaacccgacuggagcagaguuccugccccaggcagggaacaccgcgccauacacugagucucacccaccuagcaccaugccugcaguggcccuggucaccuccaaggacacagacugcaacaccgacgccgucuuaugacuccaacgugcaccggcgguuuccgcgauuccggcguugcaucagagagcguagaucugagggcgccugcgag

SEQ ID NO: 18578 - RNA, 21196 nt, Homo sapiens
cucgcaggcgcccucagaucuacgcucucugaugcaacgccggaaucgcggaaaccgccggugcacguuggagucauaagacggcgucgguguugcagucuguguccuuggaggugaccagggccacugcaggcauggugcuaggugggugagacucaguguauggcgcgguguucccugccuggggcaggaacucugcuccagucggguuucggcgcuuuccuuagugccuaccagagugggcgccccgcgaauguuuggggaccgauugcagggagggagggagggagggugcuggccuuugcugggcccgggacuugaagggccaggccgggcuuccccgaguccgucguucccccgggcugcgauggcgguggcuccgggcccuuccccugccccgcugcgaaaccucccgauugcgcugagacucaggcgcugggacggguucagacacaggguagccccuacuccugcaguucuucaaagugaucgucaggaaggggcuuuaggauucuaguuguuuuucucccacccucauuuuuuuauugagguuuccggggagaccauacugugcaguaggaaaaaaaaaaaaaaaaagagagagaccuggauggauguuaacuguucagaccuacuaguugugaggccuucugaaauuuucuaaccucagagcuucuguuuccuuuaaaguccagagggagcugguguuuauuugccaucucuacaaaaacuggcacugggauaucugauuuguauguguuauuuuauuucauccucagcacagccuuucaagauggggauuguuuuuccuauuuuauagguaaagaaauaagcucagaaagguuaaguaaauucuccagagucacccugccuuuuaagguacaaaauccaacauuccagcguaugucugaucaacuucaaagcccauauuuuauuuuugggugcccaauuagauagaauaaauaucacaaauuaaaaugaucagaguucauuuugaaaaccuggauuauuaacuaauguuuuuaugagauggauguuauugaaauggaguggggaaauaacuaggauauuaauuacuuauggaccucaauuuuuauuaaucgaugcuuguucuguuuacaaagauaaggaaugaauaaaguaguaaggugacuaauaguuaauggccagaccauaacuuacccucauuuugucaaacagcagagcuguacgucucugaccgagagggaagcgaugccacgggagauggaaccaaggagaaaccauuuaaaacaggucuaaagguagagucucuucucauuaggaaaaugagacugcauuuauuaaugaguuaugucaauuuucuugugacuugccaagaacuuaauuucaaacacuagguuccaaagagaauuuucagaaaagggaaaguaaggaaugcauacagauaugugacuuuaagauuguuagaugaucaaagucuaaacuuacuuuuuaacauuuugaaaaaaggucucuucuuucuuaccacauggcauugcuucuuggaauuuuucucuccauugagucagauugcuggguuuucaauucuuguaaagauaaaaguuaccuuuccucaguuacagugagcucaugaccagggggcuccugagagggcuuuuggugaauuuaccacaauccagagugugauccugagauuugacuccaagaccaccaagaauggauucauuugucagagcugacucaugagucuggagcuucaagcuagaaugccaauuuauuaacauucuguuaaugaauuaacagugcuguuauuucucaggaucuagaauccuugaaugaguuuagcucauucucaaagggguuugucaagagcuuggacucaggccuggugugguggcucacgccuauaaucucaacacuuugggaggccggggcagguggauugcuucagcgcaggaguuugagaccagcuugggcaacuuggugaaauccuggcucuacaaaaaacauaaaaauuagcccagcaugguggugcgugccuguggucccagcuacuccggagacugaggugaggauuucuuuagccuggaagguggagguugcagugagccaccauugcgccacugcacucuagccugagacccugucucagaagaaaaaacaaaaaaagggcuuggacucacaacauggguguuagguaguugauuauaucagaguaaaguguggccuaagacaaccuucuuaaaauagaccauggacuuagcuguugaacucauaugcuagaauccauuggcuauaacugccacauaaggaagaugguuaaaaguuccuuccuugggucugggcuuuggugccucacguuuguaaucccagcacuuugggaggcugaggcuggaggacugcuugagcccaggaguuugagaacagccugggcaacaugauaagacccucaucucuacaaaaaauuuaacuucuuaaaaauuuuuuaauaaauuuaauuuaaaaaauaaauagagacaggauauuaacccucccaaagugcuggguuuauaggagugagccaucacacucagccaacuaccaaaaaaaaaaaaaaaaaaaaauuagccaggcauggugguaugguaugcaccuguggccccagcuacucgggagacugagauagggggauuacuugagcccaggagguugaggcugcagugagccgugauugcaucacugcucugcagccuggacgacaacaacaaaaaaguuccuucuuugaacuguauuaggaaaagcagugccuugacacuccuuuuucugugcauccccuuuuuuuguuaacuguguuacaacauuuauaguuacuaucaaguccuaaucugggagcauucuccucucuuuuaggucauaccauaugguuauaaacuuuggugugucauacauggguacuuguuuuuaauuuaacuuauuuauuuauuuuucugagacaggaucuuaauuuguugcccaggcuggagugcaguagcgcauucauggcucacugcagcuucaaccuccugggcuuaagggauccucccaccucagccuuccaaguagcucggaccacaggggcaugucaccacacgcgguuaauuuguuucuuauuuguagauacgagaucucauuauguuucccaggcuggucuuaaacuccugggcuuaagcaauccugcugccuuggccucccaaagugcuggggcuacaggugugagccgccacuccuggcuggguuuuacuuuuuaaccacucuuaaggggaaaucuuucauuucuggauuaucgggugccucguuuugcagcuccugaaaacugacaacaccguuuagaugaacguuugcagaaugucacuguuaacaacagaaugucacuguuaacaaaaguguagcauucugauuugggaacugauaguuuggcucuuucaauuucaaugauacaaaaggagggaucaguacagauugucggguaauaagugaauuccgaacgaccuacauguauucaugggaccuucucucuugguuuugcauuuucaucaauggcuaucuuuuuuuuuuuuuuuuugagacagaguuuuguucuuguugcccaggcuggagugcaguggcaugaucucggcucacugcaaccucugccuucuggguucaagcaauucucccugccucagcguccugaguagcugggauuauaggcacucgccaccaugccuggcuaauuucuuuuuuuuuuuuuuauuucuaguagagaugguguuucaccguguuggccaggcuggucucgaacucuugagcucaggugauccacucaccucggccuccuaaagugcugggauuacaggcgugugccacugcgccuggccccuacauguauucuuacaaugucuaguuguuaaaaggaugaacuauugaauguuuucuuuuuuuucuuuuuuuuuuuuuugaaaaggagucucacacugucacccaggcuggagugcaguggugcaaucucagcucacugcaaccucugccucccggauucaagagauucuucugccucagccucccgaguagcugggaccacaggcgugugccaccacaccuggccaauuuuuguauuuuuaguagagacaggguuucaucauauuggccaggcuggucucgaacuccugaccucaugauccgcccaccucggccucccaaagugcuaggauuauaggcgugagccaccacgcccagcccuugaauguuuucaaaagauccagauuccuuccuucucuauuuuuuuuuuuuuuuuuuuuuugagacggagucuugcucuugucacccaggcuggagugcaguggugcgaucucggcucacugcaagcuccgccucccagguucacgccauucuccugccucagccuccugaguagcugggacuacaggugcccgccaccacacccggcuaauuuuuuguauuuuuagcggagacgggguuucaccauguuagccaggauggucucgaucuccugaccucgugauccgcccaccucggccucacaaagugcugggauuacaggugugagccaccaugcccggccucagauucccuccuucucugcagcagucguagaacugagaaaaaguccguuuuugcaggcugcagaucuugcaacagagaauaauucacugcauuucuuguuugauucaauaacuuggaagagauuuugaaagauuauuugaggcuuuaaaauauucaucuuuuauguacuuugaacuauuuuuuaaaaacuacaaacaauacauuuuaucaaaugauauauaacacagcaaugcuugauaugucccauuggggaaaagagguauucuacaugggggaguuuuucagauuaaaugaguuuagcuuuuugugcucuuuuuuuuuuuuuuuuuuuuuuuuuuuugagacagagucucucucugucgcccaggcuggagugcaguggugccaucucagcucacugcaagcucuacaggcgcccgccaccacacccggcuaauuuuuuguauuuuuaguagagacaggguuucacuguguuagccaggauggucucgaucuccugaccuggugauccucccuccucggccccccagaaugcugggauuacaggccugagccacugcacccggccgcuuuuuguguucuuaaccauuguuuuguugaaaguuucaaaaaugucugacacuucucugauuucucacagagaacuaaccuuuuagaugucacuugcaguugaguuuugcugucaggugucucuucuguuguccuuguaccugugcugguugcuacagccacuuaagaucuguugcuuauagucugcuuuuccuggggaacuguaucguguauacccgaacuugcuguaauuguuugugagaggaccucagagcuucagcuuuaaccagugugcuucuuuuuuuuuuuuuuuuucucuugagacagagucucgcucuguugcccaggcuggagugcaguggcacgaucuuggcucacugcaagcuccgccucccagguucacgccauucuccugccucagccucccgaguagcugggacuacaggugccugccaccacaccuggcuaauuuuuuuguauuuuuaguagagacgggguuucaccauguuagccaggauggucucgaucuccugaccucacccaccucggccuuccaaagugcugggauuacaggcgugagccaccgcgcccagccaaccagugugcuucuuaaauguucaaccagucacugugccaauaucagcuuuuggcuguuggggucuuuaugcuuagauuguuccaguugccuuauacuugagauguuauuuugauuuuaaguauuguacaauguucaagaacugucuuuucucuccucccuacccaaggcuuugaugacaguagggaaagaaccauuuccuaccauuuacguagauucacaaaaagaaaaugagagguggaauguuauuucuaaaucacaguugaagaacauuaaaaagauguggcauagggaacaaaugaagagugaaucccgggaaaagaaagaggugaguccugaccuugccaucgugaacguuguuaaaguuagaacucuggcaaccauguuaacaaacugcuucaucauuaaaauuaggcagaagauaguuuacgaagagaaaagaaccuggaagaagcaaagaagauuaccauuaaaaaugauccaagucucccagagccaaaauguguaaguuuguuuaucuuuucaaauaccguggacuuggcuacaucagaucauuauuucuguguaugaggggcaugucacaugguuuguuccuuuacauuuuguuuuuacuuuccauuuauuuauuuauuuauuuauuuuugagacggagucuugcucugucgcccaggcuggagugcagugguucaaucucagcucacugcaagcuccgccucccggguucacgccauucuccugccucagccucccgaguagcugggacuacaggcgcccgccaccacgcccggcuaauguuuuguauuuuugguagagacgggguuucaccguguuagccaggauggucuugaucucccgaucucgugaucugcccaccucgaccucccaaagugcugggauuacaggcgugagccacugcgcccggccuacuuuccuuuuauuuuuuauuucuuaauuuuaaauuuuaauuuauuuauuuugagacagggucuugcucuguugcucaggcuggagugcaguggugcaguuucugcucacugcaaccucugccuccugggcucuaacgauccucccaaguaggggggaccacaggcaugcaccaccacaccuggcuaacuuuuauuuauuuuuaauuuuuguagaaacagucucccauauugcccgggcugguuucaaacuccugggcucaagggauccucccaccucagccucccaaagugcugggaauacaggcgugagccaccaugccuggccuacuuuccuuucagaagggacauagagaaauaauguuuuagaguuaugaggcuaguucuuuagggguucauuuuauuacacaguuaaguaaaugcauguugaaugaauucugucccaacugaaugccagcagaugggggacccaggccuggcuacgcuucaugauguuggucaagugauuuaacccucucuagugucaguuugcuuauaaaaugaagagguugaaaucuaugauuuucauguuuuauuuaaauagaguaaaaguuugugaauugugaaauuagauucacucuucuucuguucuuucuggaacccaaauagauugcuggacuaugaaugaaaaugguuugauuuccaguaguucuuauuuuauuuuauuauuuauuuauuuaugagacagaguuucacucuugucacccaggcuggagugcaguggggagaucucagcucauugcaaccuccgccucccggguucaagugauccuccugccucagacucccaaguagcugggauuacaggugccugccaccacgccuggcuaauuuuuguauuuuuaguagagaugggguuucaccguguuggccagacuagucucaaacuccugaccucaggugaucugcccuccuuagccucccaaagugcugggauuacaggcuugagccaccacgcccagccagauuuccaguaguucuuauugcugaugaauuuuuguauuauuuccuuagugauggagcugggguuuuuuggccacaugcaacagccccuuccucuacucaucuccucucuccuucaucccccaaacaaaagcuagccuuuuaaguaccauguucuggaagguauugaagaacuguggggucauggaaaaggcuucauguggacugggauuguugcuguugugggaagcaagugcuccacuuaugacaaaggaauucauuuauuaauuaauuuuaucuagcaauaucugaaauucuucuggguguuucucauuaucaguuuuacauuaagaaagaagacuuggauuuuuuuuuguuuuguuuuaaaccaugccaauacagugaaaugcguuugguucugagcugcaguagaggggcugucuccaguuuugcaccauuugugauuuuuaacacuuacuaccgucugccuaauauuagugaaaaaguugguguguauaaaugacauuauugaacaaauguuguuuauuucaauuugacaggugaagauuggugcguuagaaggauauagaggccaaagaguaaagguguuuggcuggguccacaggcugcgcaggcaagguaaauggcaaagcuuuuccuucuuuuuaauguuuaaauaucccugcucuuagaugaagaaaaacauacaaagauuugcagggguuuuuuucucucccccuuuuuuucuuagacacagucucacuuuguugcccaggcuggagugcaguggugcuaucucggcucacugcaaccuccgccucucagguucaagcaauucuccugccucagccuccugaguagcuguuaucacagguaccugccaccacaccuggcugauuuuuguaauuuuaguagagacgguguuucaccauguuggcccgucugcucuggaacuccuggccucaggugauccacugucuuggccucccaaagugcugggauuacagguaugagccgcugcgcccggcccucuuuuuuuuuuugguaugcuggcuagacuugaacuccccccagccauccuccugccucagccuccugagcagcugggauuacaggcacauagcaccucaccuggcuuuaaaggauagagugauuuauaucuuaaauuuguucuuguuuaaaaugacuauugaaaguauaaaaauuuuuaaaugcucuuuuaaugguuagcaauuauagugaugaagaugcguccaguaaauauuugucaaguugaguuuuaauuauuuagugaaaaucaagggauguuacuauaggagguugacaucugagucugaaacuuggccauaguuuugacucuuauaaacaguauauuugcauucucccuugguucugacauuuuguuuccucuuuccccuuuuauuauauauuuuauaauauauaaacaugucacuuuuacuauuuauuguaagggauuagcaaaucuuucauugaaaagugggacaggccaggugcgguggcucacgccuauaaucccaguacuucgggaggccaaggcggguggaucgccugaggucaggaguucaagaccagccuggccaacauggugaaaccucuucucuaauaaaaauacaaaaauuagcugggugugguugugagcaccuguaaucccagcuacucuagaggcugaggcaggagaagcacuugaaccugggaggcagagguugcagugagccgagaucaugccauugcacucuagccugggcgacaaaagugaaacuccaucugaaaaaaaagcgacgguggaggggacaaaaauacaaaugaaauguuuuaagcggauuucaguaauuggaccuuuaggacauaaauaagaaaaagugauuuuguucaagaacauuuauguaucaccgagugcacaguacuaccccaggcauugcaggggacucaaggguagauaaggcauaaucccuuaacucauguugccuucuguccugcuuuccccugguuguguggaucuuggggaucauguaggauuugaaaguccaauacauugaaaauaaaauauuuuacaaauacugaguagugguauuaccaguggguacuucaggggcagggagccaugugggaggucugaacuugaauguuuaaccuuggaguuuccuuuagauaagauuaagucauggcugggugcaguggcucacaccuguaauaucagcgcuuugggaggcugagguaggaggauugcuugagcccaggagcuugagaccagucugggcaacucagugagacccuugucacuacaaaauaauuagccaggugugguggcaugugccuguagucccagcuaucugggaggguaaggugagagguuugcuugagcccaggagguagaggcugcagcgagcugugauugugccacugcacucuagccugggugacgaagugagacccuaucuuuaaaauuauauauauauauaaaauuuaaugccuugagaacagucugccuaaauuauuauuucucauuuuuuaggaaagaauuuaauguuucugguguugcgagaugguacagguuaucuucagugugucuuggcggaugaguugguaaauauuuucucuuauuuaugccugaaaauuagauguuuucaguagauuccuuuauuguuuuguauacauuuauuuaaaacauuuauuaugucgacagugaaugucaaugaaucaaaacaucacauuguauaccauaaacaugcaauuuuuauuuguuuauuauaccuuaauaaggcuagagggagaaaacuuuuguggaaaauuuccagcacauuacaaaauagaaccauauaaaaaaucaucaaaugcccaucacccagcuucuguaaccaccuauauauggcuaauccugguaugauacugccccucagacaucauaucauuuuauuuaauuacacaugcuuaugcaucucuaagaaaaauaauguggcugggcaugguggcucaugccuguaaucucggcacuuugggaggcugaagugggcagacugcuugagcccaggaguuugagaccagccuggcaacauggugaaauccuaucucuacaaaaaauacaaaaacuagccaggugugguggugcauaucuguagucucagcuacucaggaggcugaggugggaggaucucuugagccagggaggcagagguugcagugagccaagaugaugccaccaccuuccagccugggcaacagagugaaaccuugucucaaaaaaaaaaaaaaaaaaagauaauagucaccuacuauuaucacacccuccaccaaauuaauacaacuacuaaauaucaucuaauauccagauucuuguuaucaguucguacugccuuuuuauaguugauugauuugaacgaggauucugacaagacuaacaugcugcguuuagugauaugacuuugaaauuuucuuuauaacucugcugcucucuuugcauucucucuucuuuugcaacccgcccccucuccccacccauuacuauguauuucuugggaaaacccugguggauuguccuguggaacuucucacauuauggauuugguuguuugcauccuugugguguccuuuagcauguucuucuagugucugcauuuuuuauaaauuggagguuaggucugauuagguucaguuuuuuggcacaacuacuucaugggcaaagcuguguucuuuuaguugcaucacgucaagaggcauguaaggugugguugucuuuuucuuuuuuuuauuugagacagagucucgcucugucacccaugcuggagugcaguggcgugaucucagcuuagugcaaccucugccucccagauucaagugauucucuugcuucagccucccgaguagcugggacuacaggugcaugccaccauacccagcuaacuuuuguauuuuuaguagagacagguuuuugccauguuggccaggcuggucuugaacuccugaccucaggugauccacccgccucggccuccgaaagugcugggauuacaggugugagccgccgugcccggccaguugucuuuuuuaugacuaguggguucagguguuggcagccugacuucuuccuuuuaaaguuccccaucaguuuuuuccuaaugacuuuaguaagaagugauuauaguguagaugggcucuguaugguuuuguuuguuuguuuguuguuuugagacacaggguuucucagaaagaguacaguggcaucaucauagcucauugcagccucgacuucccaggcccaagcaauucucccaccucagccucccgaguaguuaggacuauaggcaagaaccaccacacccagccaauuuuuauuuuauuuaucucucccuuuguuguccaggcuggucuugaacuccugggcuccagugagccucucaacuuagccuccuucaugggauuacaggcaugaaccacugugccuaaccuguauguuacuuuaauagucuagauuuuuaaaaauaaauaaauaaacuguccagauauuuuuaagugaugugggucagugucauuuauccauguauguaaaauguguauuuacauguauauguauauauuuacauguauaugucuauauauagauaaaccucugucuuccacaaaaauaucuauuuuaauauuaagaaucaguggccaucucacucuuuauuuuacuaguauuugaucagauaacuuguuuguaaacaaucccuuuaacuuucuauaugguagaauuuuuaaaucaaugugaauaacuaaauuugagcuuugaccuuuuuauagugucagugcuacaauggaguucucuuguccacggagagcaguguugcaguguauggaaugcuaaaucuuaccccaaagggcaagcaggugaguggauugaguuucgcacugggugaaugaauaguuuauuuauugguuuguuuuccagugucuuuguuuguacauuuggcauauguauuaggguucuucagagggacagaacuaguaggauagauguauaugugaaagggaguuuuuaaggagaauuggcucacaagaucacaagaugaagucccacgauaggccaucugcaagcuguggagcaaggaagccaguaguggcugaguccaaguucaaaagccucaaaaguagggaagccgacagggcagccuucagucuguggccaaaggcccaggagccccugucaaagaacugguguaaguccaagaguccaaaagcugaggaacuuggagucugauguucaaugacaggaagcauccagcaccggaggaagaugaaggcuggaagaccuagcaagucugcucuuccaccuucuuccucuugcuuuuucuagccaggcugguagcugauuggguggugcccacccacauugagggugggucugccucucccagaccacugacuuaaauguuaaucuucucuggcaacacccagauacacccagaaaauacuuuguauccuucauuccaaucagguugacucuuaauauuaaccaucacagcauauaaauacaauaaaugugaaguacaugucaaauucacuaugccuuuuccagugaaauauguacauuguacaacucaggugauaaaaagaauacaaugauuuccagccuuacggaauuccugaaucauccucaugggcuauaauauagccacugugcuguagauauaugaauuacuuuucagccagauggaaauaaaaacuuaacaacccaccuaaauauguucagagaauuucuuauuagaauuugagccuguuuuuauuguuuuuuuuuuuuuuuuuuuuugagacggaguuucgcucuuguugcgcaggcuggaaugcaguggugcgaucuccacucaccacaaccucugccucccagguucaagcgauucuccugaguagcugggacuauaggcgugcgccaccaugccuggcuaauauuuuguauuuuuaguagagaugggguuucaccuuguuggccaggauggucuugauuuccugaccucguuauccacccgccucagugagccaccgugcccagacacaaauaucuuuuaaaaauggaaacgcacaggcugcgcaugguggcucaugccuguaaucccagcacuuugggaggccgaggcgggcggaucacgaggucaggagaucgagaccaguuuugccaacauggugaaaccccgucucuacuaaauauacaaaaauuagccagacgugguggugggcgccuguaaucccagcugcucgggaggcugagguaggagaaucgcuugaacccaggaggcggagguugcugugagccaagauugcgucacugcacuccagccugggcgacagagugagacuccgucucaaaaaaaaaaaaaaaagauauuuguguguaugugaguguguauuuauccagaaagaacauugguaaaaauaucaauauaaaacuaaacuaaagcugagaauuaggagguucuuaaaaaucucagcuuaccaaaacuuugacauaaauuaaaauccucaauacuguuaauuuuuuauuuccuuuucccucuuucucuggaccccacuuuuaaaaaaugcaggcuccagguggccaugagcugaguugugacuucugggaacuaauuggguuggccccugcuggaggagcugacaaccugaucaaugaggagucugacguugauguccagcucaacaacagacacaugaugauccgaggagaaaacauguccaaaauccuaaaagcacgauccauggucaccaggugcuuuagagaucacuucuuugauaggggguacuaugaaguaaguaugcauucgucagcuuuugcaaagaauauguuuuuugccguuuugaaacuugaauaguggugcucacgauagcauugauuuauuccuucuuugcauuugaacagguuacuccuccaacauuagugcaaacacaaguagaagguggugccacacucuucaagcuugacuauuuuggggaagaggcauuuuugacucaauccucucaguuguacuuggagaccugccucccagcccugggagauguuuuuuguauugcucagucauaccgggcagagcaguccagaacacgaaggcaccuggcugaguaugaaguugucuuuuuguuuuauuucuuucuagguaauaucuuuagagaagaaaucuuaguguagguaaauuauguuuauguuuuaaaaaaaaccaacugauauauuaagugguuaauggaagaacauauaacaaaguuuugccaccuuagaucguagcuaaguucucuuuuuucacuuugacuugaucuuuuauauauaaaggagcaaacaagaaauugcuacucaguggagaagaggggaguccacagcuaauuugcaaaguugggaauugguagcauuguuggcauuuuauggacagcuucccaauguuaaaagccuugcuggauaaaaaaccagugcaggagaaaagcagugcugagcuauugucucguucuucagguacacucacguggaagcugaguguccuuuccugacuuuugacgaccuccugaaccgguuggaggacuugguuugugaugugguagaucgaauauugaagucaccugcagggagcauagugcaugagcucaacccgguaggugcaguguuuauggaaagaaaaagucacaguccuuuuuuggaagacaaugaagucuucacccucaguuuuuguagauuugauggcuuggugagcugaaauaagugacuaauuauuuugaagacuagaauuugauguuagucacugucaauaauuuuauaauguuuucaguuauauaacaggcucauguuuuccauuuuaggaaugucuacauaguuuucuagucugaaguuauauauauauauauauauauauauauuuuuuuuuugagacagagucucacucugucgccaggcugaaguacaguggcgcgaucucugcucacugcaaccucugccucccagcuucaagcgauucugccucagccuccugaguagcugggacuacaggagcccaccaccacccccagcuaauuguuguauuuuuaguagagaugggguuuuaccguguuggccaggcuggucccaaacuccugaccucaagugaucugcccaccucagccucccaaaaugcugggauuacaggcaugagccaccacaccucacugaaguaauacuuuauaauaguuuuuuaauggaaauuuuaguguuaauguuuauauuuauguauauauacacauuauauuuuuccuuucuucuguagaacuuucagccccccaaacggccuuucaaacggaugaacuauucagaugcuaucguuuggcuaaaagaacaugauguaaagaaagaagauggaacuuucuaugaauuuggagaaguauguaucccuuucucucauuguuuccaaggugggauugggcuccaauucucuucuucugguuaaugaacuaguaacauggguggcaucugccuguccucaaauaaaugguaacagcaggaccugcuucuuggguugccugcagauucgcugaguuaacagagucagccuuaggacagugccuguucuguaccacccaguaagcguaagugaguuucuuuuuuuuucuuuuuuuuuuuuuuuuuugagacggagucucgcucugucgccuacggagugcaguggcaugaucucagaucucggcucacugcaaccuccgccuccuggauucaagcgauucuccugccucagccucccgaguagcugggacuacaggcgcacaccaccaugcccagcuaauuuuuuuauuuuuaguagagacaggguuucaccauguuggccaggauggucucgaucucuugaccucgugaucugcccaccucagccucccaaagugcugggauuauaggcgugagccaccgcuucuggccaagugugaguuucuaagcugccuucaugucucaugcuuugccucuucccucuuccuucauuguucuuccuuggccacagcuuauaagcucucuuuaucauucucuaggcugguaggagugcuuuagaagguugugaagccuuugaaaucacaugcaaaauguugguauauagauauauauauauauauauauuuuuuuuuuuuuucuggagaauguaucuugugcuuuuaaaaagagguucauccccucccccaaaacagugauuuaaaacuucuuaauguggaaggcgagaaagaagauagccauugguuaaaaaugcaaaaccaagagagaaggucuuggagaagguagccuagugccccagguaaacuuagcauuucgguuuugccugagaaccacucucccagcaugcacuuggguugcaaauuuucuuuauuugggacagcaucuccaucugucguccaggcuggaaugcauuggugcgaucauagcuggcuacaaccuugaacuccagaguucaaguguuccuccuacaucagccuccaaaagugcugggauuacaggugugagccaccaugcccagcuaauuuuuuauuauuuguagagauggcgucucccuauguugcccgggcuggucucaaacuccuuggcucaagcaguccucccaccccagcuuuccaaaguauugggauuacaggcgugagccacugcaucuggcucaaguuuccaagacuaugcuaggcccucuuuccugugcauuuaaccauuacuuacauaauauuugcacaucuaauuguuuuacaguugaaauguguguagaugcugcuaacuaguuuuggguuuuagaaggaauuaauaggugaaacaauauacugggucuauguaaagcacucuuguuucugugaauucaguuugguuuuuugguuuuuuuuuuuuaaagagauggagguauugcuguguugacugggcuggucucaaacuccuggccucgagcaguccucucaccucggccucccgaguguugagauuauaggcaugagccacacugugcccagccuaugaauucaguuuaugauguauaaugacaaaauuuuguauugagaacuugcauacuuuuaguguuccuaauacuuaguaaaauaguguaguugaguggaaagaacacaagcuguggagucagaaggccccccaggugggcuuagcucccaccucuuuucuuuugugcuguguaacugaagaccagugacccccucucagguuccuuaucucuaccuuggaaguaacaucuguuuugcaagauuguggggacuaccggagcuaaaugccuaggcaggacaauggcagggggagccugucagcauuuacuauacauugcuacuguuccacacacaugaggacacuagaguggauacaugacccucaggcuuugggggguaugaaauaagaccuguuuuccccuaacuaaaucuuaugcagaaccccgcuguguaaagcagaugcaagcugagagacuagagcucucccacucaucuccuguuaccucucggcgucuccgaggacgcaagggcuccagagccuggagcuugaaaacaggugugcuaggugauugcuaccuccauuucacuucuucauuaaacaaaucuaugagucuucuccaguucucucaauccauuuuuacugggacgagaguugucaguuuuaacuucuguguuaacuuuaauuuaugugugguauagaaggauguuuugagagagaaacugaugcgcuuaagucaucaucuaacauuguuuggguaacuauuccaggugugcuuacacuuaccaguuugacauugguuauuugucuuaugauugugucugucaucgaaggcauaacugauugauuacaacaggaaagaaggguagauaacaggagaguuuaaagauaagugucauuaguaauauacucuguguguagaucaaugauguucuggagcauucaugauuaccguaugccuuacgggacuaaguggaccucauuugcuucagagcuagacaaaacgggccacugagaaaaauacugagcugugucuagucacagcuuggggcuggcuuuuguuuuuguuuuuuuuuuuauuuuccuucaucaaacagcauggugcuugagauaugcuguaaagggagacagaucuuuuaugcuucauuaaauaacugaguuuuaagaauauguuuauuucuuuuugaaagaaauuauucuuuacacaaauguguauggguuaaggguagguguguauccucuacucuguugaauugauaggaggaaggacugguacagggugaaggagcugcuucugucuuguugcgauccaaguuguaaauguuaaugaagucuuguuugaccucaggauaucccagaagcuccugagagacugaugacagacaccauuaaugaaccaaucuugcugugucgauuuccuguggagaucaaguccuucuacaugcagcgauguccugaggauucccgucuuacugaaucugucaguuucuguuucaaagaguauuaauaauuuugcuuuuuaaggggguggggacugucaucuggaaucagguacagcucaugccaaauauuucauucucuaucuagaauaacaauauuuaaagacguuggguuuuuucacccuccccugauugaaguugacaugcuuuguuaaauuagagaaauguaaacauuugaauauuacaugaucauaguggcuccuuuagcccuuggagcuuaauuguaauuuucauuuaaacucuagggcagugcugugucugaucgcuugauaguaauuguguaucuucuuucacuuauauuuaaaggucgacguguugaugcccaauguuggugagauugugggaggcucaaugcguaucuuugauagugaagaaauacuggcagguuauaaaagggaagggauugaccccacucccuauuacugguauacggaucagguaaaaccaauuuuuuaaguacucaacauuuuuuuccacuguaaucguucuguauauauugaaauuuuuaaaaggggagaauucaggguaguacuuugguauuugaaugagcuauauucaguuugcagguuauaauguggugugugaauauugccagcuuuguuuuggccaaguuauauguuaauuucauuugaaaaccuguuuaacggccggcuuguugauugcaacugaguuuuaaaaaauugauccuaccaguaucuaguacccuucuucauuuuccucuuauaaauagacauugacuuauuuuaaaaguuuuuaaaaaucucuucuuuccaggguaguacuuauucccugguugauuuuuucauaccaaauuauuucuuuaugcaugguucaugaaggcauagagauuaagugcugggauuacaggcacgagccacugaaucuggccauaguugaauucuuaaccacagugagcuaacuccuuucaugguggaaaauuuuaacugucuuagaugaaaguuuuaacuuaaguauuuacuccucuuucuuucuuucuuuuuuuaaacagagaaaauacgguacauguccccauggaggauauggcuugggcuuggaacgauucuuaacguggauucugaauagguaucacauccgagacgugugcuuauacccucgauuuguccagcguugcacgccauaaccauuuucuccagaagcguggaggaaagauuaugaaaggaacaggcucuuuaaaaaagaaaacaaaaagccagaaucuuccuuuuuuuguuucauugggguuucucuuucuguuuuucuuucuacuaccauaaaaacuaucucaaaucaccugaacaucaagugauauuaagguugucaucuuaagaaaaaauauccauuuuuuucuuaaguucgggaaacaaaguucggggaaaauaccuggcaugaaacuguaguuagggauacauuucagcauuuuacucacuuuauccaaguuauucauuuuauucaaguuauauguauguauaauucaacaauuuuagauuaugguguaagauacuccaguaacuuaucuuucuguccuuuuaaguguaccuugaauucuuugauuuauuuuauugcaucaaugaauuaaaacaaaaaucuugggggaagaaauuggcaauaucguauaaaaaucugcucauauuagaacacaguauaauucagcaguaaacacuagaaucaaaugaauagccuuuuguaucaguuauuaaucuuuucuaacucugcuuagcugcuaauaauccugaggcauagaaauugaagaauuuguaaaaauagaauugccuuaaaggauuugaaguaagaacauaauuuuggggagaguuuuuuagugauucacaguaucccucuuagcauuaauuuaagguaaagaggcagauugauuuucccucuuuccugguaauuccuaaguaauuaagaauaaauaaguuccaaaagaaauuguagcuggaaucuuaauaacaauugugaguggcuguuugaguugcccccaccauguccuuagaucuaaucugugcuaccuuauuaacucacagcaggcuuacugaauggcuucauuucagauuuaguugauuucuccaccaaaugcaugucauguauucucaauaggcuguauucccagcagucaauaaaugaacacccguaaaaacuc

SEQ ID NO: 18579 - RNA, 1824 nt, Homo sapiens
gaaaaagucgacugacgaauuucuuucacuuauuuaaaguagucucuugcaguccuauaaaucggaaggauuaaaugaacugcuugcuagagaaacgguagcuggguggugggaagaauccuacgguggcuaauaagacgucucgaucauuugcauaugcaaaggauaaccuuaagcuugaguuugauauuucacguugcggcucacaaaugaacugcuuuuuauucaaagaaccaugcugucuguuuucgcguggguggguguguaaccggggcgggcgcuauguugguuuuguucccugcaagguugacacaggcaauggcgacuugcggccacacuggggcagccucuccucggcuggcagccgggccgggcggcucgcucccgggagcugacaauguagccaaguccugcucgucggggccgcaaagaauuuaaaggggucuagaaacauccaucuuuuccccuuuucacaguuaacagcgagcucagggcucucgguaaaaagaccaccgggaggaagaaacgcucagggcguuuuuguuauuguucgcaaaauccucuaucgcccccaaacguccagcccgcccccucccuaaagcggagggaaaccgggagaggagggagggucggcggcgccggccaagcgcgccaguacacgccccugcggauccgccccgcggccgggugacccccgccgcgccgcgcuggaggccccgggccggggugggcguggggcugaacuccgccacccccgcagcccgcggcccgcucgccagcccggccugugauuggcuuggggggcgcgugugcccgccccggcgaacggggaggguacccucgcggcgccggugggaggaggcggaggagggggcggagagagcgggggcccggacggcgcuagcgaggaggcgggcgagccggguccccgggagcgcagaggaggcucggaggggggcggagagcggcggggcgggagggaggcgcgggucgcggggagggaaagcccggccgggucugcgccgccgccgcgcgcagugagaggcgccggggcugccgcccggugcucggcgcgcucucgggagccgcccgcccgcuggucccgcagccuuccgggaggaagcggugccggcagcguccagggcgcgcucucgggcacccucaccugccggcgcccggccgcuuacccggcagggcgugcgcaggguagggugcgggaccggggggaccuggaggcagaggggagaaccggccguccgcgccgcagcacagccgcugggagcgccucagaccccgcgcggggcgccggcuccauggcgaccgggcucggggagccggucuauggacuuuccgaagacgaggugaguggcacccccuuccugcucgggacuccccggggaguuccuaucccgcgccggcagggggaggggaaaggggccguccccggggugcucgugcccagcgucugcaggggagccccaaagcgggagcgccccggagcgggauccaggggagcuuggguccuuccgcaccccccacccuccgcaagccgagcucauuguuuguaaauaaagcggcgcgacgcccuuggagcuggggguucacuccgcagcuccucgcuuucgggaggagagggagggggcaugcgugccucucuucccucuuccucuccaagcagcgucucccggggcuguugggcaacuuuccgccucucgccccugcagcccgggaguccaugaugcaugucacgucugggucgcgcggcuggagacccgggacugcggagaagccggaucguuucccccuggaacuuucucucucaug

SEQ ID NO: 18580 - RNA, 4492 nt, Homo sapiens
aucauaaccacaaucauaaucauuauaaaauauaaucaaugcaguuagugagugggggaaacacaccugcucuccuaugauuccuaugcuccagaguuccuuggccuaaagcagccuguauaaggagcuacuuaaucuccagccucagaauaauagucguuaggaaaauggccucucuuucccccaguuccacaaggacucugacuuuccuaggccccgucagcaaucuccucucugcugucuucacauagaaagguuuuaaacucauaacgauaaguaucucagagagguuacaaaaugaccuugaugggaagagaguaaaauccucccuggaaaauuucaacgcagauggcugucuuucaaagaggagaccuuaaaaaagaaagauaaacgagaaaaacuaauaaacagcauaauaaaacauauuuccaaaugaggguugcugcacagcuguaaaaccucauugaagucuaaucgugauaaaagacuuugaaauaauaaaccuagcugcaaauuaggaaugucugcuaauguaguaauuucuaccuaagaggcuuuguguccaaacaugucauuugagacuccaggcagacaaaggaggaugcccuuggaaacagggcugccauucagcccggcagcccgagggcauuggauuuccucacugggcucaauaacauuuucagccacauuaggcaccagcuucagaccuggugggaagcaaauuuaagugucucuuuuagugaaaaacaaagagaaugcuguauuucacaaaagaaagaaauucgaucacucuuuggauuggcagaccuggagucauaaugauuaaauuugacaguagcuugugcuucuagaaguugauuuauuuuacuauuuuaaacuaugggaugcuucaugaauuugcaugucauccuuacaaaggggccaugugaaucuucuccauauuguuccaauuuugguauaugugcugccaaaguaagcacagaaguugauuuuuaaagacauuuuugggcucagaaaacuuaacccaaagguaugaaaugccccagaucuuauacugagcacaaauucuucaacagucuaggaaaaauguuuauccuauucacauuuaucuuuguauuccuagggauacaugaaugaacgauccuauaaacagagaggcagucccauggugcugauagaguaauagaugacucaacucaccaauucauucauacauucaaucauuuagucaauuugaggauagaaacugauggcugccaugugccaggcauuugacauacagaguuagcaagagagaccuguggcaagacacugaaauaggggcaucugggguggggaguggagguucucacaccuguaguuagagaagaagaaaggcuuuugggagcugcagagagaaggaaggaagcuguggguacaggggaggguaugcacuaauggguaaggacaccagauccaagagcagggagaucucugguccaacaaacaaaauauaauuuuuuuuuuuugagucggaguuucgcuguuguugcccaggcuggagugcaguggugugaucucgucucaccgcaaccuccaccucucggguucaagcaauucuccugccucagccuccugaguaguugggauuacaggcgugcaccaccaggcccagcuaauuuuauauuuuguagagaugggguuucuccauguuguucaggauagucucgaacucccaaccucaggugauccugccagccucggccucccaaagugcugggauuacagaugugagccacugcaccuggcuacaaaauacaaauuaaaagacuaagaaaccaaggauugaggggugaauggaaaagauuuacucucaagcaaaggacccuagaccagucuagagucuaggcucuaggggaugaguuuagggaaugugaaauggugucuuuuaaagcuaaaggaucaagaaugaucucugucccaauuuaggaaagcagucucugaguguggcugaggggcuagugcauuagauaacccuuggacuugccagagggaaccagaugugaguguuggugucacucggcucccucuacuguguacaugagguacccaguugggaucauggcauccaguuaggucuacacaguuguuagccggucaugggccaggucaggauuugucauagcaaggacaguagacagaaauugcuuggguggagaucauccuaccccaauaauucuugcucuugcguauauuccgagacacuugugguaggaaaaauccuaaagugaccccauucaugaaauuuccuguucucaucccauggucuaggaauacccugauuaggcuccauuaccuggcaaaaugugguuuugcagaugucauuaaggucacuaaucaguugauucagaguuaaucaaagggggauuuuccaggggcucuaaucuaaucacaaauccauuacaagcagagaguuuuauccaguugauggcaaaaagggaggucagagagauugaaagcauaagaauuugaugcaccuugaagauggaggaggucacagguaaggaccaaagagcagcuucuaggagaugagagugacccauggcugacagcccacaagguagcagggaccucagucucauagcugcacagaacuaaauuuugccaacaagcugaaugaacuuggaagcagcuucuucccuagaguccagccuagccaacgucuugguuuuagccuugugauaccagagcagggaacccagaugggccugcccagacuucugaccugcaaaacugugaguuuaaaauaggugcugguuucaacaccuauucgguguuugugguaauuuguuuauuuuuauuuuguuuuagagaaggggucucacuauguuaugaguuuagagaaggggucucacuauguuauguuuauuuuguuuuagagaaggggucucacuauguuacccaggcuggagugugguggcuauuuucaggcacguucccacuacugaucagcaugggaguucugaccugcuccauuucuggccggggcugauucaccccuucuuaggcaaccuaauggucccucacuuccgagaggucaccauauugaugccaaacuuagugcagacaccugauaagugcagacacuuggcauagugcacuaaggcccagaacuccuggacucaaggcauccucuggccucagacccugaguagcuggggcuacaggugcacaccaccaugccccgcagugauaauuugucaugcgcaauggaaaauuaacacaaccuucugagagucagacauugggcuggauggaauagagacacagugggugcagucaagaaccuuuaauguugugaggacaacaaauguaggcuggcacagagaaaugcaggauuaaaguucagaugaguggggcauggaaaaucacugaaaaaucacuucagagauguucugagaagagacauggggcggcugggugcaguggcucacgccuagcacuuugggaggccaaggcggguggaucaucugaggucaggagucugagaccagccuggccaacauggugaaaacccaccuguaugaagaauacaaaaauuagcugggugugguggcaggcgcccgugaucccagcuacucgggaggcugaggcaggagaaucgcuugaacccgggaggcagagguugcagugagccgagaucacaccacugcacuccagccugggcaacggagugagacuccaucuuaaaaaaaaaaaagagacagggggcaaugggauguggugauaaggauggcaucagggaugagcuugguggcuccaaugauaacauaacccccaacauuuaggugguccuggggccccaaagaugcucuauagagagaugggcacguauagaggagcgaguccucccuuuccuuuuuacaucaaaaucaaugggagaaaaaaaaaucaagaagcgagaauuugguuaaggagaggauauaggacuaaauggcuccuguugcuaaaaauuaaugagcuguucccuaagguguuuauuacagauaccauuaauagacuguauccauuuuccuuuaaaagauguugcuacugcccaauuauccaaaauucuguuucuuuucaacaguauuuuauaaaaagccagcacauuaaaauaaaaggaauguuuaagaacccuggggagauuaagcugucaggcagcugaggcagacccucucuugagaacagauuaauuucuucuuuuuaucucugcacaugcuuccccaggacccccaaaagaugaggaugucagugaagaaaauauuccaacuaccaacuuuuccgcucucugaagggugagagguggggagggguggcagggagguugggcaauggcagaugggcagagggaaaagaagcaaagaagcacugcucacugaacuauggccugagagguccccagaaacacugcucagaagggggccgucugcauccugccaauuagcaucccaaagaccuugauaaauggaug

SEQ ID NO: 18581 - RNA, 981 nt, Homo sapiens
agguuuuuuuuuuuccuuaaugggggaaugauauugaguaaacaagauguaauagcuaggucuuuaaauucuagaagggagaugguguacaaauguaacaagcacauauuguacauacagcagguggucauagccugcggaacacaaaaagauacauauguaagcccgcuaaaggucacgaagguguauaaucgugacccgugcaagggcgagagacgauagauuuccauuccagaugagguaugcuguuuucccagccccguguccucguuccuuuauuguucacagacgugcacuccauugaaagguuuuuaaaaccagacagaaacccccaagucaagcuaauugugcugacacuggaaauaggacaaaauggaaggagcugaaaaaaugucaccauaaccuguuaaaaagguucacuccuguuugauaggaaucugaagacacaaaaauaacacucaaguagcagugaugaccaagcauaagaaacauuucuauuuuauuuuaaauuugauucauugguuaguauuugcaaacugugcugaaaaguuaaaaaaaaaaucucaguauaccucucuacugcguuaacuuccauugaggaagccauuguucucugugaugggagcacuguaugauguaaauugcaaguagcauuuuugcuguuuaagacuuuucauguaaaugacccgaauuauugucucacagaagaguuguuggucuuuaauuucaaacagcaaauuguuuggaauugcacauaaauuggaauacauauuugcauauuuacacacguuuagaaagaccuauguaaucugcaaauuuugccagucacagcaucgcauuuaucagcauuacaagaugaugaaauugaaacccuugucuucuuuuggccugaaaacggugccaguacucuguggguuggguuucagcuuuaccugggcuugauuucauuugaaagggagccuuuuuucuucucccaaagau

SEQ ID NO: 18582 - RNA, 1378 nt, Homo sapiens
aguuuuacaguuuaauguaggcaaaauuaucaauccuuucuuuuugguuuuguccuuuuuugggucuuguccaugaaauucauagaaauauucuuuuauauuuuuucuguuagggaaaaagucuccagugaaaauuccugacaucgugcugugguccuuugaguucucuguuaagugaauuuguaagguuaaagcaguucucaguguggaggugggagaaggggaggcuuuuuucccucccuaggggagaauuggcaauguccgugggacaugcuuuauuguucuuuagugaguagacaccauaggccguggaugcugcuaaacacccuacagugcagaggguagugcaccccccacuccuugcaaagaaauauccaauaaaaaaugucaauagugcccagguugagaaacccuggguuagagaaugauggugaugauuggaucacugaguccacaccagccaggaacacucaggugugaagggcugucagcacuuagauaaguaacacugggccauccuguguuaaacuuggcaaacauacccuggccaagagagacgagucuaucggaggaaacuugacugagugugccaaacagucuaauuuuugcucuaaucacaauaggaggaggaggaagugcugucagugcuuuuuaaucagaucucauuuccaugcuaaugaccccuaccaaggaugauuuguauuaugugcuguuuccaagggcacacaccauauuuucuagucccuaacaaaugaucagcuaauuuccguguuuauuaaaaauuucaugcccucuuuacugaugcaggguaaaaguguguuucuguuuccuccuuuguaaaaagauaaaauuuggccagauuagagccugcuggucuguacaggcugguggcaacggaaucacccaaagagcuuuuuaaaaaucuagguucccaggaucuacuccuggagauuuccagauuggaguggggcuuaggaaucugugcuuuuuuuuuuuuuuuuuuuuuuuuuuccaaaacuuccaaaaggauuccaaugagccacaggacucaaggagugacaggauucguucuacaucacggucucaguugaugacauucacgugcaaauagcaacuucuccaagacaugcacagucuuuggcccaaagucagcuuucuuacgcccaaagggcuucccuaauaggcccccuuugggagccauagucauucuuucaagcggccagguacccuuuggccaaagaucucuuccauuauggguucguccaggagcuuggggcacuugcucucugacagcagccuccauucauuaacggacucaggccaguaccagugcucacucauuccuuuguauguucaagaaauauguauuuguuccugc

SEQ ID NO: 18583 - RNA, 58966 nt, Homo sapiens
gcuggaagaagaagaaucugguuagucuggcgguuucuguucuuuaauucucacauuaggccugaauucagacuaaagccuugaugguccagcccucgacucuccuucaaaauugaaggaagaaaugauguggaguccggcgugccuccccgacccuguuccucuucucagaaugaaaguuuuucuugaacccuuuggauggguuuucgcugcugcuucugguggcggagaggacucuucaucucagagcuuccucugugucacaggcggggagugaagcgugguggucaugucuucaagggauaugaacugggggaaagaaaacagaauugacuuaccaacagugacugugaaguuggguguguucugguuugggguugcuuuuuuguuuuccuucuccuuuaugcuuuucuaugcuuuccaaucucuagaaugagccucuauaucaucagcaaaauaaaauuuuggccagacgcgauggcucacgccuauaaucccagcacauugggaggcugagguggguggaucaccugaggucaggaguucaagaccagaccggccaacauggcaaaagccugucucuacuaaaaauacaaaaauuagccaagcguagugguguaugccuguaauuccagcuacucgggaggcugaggcaugagaaucacuugaaccagagaggcagagguugcacuagugcaagacaagauccugcuacuggccuccagccugggcgaccgagcaagacuccgucucaaaaaaauaaaauaaaauuuuaauguauuuauucaagaugacuuuguuacuuuaaguagcaaagaaauagaauggaguguguggcagggaggagagguaugauguggagaaaguggacuucuagaaacauccucucaggggcaccgagccuggguugccugcucuugcugugcagcaggacccguggagugucaggacaccauggacauucggagagaagcaucacaccugaggguuacacaggcucccacucaacucuccauucccuggccucgagaggauugauaaaguauuuccagaguaucuuggaggauuuauaaaguaugccacgggauuucgcacuuuauauauuaccucauauuguguauaauaaccaccacgucuugaagguuaauuuccccauacacucuaacccacuuuagggcaaugacccugcaguuugucuuccacucccaccuaaguguccaagcuuaaguuaccuuuuccauacugccccaauguaaaaucaagccacacgcuguagcacaucagccaaagaaaaaugaaauugacaugacacgguuggccuguaaauacgagcaugugacaugggcaaaaccuagugggaucgaauuuuauccuugggaaauggguugacaccugccaaguggugggaacagugccuggcacucaguuaggggucaguaauuuaaagcugacacaaggugacugagagugagagagagaaaccugggaagcagauagucuuaaaagucagaaaugauugugcaaggcaagagagucagcauuugguuuugaaaacuguaaaucuacagaagaguuuuguguaggguggauacguagaaugaacauguuguaugucauucagagauugagaaggcagccugccagcaucugagcucuaucucaguaagugacacagcacuccccacagagagaaacuuaggauacuggcacuagaaggagcauuacagaugcucuggccccagaccacuguucugcagauuaagugaugggcucaaaaccauccaggucauggagaguggccaagucugcagcagauucuaggucuuugaccuaccaggccagugcucuuuuucuuuuucuuuucuuuuuuuuuuuuuuaaacagacccgggcuggaauacaguggcacaaucuugucucacugcaaccuccaccuccaggguucaagugauucuccugccucagccuccugaguagcugggauuacaggcaccugccacccagcuaauuuuuauauuuuuaguagagauagguuuuuaccaugugggccaggcuggucucgaacuccugaccucaagugauccucccgccucggccucccaaagugcugagauuauagacgugagccaugugccaggccuguuuuuccuaauagcucacagacucacaggaugaagaacuugccagccuccuccucugaaguuucugaguauguuagauuaguacaggagaccccauuguauagauucauauauauauauauacacacacacacauacauuuacacacauauauggacaccuagacauacacgucaaccccaaguucaaccugauucacucagucacuccugcacucaugcauuuagcauccaggaaaucuugggaugcccacaaaguacuaaguccugagcugauugccagggauacgaaggucagcaaaaccugacacagccuguccuuguggagcuuauuguccagugcaugggacagacauugcauaaagauuuucacaaggauuguguugauuccugauguuauguucaaugcuguggagaagcaccgaguagacgaauacgguccuauuuaccgaagacuccaggugacacuaaggcaggugcuuugaaaacccugagcuacaaucagcaggcagcagaaccuccccuccagcugcuaugaaagcagcuucuaaugaguuaaugagcagccugaggauggagggcgacagggaagguggggggaggcggaggggacacaguaaucugcagagcauuagcagaugcuucagcaggaggcuggggaagcuauuugccaguuggcugcagcuucugaaagagcaggcagaagggucaaucaauguggccuucaucaguucagugaccauauuuuuaaauaauaauaauauuuaaaaaggacauguaaucuaacaguuuuuuuguuuuacaaauuaauuugauaaaauaacuugcacaaacacaaaaauuaaauugaacuuaguuauacaauuauucaauuggcucuauugaaaaaaaaaaaaacuuuuauaugaggucuggggcacauaggagccagaaauaaagaucucagcauuuuagcuugacagggggauuggaagacuauagagccacaccucuuaauuuaauaaggaagaaaggaagauccagaaagauaugugacuuuguuauaggucaugccaauggcaagauuagagaauagggcuccugguugauaauucggugcacuuuuuuuuuuuuuuaauagaggcaggcucucgcucuguuaccuaggcuggaguacagugguguaaucauagcucacugcagccucaaacaucugggcccaagcaauccucccaccucagccucccaaguagcuagaacuacaagugcacaccaccaugccaagcuaaguuuuaaauuuuuuguagagauggggucuagcuauguugcccaggcugguugcucagugcacucuugagugcagcaugccacauacuuugauccauguacuggucagccgcacgcuuacgauacacccaauuaaauacacgaaaagcuccugcauauuguuacuaauaaaagaaaugcaauuuaauacucaauaauauaccaaucuucacccaacuuggagaaguucaaaaaagcaagaaaacuggcaagauuacugggauugcauuaacaggacucaggaggcaacuugaagaggcuucuacuagaaugguuuuggcauuaucaaggauaauaauuggcacggacugaaauacaucaaauaugcuaaaauccaugaguucaaaaugacgucaaacaaacagaaaaacaaugacagccaacaacaagaaaaauaauguuauuuuaggaggaugccugagaaccaacucuguaguuuaaaacuaguuuuuuuuuuuuaaguaaaagcauuuuccugcuuauacuguacaucaaaguuaauaaaaauaguugaugagaggaaauuacuuuuucuagaagcaucccacuaauaaaugaagaggacaugauggaauuagaaugucaccauuuuaucaaacuuaaugaaauaacgaaucuaggaaaugauggucaguaccugcucauaaccaggcacgaugcgccuccuaauggaaguucacauugcccucugccuaugaacuauucuugccaaaaauuccaacuggguuggccagcgcuucugauggcucagcauucucacaaacauggccuuuuuccgggccucugagguucucacuugcuguuuugcaauaaacuccuaacugauccuucagcaucucauagcccuccagccuccucacgucaaaucacgggagugauccauguaaaaugugugucugucugcagcucccagcugcucuaacuggucaggcccugcuguggguugaauugugcccuccccaagagacacguucaaguccuaagcccugguaccuaugaaugugaccucauuuggaauagggucuuugcagauauaaucaaguuaacaugagcucauaauggauuaggguggaccuuaaucagugagugguguccuuauaaaaaggaaauuuagacacagaaacacagaaggaagauggccacgugcagacgaaggcagacauuggagugaugcaaccacaagcaaggaaaugauagagauugcuagcaagcaccagaagugaggggagcuaccuuucuagcuuaucugcagaggauccgucccucauacccuaugucagcuccaccgagucaaucacaguuccucaagggagccaggcucuuacgucuuucugaccuuuguacauauugcucccuucgccaauaaucacugucauccucucugcuacucagaugcccccuggucuuugaaaucuuagcuuucccacuggacagaauuaaaguuuuuaugggaccccaaagaacuugugcccaccucuuccuuuauguuuuccaagcagcauuuuaguagauucccgcaccagacaugagcucugccacaacagggagaacaucugauucuuuccacaaucccaaugcccagcagaguaauaauaauaugaauuaauguuaauaauaauauuaagcagcuaauggaauugugugauuccuaaguuccaaguacuguucuaagccuuuugcauguauugccucaguuaauucgcauaauucugaaucauuauucccaccuuauagaugagaaaacagaggcgcaaaagguuaagugacuugcccagcaucacuuacaguaaacguuggaggugugauucgaagccacucuagauucagaggucaugcuuuuuuuuuuuuuuucuuuuuuuugagacgcagucucgcucuguugcccaggcuggagugcaguggcgcaaucucggcucacugccagcuccgccucccagguucaugccauucuccugccucagccucccgaguagcugagaccacaggcgcccgccaccacggccggcuaauuuuuuguauuuuuaguagagacgagguuucaccguguuaauccaggauggucucgaucucccgaccuuaugauccacccgccucggccucccaaagugcugggauuacaggcguaagccaccgcgcccggcaggucaugcuuuugaccacugcucuacggccucuccagaggugaguaguguaggugaccagaagauuggauggggauagggaguaggaaguagggcaugaacaaaugaaugaauaugcaauaccuucucuuccuaaguguuaauauguaaaucuaaccaauccaugguucuuuguuuuucagguuaccagguguaaaccccagaguuggaagcacaauuugagaaugcagguaagcgacgcugaauggaauggcaagggaacccagugguuucugugugaucugugauucacccacguaugaauccaguuacugaaauugaccuuuuguccacagugcucucuuccggauuccaguggccaugcuccugacuccucgauuuuuaucucuugcaccuuuuuucaccuuccugcccuugacaacuguucaguucuucuuuucaagcuugcugaacugcauucuacuuaauuuggaccuaauucagcuuuguucauuuuuguuugaguuuucaacaagauauugacuaggucuauuagccugguguuuucucaaaacaauguaugugcauuuuaaaguuuuuaguauccagaccauuacugaagugcuacaaaauuaagacaccauuagcaaccacccacuaaccccacaauagcucuuggagaacuaccauuugguguguuuuuugcccuugcucuuuauagucuuguuuugaaaauuaugguacaauacacauaacacaaaauuuaccauuagugacacuuaguacauuggcaguguugugcaaccaucaccacuaucuaguuugggguuuucaucaccucuaaaggaaacccuguacccauuagucagucucuccauucucuccuccccgcugccuuuggcaaccaccaucugcauucugucucuauggauuugccuauuuugaauauugcauauacacggaaucauguaauauguggccuaacaugucuagcuucuuucacuuagcauguuuucaagauuuaucccuguuguagcauguaucaguacuucauuccuuuuauggcugaauaauaucccauuauauggauagaccacauuuguuuauccuuucaucaguaaaugaacauuugggcuguuucuaccuuucguuuauuguguguagugcugcucugaauauuuauguacaaguuuuucuuugaacaucuguuuucaauucuuuuggguauauucccagaaguggaaauguucuaagugaguaacuauguuugcauuauugaggaacagccaaacugguuuccacaguggcugcuccacuuuuuauucccaccaacaaugugaaaagguuccaguuucuccacauccucaccaacacuuguuauuuuccuucucaaaaaaaguauaaccauccuaguggguguaccaugcagucuuuuuaaagcauagauaucauucuugaagugcuucuucaaguucacguacgcaugcagcauucagagauuuuguaaaaguauagauucugcugcagccagucugcggugggaucugagaucuucccggggguggugguucugcugguccacuagauuuguggagcagcagagaucacauagaaagaugauagcagccuuugcuugaaacccucuggucacuucccacugcaguuagaauauacuucaaaccccuuuccaugguuagcagguccuugucaauccuuccagccuccucugccuccauucucccacuucugaccacacucccuucauucugggcuucucuucugcuccuugaacaugccauguuuuucccgccacugggacguuacauuguugucccucugccugggacucucugcccccgaucuucacugagcugccucuuuaucccucaagcuucagcuccaaugucuuccccaccaaaaggcuucccagagcccucuaccuaaaccaccaagguuuccugccuaccagucucucuaucucaccucucugguuuuuguuuauuugcuuuuacagcacuuaccaauaucacaauuugaaauuuuauuuuuaaaagcuuguccauaguuuuauuguccaucucuccccucuggcccauaagacacuaugacgccaaggccuuguuuuucucauucauugcucuaucccuaaugcgaaaacagugcuagguucuguucaucuaggugcacaauaaaugcuuauucaaugaaugaaugaguugauuacaguuucaggacuuccucuugcauguccccaugguuuucagauauggccauguguaucuaaaaugucacccagagaauacuauauugucagaauuauagacauggaacaccuucccaaagacuuccagaccauugaaacagccaucagacaaacugccacaguuuaacucagccuaccaauuggcuucuucauugucugcuuccacaucuacuuuucccaccagguuuuuuguaucuguuuauaauuacucugagaaaggaaaauaugaugucccuucuccccgugcugguucuguuuuccuuuguaagcacacagaacugugugaacaucucagaugagcaucauagaguuuuucucauaagcccaucuaauaagcagcagauuucccugacuucuugcgucuucauuauauaaggagguauuuuccauuucccuugguggagucuguaucucauuuucacuuuuuaccuuugggcuugaaaacucuaaauuucuuugagguuuguuugggacucugcccugccucuugcucaucugucuuauuuggguuucaacucaccagagcauuuugagcuuuauucuaucagauagauuuccuuuugucuuuuccacuuuuuguugacguuggguguuuauuucuuuaucauuaauauaguuuccuacauaaucauccauagauccaaauaggucccuucagccuuuauacuucuauuccagagaauuuuaagaugaguccccuacaacugugaaagcaguccuuuccccauuuaguuucagauuuaaagugaaucaucucuuuccauucccuguggucuaaaucugaucaguuuagcaucacuugccuuccuuacacccucaaaucuguccugauggaagaauuagcucaaaagggcaugcaccucaucagaugcugaaaacacaccacacuggucuuauuuuccuggguaagaaaucauagucagucuuugccaaaaugucuuugcuuuuuauccuuuucugccuuaacccagaaguucaauccucucugcuuucacuuguuucuugaguuggugauuaugggcagccauacauuggccuuggcgauaaaucauuccggcuccucuuucuuguugcucgauauccaggaauguacuguaccagaugaauguccagcugcuuagacgucacucuuauuuauugcacuuucaugcuggcuucucugcauccuucaguagucuaugagcuccuucuggcagacacuguauuuuauugaucuuuauuucuccagcagcuagcauagugcucaccucacaauagauucuuaguaaauauuuagagacugcugaaugaauaucccaugaucccuuaccuuacaagccgagagacacaauacccagguacacaagacucuuaaugaacauggaaagagaacauacagguaagugugcagugugguucaguaaguguucaaagacaggaaauaaauaagagcucguagaguuuuagaaggcuuuguagagaauguaagaccuaaauuugaccauuagaaaaaagagagcagcauugaggaagugacgagggcgcuuaaauuuuccacucugucccucucaaguuuucucaugggaaugccuuuguuuuucuuuuccucuuaucauagcaucuccgucacugggucaccugcagucuucucuuccaccuuuaccaaccuggucuaaaaauccucuuauagugcuucucugugcaacccuaucuuauuuuuuagcccagcauggaguaucaagggcucugauggacaauacaaguuuugucuccucuuccgaaacucccuugggccacucucacagccuaguguacuaacugaggcugccccucaggaaaaaccagguugugggguaauuaggucauaggaaacacugaaaccagaagauucagcuggagacuaggcuaaaauucauaaauacagauuggccuggcuugaacucacaauaggcuaauuuuagaucuguggauuuggucuagcagaacagugacaauuauauccuuucucuaaacguuuugccuccacuggcuuuggaagcauuucuuuucuaucacugagucauucaauagccauauaauuguuauguccauuucccuggcucuaacagguuugggagccaguuaccuuucccaguucauuaaccgacuggccuucgcauuaacagccccuccaucggggguugccuuggagacaaagcuuccuguggguaauccaagauuaucuagcucuuuguccuacaugugacccuuaauuacuugcuaaauuagaaugguuuucugaaaaucacaagcggagguuaauauguucuuccagagcuggucaagcuaagaugacacugaauucacagggaauucaaguuacaugaucccugaaggcgucucuuugaguaagaagaugaacucucccccugggaggcacugcccccccauaaagccccugucacucacugucccuccgccugcuuuucuaguugugguuuaaucuucucaggacgauucacuaugucaauauugagcagauucauucuggugcaggauccuguauccauuugucuuugauaacuaguugcuuuaaauuugaguacauauuuauaucauaauugcagguuuuuacucuuuauuuacacaauuacaaggcuucauguacccaugugggacaggcaagggaacugaagaagcuauuaaaauacagaaaguaaacacuuuggguaaaagaguuugagcacuagaguguccuuccuaacauuugauaggccucaaagggagauuaguagaaaggggaacucuuagaaugcccuuaaugagcugccucuucaaaugcuuuuuggaaguaaguucuauauaaguaaugcagauauugaaugagaauuucauuagcaaucauaaauguagcuuuacuuaagauguuuaguuaucuagacuauaaugaagcuacugaguagaguuccagaaguuaaaaaagaaaaaaacagcaacaacaaaaaaaaacacugucuuaaaauuuaaaauauuauggacagaucucaacauuaaaguaucaaacuaauaaugguauguagccuggaaucucacagggauccuuccaaaaaguguuuaggaaaccaaacugaaugggcucguguuagaaauaaacauaaucggugauuuaacaccucaaaucauucacucagauuuccgaaggagucguuggcagauugcuacaaaccuauucaauccagaggcuugacugaguacguauaaagcuuugaguguuugugguuauauucaacugugugccaccuuuagaaauauuuaagcaucuaugguguauaaggugucauauagcccccauuuuguugaccuguagucaucuaaguagaaauuagcagagaaguccuaugaaaaucacuuuaugacauuuggucacaucuaucauuacauauguguagcaccagaaaauugacucugccuguaacauacuuaaauuagcaucagaguacauuucuuuuagaggaaauuuugguaaauccuagagugguuaccgaggaaaacugagauugucuuugauauuguuuuaaaguaguuucauucagcauuuucugaaguaugauucugaagauaaaaguccugcagcauguuaauaaguguuacacaaaaaggauucugugauuaaauaaacuaggggaaauguuguauuaaaacgaaguuacuuuuuuaaaaauuuaauuaauuguuaccacugaagaauuuccaggagcuuuuaacacuuaaacgugcacuaugaaaauucaagucuccuaaauguauuuacuuacauaauuuccguucucauaguaccccauagcaucuccuggaagcagcgaguucuaagcagcacacucugggaaacaccuuuauauauauuucuuagccugcuuuggcuaauaggugcagauauaaccaauaaaaaaauugaugauucaacaucccaauaucacacccucaaaaccuaacuucaaaaagauuguugaacuccuuguucaauucuuuuuuuuuuuuuuuugagacgaaucucagucugucacccaggcuggagugcaguggcgcgauccaggcucacugcaaccuccgccucccggguucaagcaauucucugccucagccucccaagugacugggauuacaggcaccugccaccaugcccgacuaauuuuuuuguauuuuuaguagagaugggguuucaccaucuugaccaagcuggucuugaacuccugaccuugugauccacccaccuuggccucccaaaguacugggauuacaggcgugagccacugcgacuggccuguucaauucuuuugauaguuuaugucuuucuguuaauucagugauuucuacuaacucccaccuauaggagauuguauaauuacuccaaauauuugcugccccucccugugauuggauuauaugucccugccccauugcugucaugugaccucuuugggccaacagacugugaauaaaaaugacaugugcugccucugagcagaagcucagcagucaugguguggcucugccauguucuuucuucugccugagcagcccuuccacuucauuuggcugcuucuuuacuugugucccagaaggaagauguggaacaaagccucacuggcuugcaaucaacaugucacauguaugagaagcauaggcuugugcucguaagccaccacuuccuguuccccauucagcuccuucccaggaacaagggagauagugaugcuccuuccgaggaauagaugaugcuuuuccugccucauuaccuuuacucaugccguuccccuggcuggaagcccccuccugacccuggcugucuuuaaaacucgcccucaucuuuuuaaagcucaacugaaauaucaccucuaugauaaaaacauuuuugaucgccaccccugccaagguagcauugaucauucucucucuuuuuaugcccccacuguacccuguaccaauuuccaaauuuccgggugcaaagcuucaccugggagcuuguugaugagaucccugcgcaccuuguccuacuccaguaugguucaguggggucugggguuagggaccaggaaccuggguuuuaaguaagcaaucccaugugaucugaucagucuguuccaaggacacuaccuugagaagcacugucacuggaacaccaacagcaccuuuggcacacuuugguuugcauaccugucuacaucuacuagacuguguccuccaagcagaaaccaagucuugugcagccaaagcuccuagauuggcucaugguaaagucucaguaaaaguuaagugaaauacacaccacaauuugucaaauugaaaacuuucauacuaucaaggaucaacagaaagauaauugcuccuuuguaagcagaacacacuaaaauaaagcacaacguaaugccaccccuaggaaucaggcauauuuuuuccauauauaaauagacuaucauugucaacaagcucuucuguuuuucacuuuucccuagagaagcacagucuaugagcucccuuaguaacccauuccaauauuuugccaccauuuuuuuaaauaggcaaugcuuucuuuaccugaacuuaauucugaaguuuuaaacuacguaucucauucaggacuuaagcagcaaagauaaggagugauuuucauaacagagaauguuucuguaaggaaucaguuuuaauuuugaaaggacuacacugagacggugucauuguaguggcuguuuauaguuaccucccugcagagugaggucaggccacaaagggugugcugguuagagaugggugagcaugaacaauuggacuuugcugauguugcuuucacuaccaguccaacaaacagguuuuaccaagaauacaagacauaagaacucaaaugaaugacuacagcuucccaguucucccuaagcuccucaugcauauauacaugaagaucagcaaucugugcaacccuuugggaacaaagauggcacuagccagagagucucacuaggacagagagucccaagagcuucaggugagggagggacuacuccagcucucaaggauuuacauaccaacauagaaaacauguccugcuauacuuaaguuaccugcuuuccuguucuauuucucaagguauuauugggccuaaggcaggccuaucucaucuuccuucccaacaguccuccaguuuguguuuggagauccgugaaguuaagaaaggcuaucguuaaccuuguacaaaaggaggagcaaguaaccuuggccaagucagucaucacauucuauuccccugccuucgugauuauuucagggaaagacacaugaucuaagcaguccaugaagagugaacuucagaacauuuuagggagugauaagucaaucugcucuuucuucguuagauguugugauguagagaugcgaagucuggaagugcuacagucauuuugcuaucaucagagugugccuggagaugaagcugacacauggaggaaagcagaggcugaaacucugauccaacuguaccugacgcugagcccaccucaagucuuuuuuacuuauaugagccaauacccuuuauugcuaaagccaauuugauuuggguucucuauauugccacuacaaucacccaaauugguauaggucuuaaucccaacaaguggaacuuuguuuaaaacaggaugcugucagaucagguaaacuccucaaaguaugaaauguuacauaggagaucuggcaagauggcugaauaggaacagcucuggucugcagcuccuagugagaccaaugcagaaggcgggugauuucugcguuuccaacugaguggugccuggaaccccagcaagacagaaccguucacuuuccuggaaagggggcugaagccagggagccaaguggucuugcucagcgguucccacucccauggagcccagcaagcuaugaaccacuggaaugaaauucucgcugccagcacagcagucugaagacaaccugagaugcucaagcuugguggguggagggguggccgccauuacugaggcaggaguaggagguuuuccccugacauugcuaaggaggcugggaaguucgcacugggcagaacucaccacagcguggcaaagcagcugcggccagacugccucucuagauucuuccucacugggcagggcaucucugaaagaaaggcaauagccccauucaggaucuugaagauaaaacucccaucucccugggacagagcaccugggggaaggggugguugugggcacagcuucagcggacauaaacuuuccugccugccagcucugaagaaagcagaggaucuugacaaggaggauucucuuagcacagugcuagagcucugcuaagggacagacugccuccuuaagugggucccugacccucgugccuccugacugggagagaccucccagcaggggucgacagacacuucauacaugagagcuccugcuggcaucaggcuggugccccucugggaugaagcuuccaaaggaaggagcaggcagcaaucuuugcuguucugcagccucugcuggugauacccaggcaaacagggucuggauuggaccuccagcaaacugcagcagaccugcagaagaggggucugacuguuagaagaaaaauuaacaaacagaaagcaauaacaucaacauuaacaaaaaggacccccacacaaaaacccauucaagggucaucagccucagagaucaaagguagauaaauccacuaagaugaggaaaaaacacugaauaucaucaucuugaggauaaauccacuaagaugagugcaaaaauucugaaaauuccaaaaaccagaaugccucuucuccuccaaaugauggcaacuccucuccagcaagggcacaaaacuggauggagaaugaguuugacgaacugacagaaauaggcuucagaagguacguaacaacaaacuccucuaagcuaaaggagcguguucuaacccaaagcaagaagcuaagaaccuugaaaaaagguuacaggaacugcuaacuagaauaaccaguuuagagaagaacauaaaugaccuaauggugcuaacuagaauaaccaguuuagagaagaacauaaaugaccugauggagcugaaaaacacagcaugagaacuucguaaggcacacaauacccaaaucgaucaagcagaagaaaggauaucagagacuaaagaucaacuuacugaaauaaggugugaagacaagauuagagaaaaaagaaugaaaaggaacaaaugaagccuccaagaaauacgggacuaugugaaaagaccaaacuuacgacugauuaguguaccugaaagugaugggaagaauggauccaaguuggaaaacacacuucaagauauuaucuaggagaacuuccccaaucuagcaagacaggccaacauucaaauuccacaaagauacucugcaagaagcagcagauacucugcaagagagcaccacaaagauacucugcaagaagagcaaccccaagacacauagucaucagauucuccaagguugaaacggaggaaaaaaauguuaagggcagccagaaagaaagguuagguuaccuacaaagggaagcccaucagauaacagcagaaacucugcagaaacccuacaagccagaagaauguggaggccaauauucaacacucugaaagaaaagaauuuucaacacagaauuucauauccagccaaacuaagcuucauaagugaaggagaauuaaaauccuuuagagacaagaaaaugcugagggauuuugccaccaccaggccugccuuacaagagcuccugaagaaagcacuaaauaugaaaaggaaaaacugguacuagccacugcaaaaacacaccaaaauauaaagaccaaugacacuaugaagaaacugcaucaacuaaugugcaaacuaaccagcuagcaucaugaugacaggaucaaauucacacauaacaauauuaaccuuaaauguaaaugggcuaaaugccccaauuaaaagacacagacugguaaacuggauaaagaaucaagacccaucaaugugcuguauucaggagaccaaacucacacauaggcugcaaagacacacauaggcucaaaauaaagggauggaagaauauuuaucaaucaaauggaaggcaaaaaaugcagggguugaaauccuagucucugauaaaacagacuuuaaaccaacaaagauuaaaaaagacaaagaagggcauuacauaaugguaaagggaucaauucaacaagaagagcuaacuauccuaaauauauaugcacccaauacaggagcacccagauucauaaaacgaguucuuagagaccuacaaagaggcuuagacucccacauaacuauagugggagacuuuaacaccccacgucaauauuagaccaaucaacaagaaggaaaauuaacaaggauauucaggacuugaacucagcucuggaccaagcagacguaauagauaucuacagaacucuccaccccaaaucaacagaauauacacucuuagcaucacauagcacuuauucuaaaaucgaccucauaauuggaaguaaaacacuccucagcaaaugcaaaauaauggaaaucaaaacagucucucagaccacagugcaaucaaauuagaacucaggauuaggaaacucacucaaaacugcacaacuacauggaaacugagcaaccugcuccugaaugacuacuggguaaauaacgaaauuagggcagaaauaaugaaguucuuugaaaccaaugagaacaaagagacaacauaccagaaucucugggacacagcuaaagcaguguuaagagggaaauuuauagcacuaaaugcccacaucggaaagugggaaauaucugaaauugacacccuaaaucacaauuaaaagaacuagagaagcaagagcaaacaaauucaaaagcuagcagaagacaagaaauaacuaagaucagagccgaaaugaaggagaaagagccgaaaugaaggagaaagagacacgaaaaaaacccuucaaauagaucgaugaauccaggagcugauuuuuaaaaaacauuaacaaaauagacugcuagccagacuaauaaagaagaaaagagggaagaaucaaauagacacaauaaaaaaugauaaaggagauaucaccacugaucccacagaaauacaaacuaccaucagagaauacuauaaacaccucuacgcaaauaaacuagaaaaucuagaagaaauggauaaauuccuuuacgcauacacccucccaagacuaagccaggaaaaagucgaaucccugaauagcccaauaauaaguucugaaauugaggcaguaauuaauagccuaccaaucaaaaaaagcccaggaccagacagauucacagccgaauucuacuggagguacaaagaggagcugguaucauuccuucugaaacuauuccaaacaauagaaaaagagagacuccucccuaacucauuuuaugaggccagccucauccugguaccaaaaccuggcagagacacaacaaaaaagaaaauuucaggccaauaucccugaugaaugucgaugugaaaauccucaauaaaauacuggcaaaucgaauccagcagcacaucaaaaacuuauccaccacgaucaagucagcuucaucucugggaugcaaggcugguucaacauacacaaaucaagaaaccuaauccaucacauaaagaaaaccaaugaugaaaccacaugauuaucucaauagaugcagauaaggccuucgauaaaauucaacaccccauucauacuaaaaacucucaauaaaauagacauugaugcaacauaucucaaaauaauaagagcuauuuaugacaaacccauagccaauauuauauggagugggcaaaagcuggaagcauucucuuugaaaacuggcacaagacaaggaugcccucucucaccgcuccuauucaacauaguauuggaaguucuggucggggcagucaggcaagagaaagaaauaaaguguauucaaagaggaagagaggaagucaaauugucucuguuugcagaugacauaauuguauauuuagaaaaucccauugucucagcccaaaaacuccuuaagcugauaagcaacuucagcaaagucucaggauacaaaaucaaugugcaaaaaucacaagcauuccucuacaccaauaauagacaagcagagagccaaaucaugaguguacugccauucacaauugcuacaaagagaauaaaauaccuacaaauacaacuuacaagagacaugaaggaccucgucaaggagaacuacaaaccacugcucaaggaaauaagagaggacacuaacaaauggaaaaacauuccauccucauggauagaaagaaucaauaucauauaauggccauacugcccaaaguaauuuauagauucagugcuauucucauaaagcuacauugacuuucuucacagaauuagaaaaaacuacuuuaaauuacauauggaaccaaaaaagagccuguauagccaaggcaauccuaagcaaaaagaacaaagcuggaggcaucaugcuaccugacuucaaacuauacuacaaggcuacaguaaccaaaauagccugguauugguaccaaaacagauuuauagaccaauggaacagagcagaggcgucagaaauaacaccacacaucuacaaccauccgaucuuugacaaaccugacaaaagcaauggcaaaaggauucccuauuuaauaaauggugcugggaaaacuggcuagccacaugcagaaaacagaaacuggaccccuuccuuacaccuuauacaaaaauuaacucaagauggauuaaagacuuaaacaagaccucaaaccauaaaaacccuagaagaaaaccuaggcacuaccauucaggacauaggcaugggcaaggacuucaugacuaaaacaccaaaagcaauuacaacaaaagccaaaauaaacaaaugggaccuaauuaaacuaaagagcuucugcacagcaaaagaaacuaucauuagagugaacaggaaaccuacagcaugggagaaaauuuuugcaaucuaucccucugacaaaggucuaauauccagaaucuacaaggacuuaagcaaauuuacaagaaaaaaaaaaaaaacccugucaaaaagugggcgaaggauaugaacagacacuuaacaaaagcuaaaauugacaaauuagaucuaauuaaacuaaagagcuucugcacagcaaaagaaacuaucaucagagcgaacaggcaaccuacagaaugggggaaauuuuuugcaaucuaucugacaaaggucuaauauccagaaucuacaaggacuuaaaacaaauuuacaagaaaaaaaaaaccaucaagaaagaaggauaugaacagacacuucucuaaagaagacauguaugcagccaaaaaacauaugacaaaaagcucaucaucacuggucauuagagaaaugcaaaucaaaaccacaaagagauaccaucacacuccaguuagaauggcaaucauuaaaaaguuaggaaacaacagaugcuggcgagacuguggagagauaggaacgcuuuuacacuguuggugggaguauaaauuaguucaaccauuguggaagacaguguggcgauuccucaaggaucuagaaccagaaauaccauuugacccagcaaucccauuacuggguauauacccaaaggauuauaaauuuuucuacuauaaagauacauauacacguauguuuagugcagcacuauuuauaauagcaaagacuuggaacaaacccaaaugcccauuaaugacagacuagauaaagaaaauauggcacauauacaacauggaauacuaugcagccauaaaaaagaaugaguucauguccuuugcagggacaugaaugaagcuggaaaccaucauucucagcaaacuaacacagaaacagaaaaccaaacacugcauguucucgcucauaauugggaauugaacaaugggaacacauggacacagggaggggaacaucacucacacacuggggccugucgguggggguggggagcaaggggagggagagccuuaggacaaauaccuaauacaugcagggcuuaaaaccuagacaauagguugauaggugcagcaaaccaccauggcacguguauaccuacguaacaauccggcacauucugcacauguaucccagaacuuaaaguaaaauaaauuuuaaaaaaggagaaauguugcauagaccucagggaugcuuggaucccaguucuaugaaugaaauguuauauaggaacucaaaaucacagaggauaaaaaagaauauuaggucauuaacagcucaccauggauuagguuucuggccuuucauggggugaagaagaaugcuuuaggguccugggugucuagagcaacagauaauaaaaacuaguagacuugcugacucuuaucuaucaacaauguccaguugcuuuaccauauuacacaugguaaauauucacaaugggaucgugcucuuucuuuguagccauuuuuaauugaacccugccaaagggcuucaacuggguucaauauuuuaauauguuuacuuuuaaauaucugaaguuaauauggaaagcugcuaaaauguuugaaacaggauuguguuucauuaucucugugauuuccuucaaguugaaaacauuguaaaaucaaaaaaaaaaacacaggagucuugccuucagcauuuaggugaugcccuacugaaaagggugucuuugaugcuuacaaaguuauuuaauuauuuauuuauuuauuuuugagacaaggucuggcucugucacccaggcuagagugcaguggcacaaucuuggcucacugcaaccuccaccuccugggcucaagccaucugcccaccucagcuucuagaguagcugggacuacaggugcgcaccaucacacccagcuaauuuuuuguauuuuuaguagagaugagguuuugccauguugcccaggccggucuugaacucaugagcucaagcaaucugccugccucagccucccaaagugcugggauuagaggugugagccaccacaccuguccagaaguguuuuaagaggcagaaagacacugagaaaaaugacagcuugguugggaucaaaccuucuaaaauuugugauaauaugauuaacucuuugcuccucuuuucugugcuggcaaaaggugucuaggaugccagacuaauagaacugucucauuuuuaaaccaaauagacaucucauagcacaugcugauacugucuugggagagcagaaggacaaggagcagauugggagauugggagacaucuauucuucuuuguaacccccgcuugcugagggagcucuaaggaucaacggauuguuuuuuaauaauugguuaucaauuccaauuuucuuugacucaagugauuaaagguauuugugaaguguuauucauaauagcaaaaacuggaaaacaauucaaaugucuguaugagauuaaauuaugauuaugauauguuucguacaaugaaguacuaaaaauaguuaagcacuucuagggcugcuaauauagcaccugucuuaaaguuagaaaaaggcacuuccuccugauggauguaguguggcagacucacagacugagggcugauuuccaccuccucuugucaccuuggacaggcaucccugcucuggacacaaucauacugguaguacuagguagauccaugcuuaccuuauagaaagauaacuacuuuauguuauggaaugaaauauguauaugccauacauuuauaucuucugauccuauuuuuaaaaaucagagcguauauauuuguaaaugcacagaauagaaauucucuggaagguuggguaucacacuacuaaucauugguugacuccaagaagugggauuggaguuggggagggggagagaauuguuuuuacuuuauacaguucuccacuauuuuaauuuuuauauuagcauauuuugcauuugugauuguaauauauuuuaaauuuuauugguaaaaauuauaaacaggacccuaauuaaacucauuacugaaaagaauuuaaacucuucacuuuguaacucugccuugcaguuaugcacuauacuugaagagaaaauaaugacuccauaaagucaugagaagagaugaguggagugacuguucuacauagugguucaguacaccucuguguucgucuuccuuagaaaccucauauauuguaucccuguugguugaaaacugauuauuugaucuauggcauaaccuugaaccgaaaagucuuuguucuuaucauauaauuauauccuucuaacuuggaucacuacugcauuuuguaauccuaauagauaaucuauaaggcacgaucauguucuugauuaacugugcaggacacacuguugguuauauuuggaucuuucauuucugccuuccuccuucugaacugauccccaguugaguucauacguucacuccccaucacacacacauaacccuugugacucaggggaagcuaacuccauccccaguucccaggguagaucaggauuugucuaacuagugauucucagagugugguccccagauaagcagcauuaguaucaccuggagcuuguuagcaauacaaauuauuagacccuauucucaaccuacuaaaacuagaaaugugggucucagaaauuuguguuuuaaccaacuccagaagugauucugaaugauauuagaguuugagaaccacuguucucaaucaaggcugguaaucuuguacucuuuaccagcaacugauucagugcuuggucuuccccuggcuacgguuaauguuccaaagauggacauguaaccuagauugaccuaaucagaaugaaaggcagaaauuuuauccaaggaugaaagagauuuucugucucucccauugaaccuaaagaagaucugacaucuuagaaccuugagagaagcuaaccugaggacaaagucaaugugagguagaaccagaacuucucaaagauagagagaaccuagucguaacugccugggcccaguccuaaucuaauuuacaguucagugagauaacagauuucuuuauuguuuaagccacuuugaauuggggcuuuuuuugcccuugcagccuaaagcauucaacuuauuaaaacacauauaauaauuuucuaacuguucaaaguuaaaucugaauuccccaagcaaguuguauuccuacugccuugccucuaguauagcgguuuuaacacuuaauugucugauguugugaauaagaacaaacacaugugaaugaaugaucaugcacugaaggagcaggcagacaauaucguuuucauuacucuuaucaaauacaauuuauucaaagucauuaggaggcuccaaaaauaguuaauccacuaaugcaaacaaugaauuggcaugguaaccuuaguuuuaacacuauuuuugcuguaacuaagugaaauucuuuccagcuagcuuaagcaaaacggaggucuauuuuaagacuacuggaguggcucacagaccauggauuuuaccccaacuccagccaacaauuaugugugccauugaugaggggaguguaucugggucaaagaaaauugaaauugaucaccaauuaugaaaaaacaacccauuaauccacagggcucccugugaguaggaagaccagaaagaaaagauaucucccaaucugcuuuuuggcuucuuauucacuccagagcaaaacaccauucugugcuaugugcuagaagacauccauggguuuuauaaaugggacaggccugucaaucuucuggcauuugggauacuuuuugcuagcacagaagaggcuggcaaugagucauggauauugccagaagauaguuauaaggaaucaggcagcaaaccaagcccugguacugccacuccaucucuccagcucugugcagggcccaaugguguguugagggacccucauaauuuuuauuccccucccaauucaaaaaucugagcuuaauuuuuggaaauugccucaggcacuagaggguaguaggaaaucccuccucauuguguuguacaaaauuugcaauacgguauugcccugaagguaaaacaucacuuaauuguaaggaauuuccccuacauggauuacuucaaaaacacagauuuuaaaauucacuggcccagaguuccuggggccuggaguaaaagcauucugauccuugaaacuucaguuugccaggcccaguuucucaauuucgcuauuuguaaaauggucuuaucuaacucaaaccgaaaagcucucaguucugaaggaaaaaugcuauaaaauuuaaaguuuaacaacuuagacaaaacaacaagcaagauucccagacaugacacacaaaaaacccuuacgggggaaaauaguaaauugagcuauauuaaaauuauaaguaucuauucacuaaaagacaacauuaagagagugaaaagucaucccacgaagugggugcaaauauucgcuauauguauauauccaagcagagacagguauucagaauaaagaguuucuacaagcuaacaaaaaaagucagacagcugaagcccucacauacugcugauggcaguguaaauuagcacaaccacucugaaaauuuggcaggaucuacuaugacccagcaacucuacuccuaguuacauacccaguagaaauuuuuuuuuauuauacuuuaaguucuaggguacaugugcacaacgugcagguuuguuacauauguauacaugugccauguuggugugcugcacccauuaacucuagaaauguguguuuuuuaaaaaaaaaaucuggaugcugguugcaugggagguauucauuuugggaaaaauucauugaguuacauucuuaaggcuggcauaauuuucucuauauaauaugcuucaauaaaacaguuuuuuuuuuaagaaacagcuucacagaacauaaagauuuacauuuaugguucagcaaaauuacaaauauuuacuuguauuaugcuugaaauucaggucccucaugaguucaaaucaugcguaaugaauugaaaauacuuaauauacauaauguuuaacauaaaacgguucuuaagauugaaggcuucaaugauagaauggcuggaauugaaaccuaccucugccacuuacugugugacauugggcaaauuauuuaaucuaugcuucuguuuccucaucuguaaauggaaauauuaauggcaucuaccuuagagggcugcugucagcauucaauaaguuaacauauguugaaggcuuagugcaguuacacacagaaagcacucaguaaguguuugccauuuuuauaacauuaauguuuguuuaacaaauauuuauggaaucuucacucugugcaaggcauagagcugguugccagagcaaugagagaaccaaagaaaauaaaaugauuaaauccuauggguugaaaaccauggagaguccagggcaaugacgcacauacaccauacaguggauaaauguuuguuacugcugcugcugagauagcaguaaguaugguacuuucauuuaaauuacaucucgagacuagcaggcggaaagccuuaaauccauauucaacuugaagguuuuauuugagcacuagaaagagauuuaacaguaauggcccaugaauccgaagaugggauucaacuuccaaaacugggaaguuaaugaaaaauaaguuuaaguaaugcggguauugagucccuagggcuaguguggcguucauguagcccacacgaacagagcuaauaaaaagccauguguaaaaacaauauaaaucauacugcuguuucuuggacuugaaaaacucaucaugacacauuuuugaaaaaacaaaacuuuggauuaccaugaauauuuugacgauauuuuuuccuaagcaagggaaagaggaguccccuuuaaaauauagaacguauucauugaguggaagaccgauccuauaucaaauguccagguucuacagacgccuggguccauagcacauuaucccucucaccaaaaccaaaccaaaccaaagucaguuucauuugaaugcacucuugccaugguuucaaaauuuggaaagcucuuggaauuaaauuuugagauguaaaggcuggcugacaaauucacagaaacccucuuuccgacaccaacuuauaaauccuaaggcauccuacaaccccgugggugcugguuucuaguuugcaacgcucuaacauagcuugguagagcucagugggcugggaccauaagcauucgggauugugccacugaaaaacugaugucacaucaaaaggaacaccuuucuucuaauauacuaaaaagguuuuguacaggcuggguccagaggucuuagggcuagccaauuccugcucccagguauucuaagaagccggagaaagcucccugcagguaaggacccaucggcgcuucccgcacucugccgcgcgggaagcgaagguuggaguccuuuccccacccccggagggugggcggggccgaaggaccgcaccgccccagacccgcccccugcgcguggccccgcccacagcugcuccuggccgugcggccgcgcggaaagcggaggccgggggcggggcucaccccuugcccuugggggucccccgggcucugccaaucagcgagcgcccuguuggccauccgcagccauccgcgccccucccucucccgcccuccuccgcguuccagaauccaagauggcgggauccaggcaaaggggucuccgggccagaguucggccgcuguucugcgccuugcugcugucacucggucgcuucguccggggcgacggcgugggaggagaccccgcggucgcguugccacaucgccguuucgaguacaaauacagcuucaaggggccgcaccuggugcagagcgacgggaccgugcccuucugggcccacgcggggaguaagccggagcagagggcugggggccggguuccucucccccuucugcugccucuucgccuuucauccgcggcuacccuggugugcugagguucccguuccagcagcugcacaccauaugcgcuguggaggggacccuccuggcagccccuccgccgggucccuccugguucgcacgguucccuccgcuuguccccgagucuuucccucacccauucuguucucucucacccgccugcugucuucccuucuuugaucucgucgguacuuuccguuggaucuagagguguuugguuaccuccuacacuuccuagcacucaaacuugcuucuagguaucauguuucacaacgccacgucucuaggagaaaugugcccuacccccagccaucccaaccugagacauguucuagaagcccccuuacuuccuuucccgcuuccaccccccacccccgauccccgauuucuuugcuccgguguuagcaaugguuaaugcuucgcuugaaccccaugcccacugacggcuccugagauggcauauaguaguauuagaguaauuuuuuaagucuuuguaugucagaagacauucuuauacuguuggaacuacacauuuuccucucagugacuugguguggucuuugaucuuuucucucguaguaacacauuauguaacuuuuuaggagaagggauauauuuuuagggauugauuguuucugaaccugagacuaagaauagcauuacauuuuuagcccuuuaaaaaaauuggaagcauugaaauaaucuuggguucauauuuuauucacucucuguguuuggcacuuuuguagauaagagagccuugcuagagcauuuacuuacgugaaagaaaacauaucugcacuuuuuagugcugaugugucacugcugacuaaggagucaaucguagcacuuggcaugacauaagcucuguucagugaccaucagauauacccguugaacaaguggcaaaugccuuuauaugagaugaggagcucuggcaguuugaauucuaucuuugugugugauuaaucuuuuuuuuuuuuuuuuuuuuuacuauaagguuuaggguacaugugcacaacgugcagguugguuaguauguauacauuugccauguuggugugcugcacccauuaacuagucauuuaacauuagguauaucuccuaaugcuaucccucccaccucccccauaaguaaucuuuuauauaagguuuuuauacaucacuuuagauuauccaguucuugaaacaaaauguuucauuucuagaaaguaauuacugaauaggaagcacccuuuuaggaagcgcuauuucucucaaauuaauguguaauugaaagguauagauuuuaauuugacuuaaugaccaagucauuaaguaguugaaguagagugcaguuauuucguuacucagcagucauuuauuaugugcccaugcagcaaggguauauuacugggcauuuguuaucaagguaucucuauucuugauacacaaaggugaugcaaaugauaucaaacacaaguuuuuggaguuuuuguuucuauuugugggaugaugaauuauucaguagugauggauuuguucacacauuuucacuucuacaccucuccacugccugccuguucuucuaucccuuuucucuuuuucucacacucacauacacuacauuagccaauuaggaauguuaaucaacuagucaaaucagcuaccuugacuuccuuuacagagccggaaccaacuaaucuauucugcugcagaaaugucaagauaauguaccaguaaauuaaagccguguggcuagaaugaauuugaaacaaaguauuaguauuuuagccaugauuuaucuggcuacuggcucugggaaucucugcuauagacaucccuugcuuucauugucacuguaguuuuugcauaagccucacuguaacuacauugaucauuuuuuucuuuucguuuugcucugcaauucauuacuuuaaaaaaaaaguagagaaauuuaagaucuaguuuaaacacagcccuuuaccuucaaccccaaauuaagaccaaaucuaugguguuucucuuucuuaacucuaauguuccuuuaguacacuuaaggccauaagggcaaaaaaugauaauuuguaacccuuuauagcucucagaguucuuucacuuucauucucugauuugauccuuaguagacaaggcggguguuaucuguuuuauagaugaaaaacugauguucagaaagguuaagguuuuugaaaaaggauacauaaguaguaagugucagugaaguugaacucaaaucuaggucuucugauucuguguucagucucuuuccaugaugcccacaccccauccuuugaauguuuguaaguaacagugaacagugacugauccuacuaaaguaucucagcuuuccuuuuugucaacuuuuuucuaccuguaaagugagauuacaguuacaguuguauuucccagcauggguuucagaauuaguuaauaucugagagcuagaauuguucaaauuuuaagucugauagaccuuuaguaauuaccuagucuaauaauaggagaaauagcuaacauuuauugaaacauuuaaagcuacuuguguaggcacuuaaauaccuaugaggcuguucaagaaauggaguaacuugccuacagaucaaacagcuaguaaguaguagagcuggggcuugaaccuagccuggagauguaaaccaccguuuuagggaucacuauuuucucugagaaucuucugaagaauugcuuuuugaaguucaguugacccucuccauggaagaauguauauaaguacaguauuuugcauauaacuuuuaggguguuuauggaagugaucgagccuagcuccuucauuuuacagguaaacauauggugaauccaagagaauaagagaauuauuugcucaaagucacacagcugaacugagacuaggaacaagucucuugauuccuagugguauguucuuuucacacuguuugagcuuucuaaccuuugcaaacagguaaaauacguugcagcuuuucuaaaaauacaaauuuuuaagguuuuuaaaaagaauguuaugagacucagauaguuugccuuaaagucauaauucccuuucucucacccacugucccuguaauuuuuaguguaugaguguagcuuuaauuuuuuuuauuugauaagggagguguuagcccuaaacuuuuaaaguuaaaacugucaacaugaaauuuuuuccaaaucauuauuguacagguuacuaagucucuguagguauauuuagcaguuuggaaaugaucauugaguuuuaccuaauuauaacuuaaagcuuuuuuccccugauuucuguucuagaugcuauuccaaguucagaucaaauucgaguagcaccaucuuuaaaaagccaaagaggcucaguguggacaaagacaaaagcggccuuugagaacugggaaguugaggugacauuucgagugacuggaagaggucgaauuggagcugauggccuaguaugaucauuucuuuaacuuagaaaaugugcauaaaugcauauaccacuagccucuaacuguucccuauuacauauuuucaggcaauuugguaugcagaaaaucaaggcuuggagggcccuguguuuggaucagcugaucuguggaaugguguuggaauauuuuuugauucuuuugacaaugauggaaagguauauuuauugucaggacuguuauccacuuuaauacaucuaucaacagaguuaggcugugagaaauaauagcuuauucaaugcuuucaucaguuugauaguacagaacuccccaagcuauaugguaaaugugauaauuagucuuuauauagcuaggaauguaucaguuuaauuuacaugugcaugauuuuuuguacaucagcuugagggcauaguagagcccugacucucagaacuuugcagugaccccugcucccauggcccuauuuaauggauaaauacaaauccuuagacguagguggugaaaacaguaguguuuaggagacucuacuaaacacuuacauaagcacauccaaguccaugacuaaugcuagcucacauauucaugucuggucauauguuaaucauucuuuuugaucgggccaauuuuucugaugaucucuccuaaaacaguuaagaucaaaauguacuuacaaauuggaaacauuagcuuguggcuuaacagccuuaagguugaugaucuucccaucagcugguuguuucucuauuaauuuucagggguuauuguuagcaauuuaaagaacuuuaguaauuccuugagugccaaggccagguuauuuuaaaauuuugaguccuagaaucuuagauauguaagucacuucauaguacaucaagaaugauguagaaugcuuugauuaaagacauuuuuuaaaauguuuuccuuuuuuuuagaaaaauaauccugcuauaguaauuauaggcaacaauggacaaauccauuaugaccaucaaaaguaaguguguguuuuuuacauuacuccugauuucagcuucuuuuuggaauccuuaugaaauacauuguuucaaaucugaacaccuuccaaaugaaaaaaauacuguucuuuuucuugagacauauuuuguaacuugguagaaagguuuuauuuuauuugguucuguucugaaguucuaucuguggaccaucucagauucaaccaugguauguguuuuuaauuuaaccucaaauuauuuaauaauauacuuuugaaaguuuauagacuguuccuggcucucagugaugccacuaaucaugcauuuuuaucuucauuaaaagggaucuuuaaaaaauaaaguugagccuugauuauuaaggcugaugauuaagcaauuuaugccaucuuauuuaacuucaauauuguguuauuuaaagacucagugguuugcagagauucuaaguguucaguacagucaacccucuguauuuguggguuccguaucuguggauucaaccaacugcagaucaaaaauaauacaaauuauuuuguguacgcaacaagaauacaaauuuuaaaauacauuguaacaacuauuuacaaagcauuuacaucauauuaggugugauaaguaaucuagagaugauuuaaaguauacaagaggauauguacacguuauauguaaauacugugccauuuuauauaagggacuucagcaucugaggauuuugguauccacagggguccuggaaccaauguccuauggauguugaaggaugacuguauauuuauaauguauauaaauuagguauguacauuuuuuauuuucacguguuuguuguggaggaaauagcuuuuaaccagugaacuguaagaaaggugacuuauccaugugccuguuuacuguuuuucugccuuagugaguuucagcccugguaguucaucauaacucccuauggagcuauuuaaaauggaggugccuaggccaccuccuuuugauucugcuucaguugauuuggaguggaaucuacauguuaaaagcccagagagugauucauguucugcccuaggguagagauucacugccuuagucucauguagucucguguagucuuuugaguaaauaacauaaaguaucucaagacuuuuucauaacuugauauuauuuuagucuuccugaauuuuuaaauauugaaaagcugagugucuugucuguuuuccucccccuuacacuauagugacggggcuagucaagcuuuggcaaguugccagagggacuuccgcaacaaacccuauccuguccgagcaaagauuaccuauuaccagaacacacugacaguaaguaacaucuauuuagagagaaucaaauaaacaauguuacaguaucacuuuucauuuugaauuuuugauagaaauuaaaugcacuuaaauuuggauaugcuuacauacucuucauuguuacucuaagagaacggagguggcuucacagcucaguguaaguggucaucuguuguaaaccccugaugguauguuuccauuuagucaguaaauguuuaagcccccuacuguauagcacaugugagagauauauauaucuauagauagauagauagauagguagauagauagauagacggauaaucuccaagccuucaggauacaaauaugaguaagacagauggacuuucuccccagagagcuuauagccuaacagaggacacacaaauguaucauuccuaugcugugugauaaaugcugcguugcagacacuaucaagcgguccugugguuagaauccuguaacugccagguggagguggggaagggcaggaacauuuucucagaguugagcugugcccuacagggagaucaggaaguuccugggaguugggggaagagggugugugugugugcgagugaguggguguacuccaagcacagaaagcaggcauaggcccuugagagagcuugaaauauuuuggaaaggcauguaguuugguguggcugggagauagaagagaucagugagcagugagguugaaagggcaguaacaggccuugcacagcuuccuguaguuuaacccauaagaagcuuuuaaaaauguuuaaaggguuuuaagcaggaagugaaauuaucagauuugcaauuuagaaagaugacuuaggucccaguauucuuaguaccaguuuucuugggguuaggggugaacacaguuguugagucaaggagaguuccugaauauagccaauuggacagcuaauugguacuauuuacuagcaaagaagcagcacauuuguuuguguuuuaucuguuugggggaggaaugggaaaucagaggguugguaaugaguuuaguuguagguaaauugagguuagcauaacauauagguggagauaucuaacuggcaguuaugauaacuaagaucacuaugcauuguaaacuuugcuuuuuaaagaugccauuaauaccugguuauauaauacuuaaaaguaaaaaaaauaguguaugaauuuuucuuucaccuaaaucaugagcuagacuuacacuccugggucuaaaucucugagaaaguuaguucuguggaaaacuguauuggcuuagucuuaauuccaagcuaauuuagagaucuuagaauagagcaaguguccaauguauuauaauuagcuuggguuugaauuccacuauaauuauucacccuguacaguuucauuagagucaucaguaagucuugcuuaccugcauguagcaaagcccagacaucaagcauggugggugcagacuguccgugugacccaacaccgugaggcugugagcccuggcagcacuccaaaacaauagccuugcaaaacguacuccccagaaaggguuccacaauugaugagauuggucacuacucugcauauuagcacauuaaagauuucuuuaugaaggauccuuuauaaagaaaggauaaauaaaccuuuauuagaccucacauuucccagacugacuuaacuauggaauuuuuuuucaccuaaugucuaugagugaucauggagcuaguguuuucagguacacguuuugaagagacuggcuggacacgugacugcuacuuauugguuuucaccucucuguacaucucagucugguaauaauuccuuuucuuucuacuuguuaaagucauacuuagcuuugagcacacaaauucagaucccuuuucuaucagauuuccuaaacagcucauaaugaucugucucuccuaaacucuuagaguauuuuuuuuucucuaaugcuuauuuggccuugagauauguuguacugauuugcuuauuaacuauauguauaucucuucuuaucaauaugauuguaaacuucucacaauaggcauauccuguauuucuccuaguuccuaauauugugccaaugugaagugcucaagaaguauuuauuuucaugaguacuugcacccuagcuugucccaguuguuuccacauuggagggaaaaacaaaguaagaggagguugaaagcaauaagugcuguuggugggggaaacacagccaaagcaagagaucuuaaauauugcaaguguagucuuuaacaaugguuugaaaccauaaggugaauaaggaagguuauugaugaucucauaaagaaguaauaaucaguggacaguuuguaccuaggcuuucaguuacaguccuuccuaacauuccugcuaacucacaguacaaugaaauguguuacguccuuuaaaaaaaaauuggggccgggcgcgguggcucacacauguaauccuagcacuuuaggaggccgaggcgggcggaucacgaggucaggagaucaagaccauccuggcucacacggugaaaccccgccucuacuaaaaauacaaaaaaauuagccaggcuuuguggcgggagccuguagucuccgcuacucgggaggcugaggcaggagaauggcgugaacccuggaggcagaguuugcagugagccgagaucacaccacugcacuccagccugggcgacagagcgagacccugucucaaaaaauaaauaaauaaauaaaaauaauuggaacuagacaaugaagacucaugcuggauuuucaguuuguuagaauucaaggaaaaaaauacugaacaauuggaggauuuuaguauuguaauuugaauguaauaaucuacagucuuuuuaagacucaaaggcaaauaacuuccugauuguugauucuaauuuaaaaggcucuguggaggaggaccaguuguaaaugauguaaaaugaaauaggaauauuacuaaucacaggaaacauauuaauaugaaccaaaugcuaaaugaucuuuuaaaauuaauuauuuuaaacuaauuuuuaguucacauguuuccauucuacaguauauagagaguaacucuucauauugacagauuuuauucucuugcugaaaauuuggacagaauaccagaacauuuugccugugugacugaaucuuaagucucugacaaaauuuugacucuagaaguaaugacucaaguucccuuacucuggugccuugggccuucuccugcaaccacccugaaccucagugacuguuguuuagggugggacucgugagaggauuauuagaaaugaaauguauugaagaggcugaaccacugcuugacugggauaaugagaaaagcauucaugugucagguggauuccugugcuugccuaggauucuaagauucuguuaagaaauuuaggaucauuccuucaaauauacauuuugcaaaguagaaacguacaucuuuuuaguuuuuuccuucucugccuugucaguaugacuucugucacuuuuguucucugcuaaccugugacaguccagauaccucacuaauuuaauuaagaggagcucacuacuuguugagacaaucuguuuaauucucaaccagcugcagauaaaauuguaaauuuaaccucuugguuuuagcugucacugggaucugagaacaagucugaucccucugcugcaugaaccauuccaagggaguaaugaugacucccuaggucuucuugagagaaggcaaaccauauuccauuuuagaaagguuuucauagaaaguuaucagauuuuucucucuuuaaacuuuugacacauaguggggcaaaacucauuuuuuuaaguaaaauauauuguauauugacaccaaguaggaaacguuauuuaaaauuacucuuuauaauaaugaaacaaaacugaauaguagucauaaaauggaucgauugaaauuuauuuucuaaugucuuuugcaaaagcuauagcuaugauaugucuuucuagguaaugaucaauaauggcuuuacaccagauaaaaaugauuaugaauuuugugccaaaguggaaaauaugauuaucccugcacaagggcauuuuggaauaucugcugcaacuggaggucuugcagguaaaucuugcagucugaugauauuaaaaguuugugagguguguuuuauugggaauaguauauuagggauauguagacuuguuuauacuaauaacuuuuuaagacuguuuggaacuuucccaucaccucuugugccagucuuuuggucuguugagauugcuaauuuucuacuuacauuguucgguagguguacaguuaacuggggcuguauacaagugugucaauuacagcaucaguuugggugcuauuuuauagugaaggagacauauuuaaaguagaggcuaucaaagucagcaggcuuaaaggcuggagaucaaaccacaugacaauuaacuaaaauagcagucuuggcuagucacauccacagaaagguuaauugccaaguguuuuaggauccugaucauugucacaucacauguaaaugaauuuggcaaccuaaggaaagguuauuuggugacuaaacuuuaaacaaaaccauaguuaccauuuuuuuccacauaaggugauaaauuaccauucaacgucaaugccauuuuauguuuauaugacacauuguaguuuuaaauauuuucaaauacauggauuguuccugacaacccagagaagaagggagggaagauccuauuuuccauauuuuuagaagaacuugccaaauuuuaggugaaagaaauuucugaagaucguauggccaauugaugguaagccccaggcaggacucggccuggauuucugacuccagguucagugcccuguuacccaacacaguuucuuaaguuacuuagucuacacuacaguauuauaguuuucuuuuuaaucugucuacaucucuagauuccguaaaaacaguacaaagcauaaagauugcuguacgauugauauuaauugcucuugauugguggaugugacuagccaggauugguauuuuaguuaaggguuaggaaguuugauuugcugagcuggugcuuuuagcauaaacagcuugaauuugauuuuuugauaugauuuuagguaagauaaaauuauuaauaucuuccaugugagagaaacaaauaagaaaguaagacaaaaggugguaugcacucuuaagaaagguucagagacauauagguacccggcaguauguggagaccaggauuuucucucauuugucugggacguuguccaugaaggagauuugugggaaaccauggaggaucuugguaccagaauaaggaguuuggacuucuuuugacccuucauuuguuuguucauuucuuaucaaacauugauuaaacaucuauuauauguuaaacacugcuaaauauucugauuuaggguuuuaaaaagugaguuuuggauuauuucuaauauaaaucuuucaggugaauuuuggucucuaagcucacagagugccauugccuuuaccaaauuagugcuaauuuuugucaauucccucacugguuauuguuauuuaaaacaauaaauauugauaaaauacauuuacaaugauaaaaguaaucuccuauggaacuuuuucagacuuuuuuuuuuuuaauuuguagaugaccaugauguccuuucuuuucugacuuuccaguugacugaaccuggaaaagagccgguaauuuuacacauauuuucaaaaacuuuaucaguuuaguuugccuuuuagcugaacguuuuggaagacuaacuuagguuuggaucuuguuucugccaguuacugcuauauggucuugugcaagucacugaaccucuguaaugcuucauuucuuuuuuuuuuuuuuuuuuuuuuuuuuuuuuuuuuuuuuuugagacggagucucgcucugucucccaggcuggagugcaguggcgcgauaucugcucucugcaagcuccgccucccggguucacaccuguaguuccagcuacucgggaggcugaggcuggagaaucacuugaaccugggagcgagagguugcgguaagcugagaucaagacacugcacuucuccugccucagccuccugaguagcugggacuacaggcuuccgccaccacacccggcuaauuucuuguauuuuuugcuagagacgggguuucaccauguuagccaggauggucucgaucuccugaccuugugauccgccugccuuggccucccaaagugcugggauuacaggugugagccaccacgcucggccacgcuucauuucuuaauugcuaaaacagaaauguuuguacuggccaccucaugauauugaaggauugagacagugcacguauagcaagugcucaguaaaugguagugguuauuauuagaggcaagaguaggccgggugugguggcucaugccuguaauccuagcacuuugggaggccaaggugggcagaucaccugaggucaggaguuugagaccagccugaccaacauggcaaaaccccaucucuacaaaaauacaaaaaauagcugggugugguggugcacaccuauaguuccagcuacucaggaggcugaggcuggagaaucgcuugaaccugggagggacagguugcaguaagcugagaucaagacacugcacuucagccugggcaacaaaguaagaguccaucucaaaaaagaaaaaagggccaggcgcggugguucacgccuguaauccuagcacuuugggaggccgaggcgggugcauugccugagcuaaaggguucaaaaccagccuggacaacacagugaaacuccaucucuacuaaaaaauacaaaaaaaauuagcugggcauggcagcaggugccuguugucccagcuacucgggaggcugaggcaggagaauugcuugaaccugggaggcagagguugcagugagccgagaucacgcuacugcacuccagccugggugacagagcgcgacucuugucucuaaaaaaaaaaaaaaaaaaaaaaaaaaagaguaauuugcuaucguuuaaguaaagaaggaauacauuuuuauguuaaccuuuccgcuagugguagaagaguuaaaaugagaaaaauaacauguauagagauaucuuaaugauuuucuuaucuuuuuaaugaucuauuccaaaacuccaaaaaaaagcccacaccagauaaagaaauuucggaaaaggaaaaagaaaaguaucaggaggaauuugagcacuuucaacaagaauuggauaaaaaaaaagaggaauuccagaagggccaccccgaccuccaagggcagccuggugaguuguagcaaagcugacaugggugccgcagcagggcuugaggcuguugaucauggacgcuugagucucuguguugccuagcucaucccugcucucugaacaggcacauuccaagugauuucuggaaacaauuuaggagcaaaucuuuagucuuuaagagucaagagauuggcauuuuuaccagugagaauguggcuuagucauguaugaaauaaagaguaccaugguuauuuggaggaaugggaccgcuagagugaaagcuccaugaggacagggauuuuguuaauauucauugcugugaccacuaagccuaaaaauaaauccaaaacaaugcuaaccuaguaguucagguucaguaaauauuuuuugacugaaaucaucaaaaguguauauuuuugguuuuagugacacauaauuaccuuauaguguggagauaauccuuaaaaucuaucaaaacuguugugaaaguaaugugacauaucugcuucuccuccccauacuacucgauagaauccuggacuguauacuugaaaauuauaaaauacuagucuaacccaauguuauuaagaacgugagugugcuaaugucaaaaauaaaacauuuuaaggccaaauugagggaauuuauauuaucugcuagcuuuuuaucugaauuguucccagucagcauaagugaucaaagguguacuuaauaaaggcuguggcuagcauuugaacucuauguaguaugcaguucucuuaaugaucaacaguaugagucagacuuaaugaauuuaaaaaugaaacauaaaggucauucuuauuuugaauuuguuuuaaacaucaucacauaaaauuugugaguauauccugaagcugacuuuaguguuugaaaaguauuguuuaguaaauuuugacaaauguguauacccauuuaaccaucaccccgaucaguacacggaacauuuuuaucaucccagaaaguucccucaugccuccuuaaagucaacaaccuucuccacagagcccaucacuauucuuauuguuaucacuguagauuaguucugccuauucuuauaaguagaaucacacaguguaaugaaagagaaauauuuuuccauuuuaauuuuauuuaacuuuuuauguauuuaggaagaguacaagugcagauuucuuauaugcuugugucauauaguggugaagucugggguuuuaguguacucucacccuaaugaaccugguacucaguggguaauuuucaaccuucauuccccucccaccuuuuguagucuccaguguccguuauuccacuccauuuguccauguguacccauuguuuagcuuuuacuuauaagugagaauguaugguauuugacuuucuaagucauuucacuugggauaaucacuuccaguuccauccauguugcugcaaaagacauaauuucauucuuauuuuauggcugaguaguagucuauaguauauacauacauauauacacacacacacgccacauuuucuuuaucaaguucucuguugaugggcauuuagguugauuccauaucuuugcuauuguaaauagggcugcaauaaacguauaagugcaaguaucuuuuugauauaaugauuucuuucccuuuggguaaacacccaguagugggauugcuggaucaaacgguaauucuaauuuuaguucuuugagaauucuccauacuguuuuccaugaagguuguacuaauuuacauucccaccaacagcauauaagcauucccucuucuccacaucuugacaacaucuguugucuuuugacuuuuuaauaauggccauugugacuuguguaagauaguaucucauugugguuuuaauuuggauuuuuuugaugauuagugauguugagcauuucuucauuuauuuguuggccacuugcgugucuucuuuugaaaaaugucuguucaugcucuuugcccaguuuuuuaaugggcuuuuuguuuuucucuugaguuguuugaguuccuuguagauucuggauauuagcccuucguuggaugcauaguuugcaaauauuuuuucccauucuguagguuagauuauuguguugauuguuucuuuugcuguguagaagcuuuuuaguuuaagucccauuugucuauuuuuguuuuucuuguguuugccuuugaggacuuggucuaaguucuuuaccuaggccaauaugcagaagagucuuuccucaguuuucuuuuaggauuuguaugguuucauguguuauguuuaggucuuuaauccaucuugaguuaauuuuugcauauggugagaaguauggguccacuugcauucuucuauauauagcuauucaauuuuuucugcaccguuuauugaauaggauguccuuuccccaguguuuauuuuuguugacuuuguugaggaucaguugauuguagguauguggguuuauuuccugguccucuguucuguuccacugacuuaugugucuguuuuuauaccaguauuaugcugguuugguuacuuuagccuuguaguauaauuugaagucagguaaugugaugccuccagauuuauuccuuuugcuuagcauugcuuuggcuauuugggcucccuuuuuuuuccauaugaguuuuaggauuuuuuuuuucuaauucugugaaaaaugacauugguaauuugauugggagugucuagaacuaguagauaguuuugggcaguauggucauuuuaacaauauugauucuuccaauucaugagcaugggauacuuuuccauuuguuugugucaucuaccauuucucucaucguuguuuugaaguucuccuuauggagagcuuuccccuucuugguuaaauauauuucuagguguuuuuuuuuuuuuuuagcuguuguaaauggaauugccuucuagauuuggucugcuagaucauuaucaguauaugaaaaugcuaccgauuucuguacauuaauuuuuuaucuugaaacauuacugaauucauuuaucaaaucuaagaguuuuuugguggagucauuaggauuuuugagauauaagaucauaucauuagcaaacagggauaauguuacuuacucauuuccaguuuggaugccuuuuauuuuuuucucuugccugauugcucuggugaagacuucuaguauuauguuauuacacguaagagugauaaaaguggcauccuugucuuguuccaguucuuaaagggaauguuuucaacuuuucccuguuaagugugagguuggcuguggguuugucauauguggccuaauguugagguguguucauugaggauuuuuaucaugaagggaugaugaauuuuauugaauguccuuucugagucuguugaaaugaucauguguuuuguucuuaauucuguuuaugugguguaucauauauauggauuuuuauauguugaacccuccuugcaucccugggauaaaucccaccuugaucgugcuguauuaucuuuuugaugugcuguaggauucauuuugcugguauucuguagaggauuuuugcaucuuuguucaucagggauaugggucuguaguuuucuauuuuuuuguguccuugucugguuuugguaucagggugauaccgcccucauaggaugaguuagggggaauucucuccucaguguuuuggaauaauuucaggagaauugguucuucuugauauguuugauagaauucagcuauaaguccaucuagucccggcuguuguuaagagauuuuuuuuuuuacuacugauucagucuugcuacucauuauugaucuguucaggaguucuguuucuuccuguuucagucucagaaaguuguguguuuccaggaacuuauccauuuccucuagguuuucuaguuugugagcauauagguguucaaauaguuucugacgaucuuuuguguauuuguggaaucuguuguaaugucuccuucuuuucugauuguguuuauuuggaucgucucucuucuuuucuugccuagucuagcuagugguuuaucaauuuuguuuaucuuuucaaggaagcaacuuuuuguuuuguugauccuuuauuaauuuuuuuggucucuauuucauuuagcuuugcucuuauguuuguuauuucuuuucuuugcuaacuuuggguuugguuuguucuuguuuuucuaguuugcagaggaauaauguuagauuguuugcgaucuuuccacuuucugauguggcauuuaaugcuguaaacugcccucuucacacugcuuuuuucaguuuugguuugguguuuccauuuucauucauuucaagaaauuuuuacauuugugucuuaauuucuucauugacaaagugaauguucaggagcaugcuguuuaauuuccauguguuuguuuaguuucuuaaguuccucuuaguauugauuucuagauucauuccauuguggucuaagacacuugauaugauucugauuuucaaaaauuugcuaagacuuauuuuguggccuaauauguaguccugugucggagagucuucuaugugcuggugaaaagaauguauauuccauaguuauuguagaaaguucuguaaaugucuaaguccauuuggucuaaaguccaauuuaagcccaauguuucuuuguuauuuuucugucucgaucuaucuaguguugugugugugguguuaaauucucccacuauuauuguauuacuguuuuucucuuucuuuaggucucguaauaauuguuuucugaauuuugaugcucuaauguugggugcauauaaauuaggauuguuauauccucuuggugaauugaucccuuuaucauuauauaauaaccuucuuugucuuuucuuuuuuaagucuguuuuaucucauauaaguacagcuacuccucucacuuuugguuuccauuugcuuggacuauuauuuuccaccucuuuacuuucagucuaugugugucuuuaugaauaaccuaaguuucuuguaggcaguauauaguugugccauguauuuuaauccauucugccagucuguaucuuuuaguggaacauuuaauccaucugcauucaagguuaauauugauauaugaggcuuuguucuugucauauuguucauuauuuucaaguugucuuauaaauucuuuguuccuuucuuuuuuccaucuuugucuuugucauuugaugaaauucugucauguugccauuugauucuuacaucuuccuccccucugugauuguuuuauaagaacuuuuauuuuauauuucuguuuuuaucauggugaauauugcccuuuuguuuccauguuuaagaccgcuuugagcauuuccugucaugcuggucugguaaugacggauuuccccagcauuugcuugucugggaaaggcuuuauuucuucuucauuugugaagcugauucuagcaggauauaaaauucuuggcugacaguuuuuuuuuuucuuuuauuagcacuuugagaaugcccauuccuuucuggccuguaaagcuucugcugaaaagucugcuguuaaucugauggaauuuccauuauaagugacuaaauacuucucucuugcuaauuuuaaaauuauuucacauugacuuuagacauucugaauacaauaugcuguagugaaacccuuuuugcaauauauuuuucuggggauugcugggccuccuguaucuggacaucuaacucuuuugcuagacuugggaagcucucaucaauuauuuucuuaguuauucuccuuagccagacaacaacugcagccauaugaacuugaacucggacuaaggauagggcacagcccagcaugaaacucucaaaauugugccuugugccugggaccagggagagcagggcccuuccuagucaggugucaugagcaagaagcuguaaggagugcagucugcucacaucucaguuucacaagagcccauugcagggcaguggguauuguccuagauaugcauaggagagccuguuuccugucucuccuuggccaggugguagcuacagccuugucagcccaaacauagccugaggguggggcacaacccuccauuaaacucucaguguuucaccuugggucugggaccagagaggguagggucccuuccaggcaagcagcaugggcaagaagcuguggggagugcugucuacucaugucucaguaucagcagcacccuucagcaaggcaggagggaccuuccuaggggugcaugggagugaccaguguccccccuucucuccuuggaacauugcagcgacugcagccaugucuguagauccccaguaucuaggcuaucaacaguggugcccaacuggagcuguuguaggcucaaaugccugugggauuccaugugguuucccuuuauggagcaacaucucugugcaauauuuaggcaguuccauauguccagcccacagcccuagugggucagagguuucuccuguagccaggaucauaaaagcccauuuuggacugcagggcccugggguuuucucucuuacuguuucccaucaucuaggagcccuucuggugcucagucagcuccuggcugggcaagcugccucaaacucucuccuuauuuuggugcuucccauuucuucucugaugaauccuagcauucucuccuaggcaaucuauuugaaaugcaaguaucuacuuacuacucugguuuuucuccguggaggagguacauacuacuugcaucugguuagccauuuugaucccuccugagauuauccaagaaaaauuguuuuuaaauaaaaaaauuuaaacccaguuuauaauaaguguucaaucaccugaaauggcagaaaacaaauaauuuaaucauuauugaauuaauuauuugcauauuuucuguuugggagauuguaccacugugauggugauguccuaauuuugcugaauguuggcacuuuggucacuuacguuauuucaaaaacuacauauguguaggugacucugaucauuuuuauuuauuuccuuuucagcggaggaaauauuugagaguguaggagaucgagagcuaagacaagucuuugaaggacagaaucguauucaucuugaaaucaagcagcugaaccggcaguuagauaugauucuugaugaacagagaagauaugucucuuccuuaacagaggaaaucucuaaaagaggagcaggaaugccugggcagcaugggcaggugggcuugcagaauaugcagaugugccccauuuacccuuugcuggaagggaaguaaagaagaagggcaacuguacuaugugcucauagaauguggauuauucagcuugcucgucauuguuucuuccuccagauuacucaacaagaacuggauacuguugugaaaacucagcaugagauucugagacaaguaaaugaaaugaaguaaguauggaaaaguagcguuuguguguuaugugauuuuuuuuauccuaaauuugugacuucaggugugcaagcacuguauugcaagauuucugcaugaggguaagaaucccguucuagauucauuuuacaaauaggggaccauaaauacagcaacuuuuaauauucaaaaacugcaaacaugucuaaaguuuuuaauuguuuagagcuggaaaagaaaaaauguuuuggcaucuuuuaaagagauuugucaguuacuugacagagccagguguguucuuauauuuauaaaauauaaaaagaauaugaaauaauauauaacacuuuuaugaaaaguacuagaggaauaaauauguguagcauuguaagacuauaauacaagcagaccugaugcaggaaauucuuuuugauggaaugaaaccauuuugaacguaauaugugugacuaccucuuuuucauucccaucuuuuacucucagagagacuggacagaguuggagcagagaggagauaauuguguccuuagaauguugaacaauaaauuucuaaugagaaugauugacuuaugcagauaauuaauagcuuucaaugccuggagcagagauaacaaaccauagugucauguuuccauaaccuaacauuucagagcacugucccaaccgauagaacccuugacaaacaagaaugucaaggugaguucuuuaggacuggagaauuaaacaagguuagaucaaacagaaggugauuauaccugaugucuagagauuaaaggcacuuaacuuauaacugcaaauuuauauuucuucaauuuuucucuuugcauuuuaaaaaaucuucauaaucugaacucaugauugaaauauuuaugaugcuagaugaauaguuuagcucuucaaauaguuuaguuaaaugaauagaauccuuuuagaaauagacuggaucauguaacgcaaccuuuuuaaaaaucuuuuuauuucgaucuaauuuuagaccucagaagcuacagaaauaguaugggaaguuucuauacauucuucacccaucuuucucuaauuuauauaaccaugguuuaauugucagaaccaggaaauuaacauugauacaauucaaucaacuaaauuaaugaccuauucaaaauuuaucaguuucuccaccaaggccuauucuauuccaggaucccauccacaaucgcacauuacauuuaguuauuuuuucucuuuagccuucugcagucugcaguaguucaucuucccuugucuuucaugaccuugacauuuuccaagagcauuaaucaguuaauaccuuuugauuuggguuugguuggauggaaguuccacauuuugauaagaagauauuauauauuauaauauguuauauaauauaauuauauauauuauuauauaagauugguaagauauuacugaugauguuggcugugaucacucgguuauggugguuuccuauugcuaucucuacuuuaaaguuacuguauuucccuuugugguuaguauuuuggagaagguacuuugagacuauguaaguauccauuucaaccuucugcucauucauuuuagcauccauugauguuucuugccuguaacaagaaagugguuuuugccaaaugcugauuuuuuuuuaauuuuuauuuuuauguauuuauuuauuuauuuuuuugagacagggucuagcucuguugcccaggcuggagugcaguagugcaaucacagcucucugcagccucaaccuccugggcucaaaugauccucccaucucagccuccugaguagcugggacuacagguacaugccaccacacccagcuaauuuuucuauuuuuuuuggaguugggauuuugccauguugcccaggcugaucucaaacuccugggcucaagcaguccuccugccucugccucccauaguguugggauuacaggcgugagccaccacgccuggccccgauguuuauauuucgaaauaauucccuccauauuuguucauuggaauucugcugucaggaccaacuaucuuuucucucccauuuauuuauuuaguuauuuauuuagaucaguucagacucauggauacuuauuccauagguuacaguccaacacucuccuuauuuauuuugcugcucaaauuguuucagguauggucauucugagcuccuucauguuggcaucuuuguucucucaacaagcccucaucuuuuuuugagcauuuuaaaaauuuaugguacugcucuaucuucuagggucaucuuguauuuucucugcccucagugagcccugguuccuuuuucuugagaaagguauuugaaaaccaaccuuugggcacuagguaugcucauuacuaccgcggugccguuaccucuaggccucuuacuggacagagcuagggaauauacauauguauaccaacccaugcauguacaugagucuguaguuccgugucugucaaccuacucuuguguuaaaccaugagauuaugcagauauuuuggauucuggcuggacugaacacuacagaguuaauuuuuaacuuucccccuugucuuauuugaaaauucuuccuccaacagggaaaaaccugguucuuauuaucuguaucuauaacauauuuacuuauugguuucacuugaguaugcauauaaguacacacaaagugguuucaaauuguuagcucguaucccugugagaaagacauuuacugacaaguuuauguaaaguuccuuuuaucucuagcuuuacaguauccagcccagauacucuuuuccagauaguuucuuaguguaguucucuuuuucccuacucuuuucauuauggcugauauuacucauuuaggauccagcuagauucuuuguuaauguuuauauuccuccuauauccugguugauuuaaauuguuuguauuuuggguauaugaauacuaugguucuaaggggcagagcauguguauaucgcuucuucauccuugcuaccacuuucccauccuccccuucuuuccagcuguuucccacccauucccucuugguaaccaauucuguuagcuuccgguuuguucuuccuguauuucuucugcauauacguauuuucuuuuucuuuucuuucuuuuuuuuuuuuucuuuugagauggaguuuugcucuuguugccuaggcuggaguacacuggugcaaucuuggcucaccgcaaccucugccuccuggguucaugcgauucuucugccucagccucccgccuagcugggauuacaggcaccugacaccaugccuggcuacuuuuguauuuuuaguagagaugggguuucuccauguuggccaggcuggucucgaacuccugaccucaggugauccacgcgccuuggccuccuaaugugcugggauuacagguguuagccacugcacccagcccauauuuucugaagucccuuucuuucuuaugugacggguagcauauucuagauacucuuuugugcuuugcauguuuuacuuaacaguaguacuaggacaucuaaagauguaacuaguugucaggacguccuagcuguccaguuguauuauccauagaaucccuuucuuagaggaguuaacaauccuugcaaacucccacuuacugagaauaaaugucaugcauacaguaaguuaauauaaaaacugagcucaaguuucugaacuagugcucuggaacuuuuucuuuaggauuuagcuucaaaaaaaaaauguaaagagauagaaaauauuugccuuuaauggaaaggguaguuuguuucuuuguggauuuuuauauucuuaaggaaucaaagaaauuuuuuuuagcagaaagagaucuuagaaagcauguagcuuuucuguagcaguugaugccucuucccacuucuccaucucaaaacuucccuuuuaagauuucugauacaccauucacuccugguauucuuuggccucugcuuccauuuaguuaucuucacuugcucuccuuccaucgucccuuaaaagguauucuuuucaagcguucuguccagcccucuuuucacuugaccuguuuccuaaaccaacuaugaccuccuucaaccacaauucuauccccauaggcuccucuucauuuuuugacacucagcuaaaugcaucuuucuuuguagagcucuagucgugcuucugucacguugcuuuccugcuagacaauucaucuccacagggcagauauuucauucuucuugcaaaguuuauaucccuaauauucccuggcucacagcacuuaugaaauaaauguuagcagaaugaacaggcaaaugaaugaaugacugaguaggagcaaauuaagugacucaaucuuugguauauuaaaaagacauuuauaccuaagcaaguucaugcuucugggaagcagaauuucuuaaauacaaauaugugacaacguuacauacucugugagguuuuggucuugguauuauuuuaguuauauuaaaauguuaugcuuaauuugaguuuaaguggaaaagcuuagccccacaggaauuuucuugagcauaugugccauugaaagaaauuuuaaucaacacgugacauugauucaaaagcacuugagauauuuuguaacuacuuuuaagucuucacugcucauguaacucaaacauaauuuuuuaaauguuauacuuaacauucugucugacauauaguguuauuuuuaaguaauuugagucucuuuuuuuuuuuucuuuugguaaagcucuuacuuuuuaaacuacauuugacuccagugaaauaacuuauuuauuuauuccuccaaauugaaccauaacuguugaaugcacucguaggaaaucagaauugugaccccuguccucagggucacaaagccauuagccuccuacuauaugcuguaugagugaaaucaucuauaugugcagcuacaaagcggacaagucugugugugugugagugugccuauaggaaaugauugcguuuggcacuaguccuuuacuguacagcugaacaccuagaaagauuuauuauaacuucauuaaaaauaucauccauuauauucaauauccacuuauacuauugguuuuaacacagauuaccuaguaguauuuucuacaugguauuuuuagaugaccuuuaguaaaauauaaaggcauaaugucguuuuauaaauuauuuuccaauuuugaacacaacucgauuuuuaaagauacuuuaccuguuuuuuuuuuuaaaugauguaauauauuagacuugaaaaguaaaaguauuggagaucugugacugaaaaaaaaaaacuuuauagugauuuuauuguaucaagagacuuucuguuucagaaauuccaugagugaaaccgucagacuggucaguggaaugcagcacccuggcucugcuggaggcgucuaugagacaacacagcacuucauugacaucaaagagcaccugcacauaguaaagagggacauagauaacuuagugcagcgaaauaugguaacuuuguuuccuuuuccuuuuauaauuauaaucuuuaggaaaggaagaacucauacucuacugcaaguauuuuaacccuuuaguuaaugcuaaugcuuauuuuuaauguuuaagguagaauugucccauuuauugcagaucuccauguguccugguuuucuaguuauugaagguggaagaacaguucccauagcagucaugguuuuuuaauauguaauauuuauauuaucauuucgugaaaauauuuucugauuuccauguuaaugucuucucugacccauggauugcuuaaaguguauuucuuuggccuauuuuuccgucaagguucuaaucugguaauuucuugcuaucuuguuagcuucauuuaccuucacccagguuucgugugcuuggauuggauuagauauguuuuugacucugcugguugucuucuauaagacauauuugggauaugguuggcccauauuuccuagucugcuuuaccagaagcagaaaucccaaucccuuauauuuuauaucgcguuuuaucuuuuuaaaagcuuuuuaaaacguuugaugaccuuuagaaaauauacuaauagauuaauaauaauguuacauuaaacugacucucccaaggucaguagcuaguaaguaggaaagggagaaaacuuaggucuucagcuucuaaucuugucuccuuuauauuuuuugauaacucucuuaacuauauuccuguauauaugccuugaauauacauuuuuuucaaagauggcuuaauaguuuucuuauugaucaugaccucucauccaaagcauuauuaucuguccccuuaguucuguuugagguuauuuuucucguacauugucuuuguugcaaugaccaaauugauacuguguguaucaauuuacugaagaacuuugucccacaaauauaacuauauugggaacaacuaaucuuagaagccauucucucuggguacuuggaugaagucuuuguuccugguauuuaauugccuccuuauaauagaaggaauacucagggaaauagggaaagaaauauuuuucagaacaccagugaauaauguugaaugauaugagauuguagagaaugaggacugagaaaaagccagucuguuugucaaguaguucauugguaggguaaccauguaauuuauugucugaccugggacacuuuugagaaugaaggggugcuaauaaucacaccacuacagcaagcgugaacugggaguauccagaggaguugucuguggugacgcuagucucagugaccucagggacagcaacaucaucauauacuguaaugcagacaggagccaggaggcagugaguuagugacuggguaguaaaaagguggaggccuuccagugucaacuacuccuucaaaaacaguugucaguaaaaguuaaggggauagaagguuuucugggggaugaaaaaaugaaaauacuuguuuauauagcaaacaguuuuauaaagauuucacauuuauuucuuuuuccaaacugcuauuuugacuaacuguaauagaaagucauuugccuuacagccaucaaaugaaaagccgaaaugcccagaacuaccaccauuuccaucauguuugucuacgguccacuucauuauauuuguuguggugcaaacuguauuauucauugguuauaucauguauagguaagucucuugauaaaaugugacccaauauuuuucugcaucuguuuaauuagaaauauucaacuaaguuaucuauguucauaauacaauuuucaccaccuauaaaauuaaguuuauugugauuucuguucauuucaguucacauaaagugcacguguagaauauauguuuaucuuaaugcguuguauacuucaaaaggcauugauauuuuaauuuuaaauaguccuguuucuuuccaaaguuaagcguauagaacuucuuuaaguguuuguuucuuuuuuucauuaggucucagcaagaagcagcugccaaaaaauucuuuugacuaccauuuuccuguguacuucaucuauuuguguacaaaaugaugucguuuugagggaauuuaaguauuuaaauugcuucauagucuaaauuauuaauuuucuuaauaaaauaacuguuuaaacauugauuugcaguuaagaauaaaccuuaaagcaaagacaaccacauuuuaauuuguucacaguauguaaaucugucuaaauuucagugaauuucuggucaguaugaugcagccucugagcagaauauugaccaguaagaggguaaauaaagugggggcaaccccuggauaugaauguuacccccuaagucuccaauauugcagguuucccuguauaacguaaacacacuugcccucaugccucccagaauaugaggucuaauuaagaagucccaucagguuuauuuuguaaccaaagucuuuuuuagaggucagacuuccuaaucaaaggccugggccugcaguccuuucaucuuaaugcaacuuccuuugaaaucaaagaauauuuugucugagagcuuuaaggaucugguaauagacuucaaaauguuaagugaaauuuuuuuuuccucuauuuaucaaugauauauuucacuuuuaaaggaaauuuuagaggaaaauuaauagcugcuuuuugccuaaaaaaccuuguggguggaaacauuccucugagaauggcuuuuauagguauuuugccugguaauguauucauucaugauugcccauauucuugaaugucuucauuccaauggggucaggucaauauuaugaaaauaauuuuuauauuuauauuuguaacuuaaggaauuuauuucucccuuuacuacagcauguaaauucagcucaaauugcaugaucugaggauuuaaauucacaaaaccugccacuacauucugguuuacauuaguuacuucaugcuggcugggguuagugaccauuugcauacucuuuuaaaucaaggaggcuguaguagaagcaguuuuaagauucuugaaggcaaaauuugaaaaacagugaauacuucuaauuguuuccuuuuagugccagaacuaaggacauugugaagcacuuguuaguaaacuuaaccuugaaaugucagacuggaaggaguuuuuauagucuuugugcauacuucuagguauuacagaaacagucuguaaaugacauuuuaagaugcaaauuuaauucuguucacagcugauuuauacugauuuuugcugccuucaaaauacucuuuuacuucuuuuagcuaaaaugguugucuuucauuugccauagaauuccaaacaauacuaucuuauaaaauaguacuguugaauuauuccaagccucccuagguuugcucucaaaugucauuuacagauugggcuaacgaccuaaaaucuauauauaaagacuuucugaagaacucuguauuauagcaauaccaaacgagugcugugugugcaaacagucuggcguugcuuuuuauguugauauuuauccuagaacacugaaagagaauaugccagugauaacucacuuuacuucagucauuucaacacagaaaaugcuucucuagcauuuuucuuuuguaguguuaacauuuugaaauucauguuucagaggcuucaucaucacagaauuuacucuugcuccaugaaaaaaaauuaaauaccuucagaggaauauuuaaguuguaaacuaugaaacuugagaaauccucuugagauaaaaggcugccaaauccaguauuauaaaguccauggucauaugugccugugcauuaaaggaauaccagaucuaugcaguauacauuuuucaggcugaaauucaaggggaaucauucugauuauucuuacuacaaauggagauggcuauuaugaaacagcaugagcaugagccuuuuaucuuuuauacuuagugauauacuuugcuugaaaaucacucagcaaaguaguucacaugauguguaucauauuugaagugugguuuuucucaaaaucauugacuuuaaggagcucauuucugaacaaaaagguuugcucuguggaaaaaucaaucacugccaggauucuuucauuucuguacuauuuuguauaauugaauuuguucacuucucucacaccagcaaguguuuuacaggugccuuggauuaaaacaaaauugauuuuaaaauuuuuauguaagucauugugucuaugaugccacuuuuaaaaggaaaaugcaauugcguaauggcuuauauccuuauuuaauguaccuauuuguguucuaauaauuguuugaauguuuuauucagcuuaaaacuuuaccaugaagucauaaacaguaaacaauguuuuguuauguauuaaggggauaucaguguuucucaaaguaugauccauggaccaucugggucauggcgccugguuucagacaaccugaaucaaaucuuagggguggggcuuugggaugucauuguucaauaggcaccucaggagauucugagcacaccaauguuugagaaccacuaaaaugaggagugggaaaaaaaaaauagguguuuuguuaauuuagagcugagcugagaagauaauauauuuuuauugucaaugacauuaacagauaugcacugauucuuuuauaccuacaauuuacuuaauguuccuuuuauuaaaacgcgugguucaugagcaacuacagacugaauccagauuauuaccuguugcuuucaguauuuucgugauggcuuuuaaucuuaugaaaucaucuugagaucauucauggucaagccaugaaaacucccaucuucaagccugccugcuaaagcuucuuugccuuccugauugugauuaugguaacaauuuauaucagacaguuguacuuuuugauaacuuagggaaaacagaaaugacuugaacaagggauugccugccucacugcauugcagagauacaauuuuuguaaagaacacaaauagcaguugugaauauuaaggugugauuaucuuucccuguccaugugcuuauugaaagaagauagugaacaaaugauuauauugaggauuuuuuuaauuuauaagaucuaaugugaaauccacacuuggaacuuuuuagaucugucuguugcuuguuuaauauauuucuuuuaugacauuacuuaaaguuuaaaaggguuuucuauccacugucaauuucaauuggauaacauuuugucaaguuuuuuuuuuccugauuauuugaugcuagcuggaauucaagaaauggcauugaccuuauucaaauaaagaaauauuuuaguaaauuugcuuuuuccuucauu

SEQ ID NO: 18584 - RNA, 2926 nt, Homo sapiens
gaagcugaaaugaguuaauuuauguaaagugcccagaacaaugucuggugcauaaguacuuuauuaauguuaguugucauuaucaucaucaucuaucggagucucucaugauuauauuccaaaccaucucaccuagucagaauuugucauuaagaaaacuaugggcugggcacgguggcccacgccuauaaucccagcacuuuggaaugccaaggugggcagaucaacugaggucaggaguucgaggccagccugaccaacauggcgaaaccccagcuguacugaaaauacaaaaauuagccgguagugcuggcgugugccuguaaucucagcuacucgggagacugaggcaggagaaucgcgugaacccagaagggggaggcugcagugagccaagaucacacuacugcacuccagccugagugacaaagcaagauuucaucucaaaaaaaaaaaaaaaaaaaagaaagaaaagaaaaaagaaaacuauggagcaugacauggaagcuggauaagaaacuuguuugcaaacuccaagaaaaaccaggaccuaaaagaagggaagaguggaauggagggugagcagaguagggggccuaagcucucuauauccacuuugaacagauuucuuccccuuuuuuuugguuguuuauauuccauuucuagaaaaguuucauuuggaaaaaggguucuacugcuuugcggggcaaaaaggaaccauagcuaagcugcuaacuaggguaacauccuauccccucugaaauacaauuaaauucagcaacgccaucuggauucaguggcugcugugugcagagcgccugcugggcuccauggagaggggaaggaaucagugucugcauccaaguaguucacacuguaacaggugaccuauacacacagaccccuugccaggcaaugugcccuguaguauggccacacagaggaggaguccuggggaggcuccauggugaagguggcuuuugaaggacuggcagggugucaauaggcagagaugcauggacacuaaaauccaggcaacaggaacagcauagccacaggaccgggcgucagucacauucuccccgcuggccgaaugacgcaaauaaugcucaaauuccaugcugcgguuugcuuugacuggcggagguggaggggcgcgaaagacgagccagcaugcugcacagcagguuuagccuccaugcccgggguuuggagcaagagagugaaaacaucagagcuaugucuucagaaggucuuguguugugaaacugacuggcaagcuaucacaggaagcuaagcgagguggcaggcugcuagauuaaaaugaucucuaaacagaauucgcucucagaguucauuuucagccuaccucauuagggcagauuuggucuucucacauuguuauugcuguaucggaggaaucuuucuaaagagaaaagugacagcacacauugcugccauuugaaagccagcauuuuuaaagggcguaauacauagugacaguuuugauguaugcccguggguguggguccugauaucucaacauacucugccugcauaauuuaaaaugacaguuuagccugucaaacuuaaaugugagugaaguuccuuggauauuuauaaaacaucaaaaagacagaauggugucagcaaaagaugggucuuuuuauuacuaaaccacgggacgauuuuuggauaauugcuggcaacucaccuagaagcugaacuuccagacaaaguauaaauuugguggugccacaguuuugaagauuauuuucacucaaugcaauaaaaggauauuacagaacucuagcacaaauuguagucaaagauggagacgcgucaaugacccguuuguuuuuaauguguuuuaauguuuuuguuuuuaauguauccaugguuuccaguuccccugagaaaguggaaauuacccaugcuaauaaagcaagcguuagugcgaagaccuagcugauguuuggcugguuuuuagcccgcuagccagucacccuuuauaaagccugccaaguuuggagcguggguaauuuuacacgcgggucuccacagauccugucuacuucgguagauuuauuacuaggaaagugcgugggggcacuaauuuuugugaauugacuaaugcguuagaauuuuaaaaaccggguagaacgcagcgcaggaagcgagcguuccccgccgcagcgccggagcguccagccagaaucccccugcaugcgcagccccuggcgucuuacgucccacaggccccaccccggcgccuuccgucccgcaggcuccgccuuuggcgcugggcucugacgucaccaccugcgccgcucacaguagaaacaggaagugggaccaaaacaaaggagcggcggccgggagcggacuuaccuuaccuucucugccuucggcgcgcuucucagccgggccgccgacccaaaggagccguccgacuaugucuaacauggagaaacaccuguucaaccugaaguucgcggccaaagaacugaguaggagugccaaaaaaugcgauaaggaggaaaaggccgaaaaggccaaaauuaaaaaggccauucagaagggcaacauggaaguugcgaggauacacgccgaaaaugccauccgccagaagaaccaggcggugaauuucuugagaaugagugcgcgagucgaugcaguggcugccaggguccagacggcggugacgaugggcaaggugaccaagucgauggcuggugugguuaagucgauggaugcgacauugaagaccaugaaucuggagaagauuucugcuuugauggacaaauucgagcaccaguuugagacucuggacguccagacgcagcaaauggaagacacgaugagcagcacgacgacgcucaccacuccccagaaccaaguggauaugcugcuccaggaaauggca

SEQ ID NO: 18585 - RNA, 3153 nt, Homo sapiens
cuucucacaucaaaauagggaucauuggcugggugcguuggcucauaccuguaaucccagcacuuugggaggcugaggcgggcggaucacgaggucaggagaucgagacaauccuggcuaacauggugaaacccugucucuacuaaaaauacacacacacaaaauaaguuagccgggcaugguggcaugugccuguaaucccagcuacuccagaggcugaggcaggagaaucgcuugaaugugggagauggagguugcagugagcagagaucgcaccacugcacuucagccuggagacagagccagacucgucucaaaaaaaagcaaaacaaaauagggauccuguuuuuuuagccacagggcagagaugguucucuggcucucagcagugauucuuuuucccucaggccugggcggaugauguggagcgguuucagaaaauguucagacacccaagucauguacagcugaagguaguugcuggaaaccaugacauuggcuuccauuaugaguaaguaguucacaaaagcccugcacccugagagcucuuguuaacuguaauucuaaaucuguuggaauucaggugaaagcccuauuugugcugucuugaaauuuguuuucuucaaaagaugugagcucugggauauuaaacucuuuaagggguuuuuacuuggugcauaguacacccucaacaaauaucuguggaaugaaugaauuguaugugcccuugggaaacaucuaacuugaaauguacauuuaauggccaauuauugucuuugggaacgaaaaaccaagaucauuuagacuuuaauagcuaacauuuauauagugcucuagugcuuauaaugugccaucuguuucaaguacuuuacuuccauauauuaacacauuaaucuuuaccaugguccuguuguuuuaccuacgguaccaauguggaaucugaggcccugggcagcugaguaacuugccccaggcuucauaguaaguaguggaacuaaaauuugagcuuugcuauccuggggccagguagagcccuuaacuaauaaugcuagucugaaacucaaguguugaaaguuauuuuguguucaugaugacucuaggaguuucuaaaauggcuuguccugaaaaauguuucuucucacaauugaauauaggaugaacacauacaaaguagaacgcuuugagaaaguguucagcucugaaagacuguuuucuuggaaaggcauuaagugaguauuauuuguaaauucuuccaagaccuuuaguccuuggaaacuucauuuuuuaaaggugccugccauacugggaucuaucaucuaccugcguucuguuuagccugguuuaugaucuuuaaacagcagugccuuaggcuguccuugcuggugcucaccaugggagccgauagaugggaaaccucaaaccacccugguuuuccuugacaaccccauaaugaaucggucaguuuaugacucugcccagccacugugggaaugauagucuuucugucugcacugucucuggguagcacaaauuucaucagcccacuuuguaaaagagucuuuauuugaucaaaauauacuaauuucacguuacaaagacuguucucguaguuauggugucauaacuacuaugggauuugguggcaagugugucacaguuccucuguagcucugugccacccaucuccauuggccugggcuuuuagaccagagcauccugacccuuagccugaccaugagcagcucccgcucugcgaggccaccucagugcccaucucuacauccuuucugggcuguguauguggcugcagcacaguggacaggacucuauacucuauacugauuauagacgcgguggagaaaacaggugggaguggaagccuuuucucuuuuaaucuuguccuuccugugggugcccagcacucuguugaccuuggacacagcaggucugcaggugaggucauuucuguccaguggcuucaccaccaaugcucaccuuucccucugccaggaaggcagagucucuaguagguggcuuucucugcugacucauaauagaagcaugauacaguuugaauuauuucccucuaaguguguguuuaagacacuucaaacagcuuaucauacugcugaucacuugauaacuccacuccuuaucucuaaaacgaguuaaauuucaagcagucuuuacugacagguacuuucgucauuccaagaugguaugcauguaggagauaaaaccguauuuagugggagucuuuaaaaaaauguggcugcugagucuaaccacaauggacuuuguuauuacccuaguuugggauuauccauacccaguuagcucuaaccggcacccuacccucugccuuacuugcugugugugucuguaugucacugaugcacucugugguucccucuaccuguuagucacaauaucugacacguacugaguacuuucuaguggcaggcuguguucuaaacaccugccaugucauuucauugaauccucacaaccagcugauggggugggcauaggguucuuagcccugcauggaagaggcgcuguaacagaugagguucugguuggaggaugagcuuagacauagucuaacugcagagcuucuguaaucugggauuucucacaaguuuagggucaaaaacccuucgaucgugucuuagacagaacucccaguaaugcuauuuuuguuaauauugacucauauuuaaaaauacaccaaauuauucugggugggauugaaagcugcucugggcuuguuucuuugcacuggaugcuuagcuuucuuuucaugggaacaguagggaaaagaaagcacugauacccccagcggccucaccugcguuucccuccgcuucagcuuugugauggucaacagcguggcgcugaacggggauggcuguggcaucugcucugaaacagaagcagagcucauugaaguuucucacagacugaacugcucccgagagguaggagagcaucugaaugccacaggugccuucugucccguguugcuccgcuucgguugcucacucagcccccuagcgcuucuugcccuuugaugagggucaggugugcggauuaauggccugacuuguacccagcaggcacguggcuccagccgguguggaccugggccuc

SEQ ID NO: 18586 - RNA, 3908 nt, Homo sapiens
cuggccucucuggcuuggcccuggaaguugcccccaagggcagcuccggagagcauggcugcccagacccagggaccacccugaggggcuggcuggucaaaugacucuacugaauccagacuuauuauuccuauaucuauggaaaagggacgcagaacgguuccaaaucuugcaggcuugaggacagacauuuucagacuccuuuacacuugagcaaucuguuucacauuuucuuccuucugaauggucagugaacagccacacuaacaggaaaacuccccacaaauucaaucugcuugacaccaaaacauuugcauuaaagagaaaaaauaucaccggaucuuccaaaugauugucuuuauggugcugaaaaucaagaugugcaauuugcagaucuggagcacagugacugaauuuuuuuccuuuuacaucagaccauuuggcacuuuuuuggggggagaugggaaauacuccaauguuaugguauuuggagguggaaucuuugcuagguaauuagguaaugaggguggaguccucaugaaugggaccaguacccuuauaagaagaggcuggaggcuagcaagcucuuuccacaagagaagguggcaguuugccaccgggaagaguggccucauccgaacccaaccgugcuggcacuguggucucucaugucugaccuccagaaugagaaaucaguguuugcuguuuauaagccacccggucuacgguacuuuguucuagcagucaaacuaaggcugaauuucaaaguuuuagcucuuauguuuauauuuuuguccauuugaguuaauuuuugaauauguuauaaggguccaaugucacucuucugcauguggcuauccagaucccccaucaccacucugaaaaggcuguccuuuccccauugaauggccuuggcauccuuucugaaaauuacuugaccauauauuugaggguuuaucucuggacucucuguucuauuccacuggucuauauauuugucuauaucccagcaccacacuacaaaacuuacuacagcuuuguaguaagucuugaaaucaggaauugugagaccuuuaacuuuucaaaucuuuuuuuuuuuuuuugagauuauuguggauauuuagggucccuugagauaauauauaaacguuaggauggauuauuuuuccuauuucugcaaaaagccucauugggauuucaaaagcgauuacacugaagucuguacacugcuuuuaguaguacuaacaucuuaaaaauaguuaagucuuccaauucaugaauacaagauaucuuuccauuuauuuguauuuucuuccauuucuuucagcaaugcuuucuauugcucagugcacaagucuuucaccuccuuggguaaguauauuucuaaguauucucuuuuuuugaugcuauugaaaauggaauuuucuuaauuuccuuaccgaauuguucauuguacaugaaaauaaaugcaauugauuuuugcauguugauucuguauccugcuaacuuugccaaauucauuaguucugacacuuuuuggguuauuuuuaaaauagaaucuuuagaguuuuuacacauaaggucaugucaucuucuaacagauacuuuuacuucuuccuuuccacuuggaaugucuuuuauuucuuuuucuugccuaauugcucuggcuagaaugucuaauuaauacuauguugaacagaaguagugaaagcaggcauccuugucuuguucccggucuuacaggaaaagcuuucagucuuuuaccauuaaguaugauguaagcugugggcuuuucauagauagccuuuaugauguugaaguagcuuccuuccauccuacuuuguugaggguuucuaucaugaaaguauguugaauuucaucaaacacugauggcagugguggcccaucuggagcagcugcugugaagaugcuggcugcagcaggggaggcauggccagggcugugugcuccacggagccggugagagccaggaacaggugggagcccugcccucuucugaguugguagggcaggagcccugcccuccugggugcagcugcagucacaaagcugcagcugcggacccagggcaucccugugcucucaggguccuagcgaaguccccugccccugcaggcucagaagugccugcuccugcuaccuggcuucuccccgcuccugcugccugcuccaauuuuggagcaaagcugaggcugagccugggcacugucacaauuuggccaggugugucacaauuuggccaggugugucacaauuuggggcagcgcugauaugccagcccccugccaccucagcccccuccggacuuugggugcugacgagcaucagugggaggcugaggcaggggugggcugaggguggguuggugugggccugcaggugccccuugacaccaacagccugggcaccguguacaugacugauggcagcaggaggcagacaggcuccugggcaaaaaggggcaggucccugcugaagccccaccuucaagccaggaauggccuaaagcaugggggccaagcugucaguucugaguggaguccacagaccagaguaagaacuuaggaugcuuuuucugggccugccuguggccguccauggaccaaucagcaugcacuuccucccuuuugagcucauuaaaaauccuggauucaguuugacuugaacagacaucggaucaaccugccuguggauaggagcuacucacugcaggucuccucuccacugacggcuagacacuuauuggcaugaccugccugaggaaaggagcuacccauugacagacagacauugggaugaccugucuggggaaaggagcuacccucuaugggucuccucucugcucugagcuggacagacgucaggaugaccugccuacagaaaggagcuacccauugacagacagacauugggaugaccugucuggggaaaggagcuacccacugugggucuccucucugaucugagcuggacagacagacaucaggaugaccugccuacagaaaggagcuauccagucugggucuccugagagcuguucuguugcucaaugaagcuucucuccaacuucucacccaccaguuguccauguaccucauucuucuuggaugugggacaagaacuugugacuggccgaauggugggacuaaaagagcuguaacauaaacagggcugaaacaugccccuccacucaccacacugugggggacaagaaggaaagaagagcugugacccuuagggcagcccagaccuaggguucuccuggccagggcugugacaccaucuuugggacucugcaguuccuggugucuccaagcuuccggguaccaucacauuccccucauccagacgcaagugccugcaguggaugcugcaugcaguguaucugguccagcugcagccuugcacagagcaagcaccugugccaguaccuggagcugccugcccugcugcagcaaccagcgcaccuggcugugcacaguggcuggaccuugcacucacuugcucacacaccccucaccauucugugccuggcuugcccuuggcaggugugggaucugggccaguaacgugagcugagcgcagccugccaggggaagugggcaggaugagcccagugggcaugagcaauacucaggcagaaggcaccaccagccacaaagguuucugacuggcgaagugacacccuaaggauccugugacaauacuauuucugcaucaacugagaugauugugggacaagaacuugggaccugcugaaugaaguuugggacccccaacuucauucuguuaauguaguguaugacacugacugaauuucauguauggaaccauccuugccuucugggaauaaaucccccacuuguugaugauguauaauccuuuua

SEQ ID NO: 18587 - RNA, 1744 nt, Homo sapiens
uuucuuuuuuuuuuuccugggagaugguguucaaacugguaggaacacacaccaagcguaacuuuccuugauucugacacauuuauggucaucauugcgcucaaacugucuucaagccucuccucuuuuccuuccagaucaugcaugccccgcgguccagggacagguucacagcgccguccuucauccagagggaucgcuucagccgcuuccagcccaccuaccccuaugugcagcacgagauugaucuuccucccaccaucucccuguccgacggugaagagccaccuccuuaccaggggcccugcacccugcagcuccgggacccugaacagcagauggaacucaaccgagaguccgugagggccccacccaaccgaaccauauuugacagugauuuaauagacauugcuauguauagcggggguccaugcccacccagcagcaacucgggcaucagugcaagcaccugcagcaguaacgggaggauggaggggccaccccccacauacagcgaggugaugggccaccacccaggcgccucuuuccuccaucaccagcgcagcaacgcacacaggggcagcagacugcaguuucagcagaacaaugcagagagcacaauaguacccaucaaaggcaaagauaggaagccugggaaccuggucugauuccuuccaacgugcacuucagcuggagaaagaaaccaagaagggaagcggccgcugggccccuccugcgcacaguguuguucaguuucacaugguacaaauaaguaaaaccaaaugagcaaacacggucuuuguuucugauuccuuuuaggggaauugcaugcaaacuagacugaaaugauacaaacuuccaucuggucugaccgcaaacaguguuuauuuggggacagggguugggaugggggugugggcaggggaaaacagagaacgggaugcuuugaagauaccaugaaauaaaacccacagagguauuugauguauuuaauugugaaaggagacuuugcagauaaaugaggccagaauggcauguuuuauaauuaacugaauaaagaaggaagcauuauuauauauuauuguggggaagaaccagccaguucgcuuuuucuccuaagguguggaacuuuuauuuuguuuuaaaaauaugaaucaaaauuccuguguugugugccaagguauaaaguggagaaguuagaugagugcaaggagcuccuuuguguugugaugauguguuuuaaaaguugcacuaucuuaauguugaaaauauuuacaagggaacuguuuuacgugaaguucuguauguugucuuuucaccuguggauuguaaucaggcccaaggaauauccuggagugguccccagaagcauccaagaaaagauauuuggggacguagccuaacauuuuaccaacuuacguaaaucaaaaaagucauuauuguugcaggaguuugcaucaaauagcagugcaucgcugaagcuuuuggagacuuuuggauggaagauaagauagggaagauuaaguuccagcauuucugacuuguuauuuugaguuacucugcuacucuuaggcugcauaguuuaugagaaaaugaacacaugcauuuauggauccaguaucaugcagugcugcccucauccuccagcagugcaauuucuucaguaauuuagauuuuuuucacuauagcaugaaauauauucaaauacauaccuuauuuuaugcaauaaauuguuuaaaaugca

SEQ ID NO: 18588 - RNA, 37922 nt, Homo sapiens
cacgugacucucgcaccuccggaagugacguaagcagacacgcguggcgcgggccgccguuuccgcaaacagaaucgcguuuggcugugcuggugagugugacggcuggaacuccggcccuuccuuucuuuguguuugucccucggccgccguggagggguggaacuggcacucccaccccugacaugggcucacuucgcauuagcccugugcuucacuacccaacgcgugggucuauugccuuguguccucagucccaaggaaaaugggaacuccuuggggugggcgggcgcuguuccuccuccagacugggcgagcccgggugggagaagcagcucgaagagcugcuccagcucgcgccccagggccgugcuggggaggggcgugggguccgcagguuugucuucagcggcgcuucggaaaccugaaccagagguugaguaacaggccgcgcuaaugacggagggggugaacuuggcuggagaagucccuucucgccucugugcguccucucgggccccgugguagagggucaagcgggcgggucgggacuuagagcuuaucccgcuugggcuuuaucccggcggcccuggcggccugcucgcucguacccugaggagcugaaaugacgcagagacauagcuugcuucggaggugugacuggaaagccgggucgaaauguucgugugguuauuuaucgcguguccaucuccaugucagucgaccaccuuucgaagguuucuugaagauucugagggacagcucucuucccuauggaguguuuucauuauuccacuuugaguuugguuuggguuuuuuuucccccaauuuguuaaauugauacauagaaguugcacauauuugcaggugcaggugauacuuugauacaugcauacaauguguaacgacuaaaucagggcaauugggauauuugucaucucaaacauuuaucuuuauguugggaacauuccaauuuuucuuuuagcuauuuugaacuacacaauaaguuauuguuaacuguguccaccccacuguacuaucaggcacuagauuuuauuucuucugggguuuuuuguacccauuaaccaauuucucuucuucaucccgcuccucuuccugcuacccuucccagucugugguaaccaccaauccacucuuuaccuccaucagguccacauuuuuagcucccacaugaguaacaacaugauauugucuucaugugccuggcuuauuucaguuaacauaaugacauccgguuucauccauguuguugcaaaugacaggauuucauucuuuuuaaugacuaauauuccauuguguauauaugcuacauuaucuuuauucaucuguugaugaacgcuuagguugauuccauaucuugacuauugugaauaaacuugagacugcagauauuucuuagauauacugauuucccuucuuuuggaucuguacccagauuugcaaaacuguucaucggacaggggauuaacaaccagaauauagaagaaacucaucucaauagcacuaguucuauuuuuuguuuuuugaagaaccuccaucauacuuuucccaguauguaaauuaguggcugugcuaauuuacguucucccuaacaguguacaaguguucccccuuuucugcauccugcauccucaucagcaucuuuuuuuuuuuuuuuuuuuuuuuuuuuuuuugugugugugugugugugugugugugacggagccuugcucugucgcccaggccggagugcaguggcuugaucucagcucacugcaaccuccaccucccggguucaagcgauucucaugccucagccucccgaguagcugggauuacaggcgcacaucaccaugcccggcugauuuuuguguuuuugguagagacgggguuucacuauguuggccaggcuggucuagaacuccugaccucaagugaucugcccaccuccaccucccaaagugcugggauuacaggugugagccaccgugacggccucagcauccauuuuuuaaaaaucuuuuugauaaaagccguuuuaaccgagaugagaugguaucucauugugguuuugacuugcauuucccugauauuacugauauugagcauuuuuuacguauauaccuguuggccauuugugugucuuuuaagaaaugucuauucagaucuuuugcccauuuguaguaggauugcuucuuuuuuuuugcuauugaguugaguuucuucuguauuccgguugugaaucccgucagaugaaugguuuugcagauauuuucucccauucucuagguuaucucuucacucuuguuuccuuugcugugcagaaguuuuuuagcuugauguaaucccauuugucuguuuuugcuuuuguugccugugcuuuugaggucuuaccacaaaaaucuuugcccagaccagugucuugaagcauuuccacaauguuuucuucaaguaguuucauacuuuuggguauuaaauuuuucaguccauuuugauuugauuuuugcauauggugagagagaguggucuagauuucccagcaccguuuuuugaagagacugucuuuucacuauguacguucuuggcaccuuuguugagaacaaguuggcuguaaacaugaugcuugguuuuaaacguucuuacuuauuuuuguggucaucuggaaugcugugucauuucuucugaccuaauuauguuuuuauuaugucacaucugugauaucaugaaagugacauaaguaaaauucaugcuuaaaucucaauauuaauuuuagguaauaaauauagcuaaagauaagucacauuucuuuauuugaauuuaaagccaauuuccauuaggaaaucaauggcagaggaggagaaauaggaauuugauaaguugguauccaguuuuucuagauaaucauuuuaaguauuuguucugaaaaucacuuuucugauuuguuguuguuguucucugauucaguucuauuugguacuucuugguauuuuguuaccucaaauggugggucaugaaaacuaauaaccauugaaacccuuacccauucauagugagugacuuguuacccauuccuuuaagcaacuugauuucuuauucuuuuucauuauccaaaaggcuuuuuauuuauuuacuuuuuuuuuuaagcacaaacacuuccuucaugaaaaagcuuuuuuuuuuuaaguggggucucacuuuguugucuaggcuggaguacaguggcacaaucauggcucacugcagccuggaccuccugggcucaggugauccuccuacuucagccugcugaguaacugggacuaaggcaugugccaccaugcccagcuauuuuuuguagagacgggauuuugccauguugcccaaccuggucucgaacuccagagcucaagcagucugcccaccucguucccccaaaguggugggauuacaggugugagccacugugcccagcgaaagcuuaacauuuuaauagugguauauaagcuauaaacaucuugaaaacaugauuuacauugagcuucuccauaguaggaggucacuaaauuuguugaauggcuuaauaaaugaaccaccauaauucuugcccaauagauaguucaguuauuucucucgcuuucccaucuuaauguaggucuaaaaacauauuugaaagagacuuaauggucaucaaacugcaggcugaguccugaaacuugucuaaagccauuucuacucucuucacuuucuaccuaauuggaacacccauuaugaaauacgauuucagaauucuugcuguagaaucccaaacuuuuucuguucuugaugcccuuaguguccauaggccaaaagaaauauaacaguuccauuuauuaaguaguuuaccccaaagaauuuaaaaguauuuauggucuaacaacuuuaugucuguuuaaaaaauuaacacacauaaauuggggggaaagguaauguuucuguuuuauucuugauuaaucacaaucccuuacuaacaggaugugugaaccuauuggguacuguacaacuucaagccucgaaaucagauaggcaccaccaaccucauuuccuguuucaccuugauuuucugugauaccaaaaucucagcuucacaaagucauugaaagguauguaguguaaucuauucagcuggaacugugcuguacuuaaagcugguaguuucugugauaucuuccacauuagguucuguggugccuguuuguuauggugccaaccaugcaguuugggaaccaggguuauagaguaaggaucagaaccaaaauggaacuagugcauguguaucgccacuucauuugucagcuuuaaugccaacagugacuuuuaugaauaagauuauagaauuuuggggggauuauaauuaguacugccauauucagaaauucauacauaguaucaguuaacauuuuuuaauaugcucucuacaaugagauuuuuuuaaacuccuaguugaucaaauucuaguuaaaauuauuuuaggccaggcgcaguggcuuacgccuguaaucccagcacuuugggaggccaaggcaggcggaucaccuggggucaggaguuagagaccagccugcccaacguggggaaaucgcgucucagcuaaacauacaaaaaauuagccaggcgugguggcaggugccuguaaucccagcuacuggggaggcugaggcgggagaaucacuugaaccccagaggcggagcuugcagugagccgagaucaugccauugcacuccagccugggcgacaagagugaaacuccgucucaaaaaaaaaaaaaauuguuuuaaagucuuaguguuuacaaguaauaccaauuuuuuuccuauucuaguguugguucaugaaguuuuaccaucaauucaaguaaucauaaauggcaaauucugcaaaagcagaagaauaugaaaagaugucucuugaacaggcaaaagcgucagugaauucugaaacagagucuucauucaauauuaaugaaaacacaacagcuucugggacugggcuuucugaaaagacuucugucuguaggcaaguagacauagcaagaaagagaaaagaguuugaagaugaucuuguaaaggaaaguucuaguugugggaaagacacuccauccaagaagagaaaacuugauccugaaauugucccagaggaaaaagauuguggugaugcugaaggcaauucaaagaaaagaaaaagagaaacugaggauguuccaaaagauaaaucuucuacuggagauggcacucaaaauaagagaaaaauagcacuugaggauguuccugaaaagcagaaaguauguucaguguauuuucauuuauucauaauagaauauguaaguuugaaauguggaacacccguggauucauacugguuuuuacauaauagcuuaagaauguucuauuuuuaauagauaugguccuaagacaaaguaggcuuuuaacucuuaugauuucuguuaaggugaaacaucuccugcuaaugagauagauuuuuuaguuuuuguuuguuuuuauuuucuaaugagauaauguuuaucuuauuuuagaauauuuaacuagaaacuuuuuuuuccgagacagagucuugcacugucgcccaggcuggagugugaugguguaaucaaagcucacugcagccacaaccuccugggcauaagcaguccuccggcguuuuuaaaaagacuagaguaugagauccaaaugauuuaccuauuuuucuuuuuuauuagguguucagcucuaguuuuuuugucagagguuaucacuuaaagggauaacuuuuaaaauuauaccuagcuuuacaucccuuuauuaauguaauuccuuaaacaguuuucagcuucuuauuaauguauuuuacauacuguuuuaguuaagugaaugcaaaugccuaauauuuagcaaagauauuauagggcaaguuguuuucaucuggaaguaccacauuagaaaggaauuugaggcagaaucuggaguuagaggaaaagauuacuuuaaugaguaaauaaaauucugccauuggcccuuaugaggaaagugacugauagugaggcuuuugucaucaauggaaugugaauucuuguaacagaggggagcccccccuuuuuuuuuuuuuuuuuuuuggagacagagucucacucugucuccuaggcuagagugcagugguguaaacucggcucacugcaaccuccaccucccgggaccuccaccucccggguucaagcgauucuccugccucagccucccgaguagcugggacuacaggugcccaccaccaugccuggcuaauuuuuguguuuuuuaguacagaugggauuucaccauauuggccaggcuggucuugaauuccugaccuugugaucugcccaccucagccucccaaagugcugggauuacaggcaugagccacugcgccuggcugggagcuuguauuuuaaacauaguuuucaaacuuuuacuagccccagaaccccuuuuucaacugaaaaucuuacacuuaaaccuguuacguaaaauaggucaaggauuuguuugaaaggccuuucagcacaucagugagauucagcacuuuggcugaaaagggagguaggaggauccgaagcccuuuaccuaucauggcauuuuuacaggauuucuagggccucaggaagcacaaauugaaaacuguuggguuacauguaacauauauaauagcauuauuauaauagaaaucacuaacgcugcacauagccuacugaauucuaaucucucuuuuuuuuugagagucucgcucuguugcccaugcuggagugcgguggcccgaucucggcucacugcaaccuccaccuccuggguucaagcgauucuccugccucagccuccugaguagcuggaauuacaggugugcaccaccaugcccagcuaauuuuuguauuuuuaguagagauaggguuucaccauguuggccaggcuggucucaaacuccugacuucaagugauccucccaccugggccucccacagugcugggauuauagguaugagccaccucacccaggccuaaucucuuuauauacauuaucuuauuuaauuuucacaacagcuuuauaauaauaauguaauuauagcuuauuccuaauuuauuccuuuguagaaacaccaaacauugacugucauuuauugaacugaauaaaucagaacucuggaagaguacuggguuuauuaagacauugacacuaaaauuaaugcagaugaaauaucacaaugaaaauuuuaaaccuagagauguuuuucaaaauaaggugauaugguuugggugugucccuacccagaucucaucuugaauuauagcucucauaauucccacaugugugggagggaccugaugugagauaauugaaucaugggcgcaguuccccauacuuuucucaugguagugaauaagucucacgagaucugaugguuuuauaagggguuuccccuuuuacuuggcucucauugucucuugccugccgccauguaagaccugccuuucaccuuccaccaugauugugaggccucccccgccacgaggaacugugaguccauugaaccucuuuuuguuuauaaauuacccagucuccgguacgucuuuagcagcaacauuaaaauggacugauacacagggacacagaaaacaaaucuuaggucuaaugauaauuagugagacuucugugguuaauugccauuguuuagugaaguuuaccaauucuaauagcauuuuauccauucacaggucaaauguucugaggcuuauuuuuaccauguucugauccuugauuuuuuucuauucucuuuuauuuucagaaucuggaagaaggacacagcucaacaguggcugcccauuacaaugaacuucaggaaguugguuuggagaagcguagucaaagucguauuuuuuaccuaagaaacuuuaauaauuggaugaaaaguguucucauugguaugauccaacaccaagcuacugagucuuuaauuccuauucauuuaauuaucaaaccuugacuuuauaaagcuagagccaagacuaggucuugaagacaaauucuucuaauauuuacuuuugguugacuguguaagauuuuaaugaguguuuaauuauuauguuaaucagguuuucagaaggcaauauuuuuuuuaaugcacagaauuaagguuaccuaguacuauuaaguaaugauucuauuuuacucuaauaguuuuggagcaacugcauauuguugguuaaacauucagguuucauuaagucaagaaauaggcagugucuugauuuguuuaggccuucaauuaguugauaaagaucauguguauuacauugaggauagauaaaaacauucaacuuuuuugagccaacauuuuaucuauggaaacucaccuuugaaauuaaaaugaaagugaacagagaaaauaugauucagaauacaauucuugucggcaccguaagauaggguaaaaaaaagaauauaauuauugcucuguauauuuagugcauuaaguagacucuuagauaaauuuagagaacuuuaaaaagugguuuguuuuaaaauuuuucauaauaaagauuuuuuuaaagccagucaaagaagaagugagaaugcuuucuuaauuaugcuagaaagaauaaagugcuaauuauggguacuuccuacuaguuuugaugauaauuuacuaauuuucaaagauaaauuaccuaaucugauaaguauuagcaguaggaacuaacuaggcuuacuuugaacacauuuuaacauuuuguauaucacuuguuuuuaacauucauguucuguuacaaaaauauuuauuugacucugccaugugucagcuuaggcuaaaugaguguucacuuuuuuuuuuuuuuuuuaagauuaacguaauggcauuuucagucucuacucacaagguucucucucuaccccaguccuaauuucuuuucagccuuucucuuccuucauuacccucaaugaugcagauaacuuauuggauuuuuuaugaauacuuauuuauucauguauuuuuuuauugaauaacuuuuucgaguccauauuuuccacauuguuacauguauuauuucuauaaucagaaaagagguauuuuuuuuuaaaggacugaagucagaguuggcaaaauugucucuuggcauauacaggguauucuuuccuuuuucagcuguucuagcagcucucuugaugugugcuuugcaccuguguuuaacauccuaauacaaucagugugaucugugccaagcuuucucucuggcuguuuccuuucucaacacucauucuuugucacucauuuucucuuuuuucuuggugcuuguagcuugguaaguaaacaguugaguauaguucuugaaugugauaaaggcuuuuuugaaauuguuucuugaugauuuccucucucguuagucuuacuguauauaaaugcagagauuuuauaauuguuuuucgcucuuucaguauuuuuaugcuauuaagauucauggcagaaaguuaaauauuauggaacauuugugcuucuguugaaguuacuuuaaguuccugcagaaggugaaaguacuuguacaggauauuuuuagccaucaaaauaauacacaccugaaaguguccagcucagugauaaagacaaggagaauguaucuaggauucaguauuguaucaaguuuuagaacuguugaauacuuaacuugccugagaauauuaauaugcuuuuaaucgacguuugaacaauuugccuauugauguuugguugccuacugauuuuaucuguuggcuguuaaugucauuuaguagacuggggucuaccaaauacugaugaugcuaaaacuaaaagacauagugcuuuuuuuuuuucuaguuuuuauauuucucuuggugguaagccugacaucuuugauaaucaggcucuuuuaucauuccauaacaacuuugauuuacuuacgugucuacuguuaaacaccuagcuauggaaagagaaagcuacaaaaaaaaauaugaauaauuaguuuuucuaauccuuacuuagcuuuuucucucauccugaacaaguguuguguugucuuauauuagaauuuuaaauaucugcuauuuaaaauucauuuuugaaaguuaacauucaaaaugcugccuuuauuuuccaaaacaccagacacguacucuuuaaugauagaggaucagauuaaucaacucuuagucauauuuuuaguuacuuaucagaaguuacaaauuacauaaauggauguguaauaguuuauguuacauauugggcaaaagauaguagguuauuagagguaacaguuuauacuucaguaaaauugaagaagagguaguuuauugugacugauuucucucuuuuaggagaauuuuuggaaaagguacgacagaagaaaaaacgugauaucacuguuuuggaccugggaugugguaaagguggagauuugcugaaauggaaaaaaggaagaauuaacaagcuaguuuguacugguaagauaaauaaugauaugggaaagaauaauuuguagucagauaaauggaaaauaagaaggauugucucaaauugcaagauaucugggacuaugcaugagauggguuuuuuuuaaauuaauuacggccugacgcgguggcucaugccuguaauccaacauuuuggaaggcugagguggguggaucacuugaggucaggaguuugagaccggccuggccaacauugugaaacccugucucuacuaaaaauacagaaaauuagcugggcaugguggugcacaccuguaaucucagcuacucaggaagcugaggcaggagaaucacuuuuaccugggaggugaagguuauaguaagacaagaucgcaccacugcacaccagccugagugacagagcaagacuccgucucgaaaaaaaaaaaauuaguuacaagacuuuccugauaguuucauaguaagauuaauaagccugggauaacguuuccuucccaaaaggaaggaagcuaucaaagauggucggagucaugucuaaagggcagacuugaaaagguuuccauuggcaaaaauagggcaauuuuaacauuaaaaaaaaaauagcaguuggacacaucaaaucagaaaaacacauuguucacccuugaagguugcuaagaaacuauucugaaacuuauaaauuaaggggaggaaaucaaacauuuguaaucagaugguugaaaagggcaguuccuuuuuuuuuucaaucagauaaagaggaauuauagaauuagaaaaucauaauuuuuuucauucuuuaugaaauaauagaucuaggcaauaauuuuuuuuuuuugcuacggaagccauuaagggaaaagucgauaguaacgcaaugaaucaaucaaucaaucaccuuagcccggugguuagucuuaacacugaagugggacaagcagacgucagcgucuuucugauguggugaguuaaaagagauacauacccccacuacugaaguacugcccaaauuagcaguucucagauuuuuugguuuuaugagcccuguauacuuaaaaauuauugaggaccccagaaagcuuuuuuguauguaauuaugguaaguagcuacugauauuuacuauauuggaaauuaaagcugagaauuuugaaaauauuuuuuaguucauuaaaaguaacaaggcuggcuuuuacauuuuuguaaaucccuuuagaguuugaaauugcaggagacaacuggauucucacaccuguuucugcauccaauauguugugauuuuauuuugguugauaaguaguuguaaaauaaagaaguauuuuaauagccuuuuuugauaauuguagauauuccucuguuacuacaucaaaacucaguaagugguaguuucuuaaagaguaguuacaauauggaaucugaaaccuuagugaugaacuuuuuauaccguguaacauuaaaauccauuaaucugucuugcacuuccugcaugauuuuauaguacuuggaaaauacuguucacuaaaguuaugcagaucuaauuguugagaaucaaaaaaucacguguuuaauaucacugccaaucagaaaaguauugggaagaaguccagcccacagugaucaauacgaguuuuucaggguuguaauucuuauuugaaagucaauuuuauuuuuggcaacaaauacacugucccuugucucccuuuaaauuagcgaucccuaaccuuuuuggcaccaggggccgguuucauggaagacuguuuuuccacagaagcggggggauggaauucuaccucagaucaucagguguuagauucucauaaggaguaugcaaccuagcuugccugccacucaccuccugcugugcagccugguuccuaacaggccguggaccuguacugguuugucgcccaaggguuggggaacuuuaagugacagguucacuuuguucauuuucaagaaaauaugugccagguacugaagucugcauaaccguaguuugucagucauucaagucaaaauaauuuucucagaaaaaaaguggccaguacagcucaaaacucagaacagucauaucaguacuguucuugaagaugaccaucauacuuuguuagguagcagaaauguuuuguuacuucccauuucaucacacaacauuuuaaaaaguguguauucaaaagcccagguuuaauaaaauuaauuuucacuauuuuauaaaggguauucuuaaaugaaacuguuuuucucccccugcauauuguauaguggugaagaauacaugaaguacugccaguaccauuuagugcugcuacuuuguauuugugauaagaucccauugccuuugcauuaucagugugaaucuuuaaacagggaaaagggcaggcugggcacagugguucaugccuauaauccccagcacuuugggaagcaaaggaggguggaucacuugaggccagaaguuagagaccagccuggccaauguggugaaaccccauccucuaccaaaaauacaaaaaauuagcugggcaugguggcacacaaccuauaauccuagcuacucgggaggcugagguaugagaaucacuugaacccuggaggcagagguugcagugagugaagauugcaccacugcacuccagccugggcaauacagcaagacucugucucaaaaaagaaaaaaagaaaagggcuaauaacauuuuauuauaaaaauauacccuugguauuuccaaaacugggcuuauugauaguguuagguuuuauaauucagauuggaauaaaacuuucuccuuuuuacuuugaauaagcauuuaaaaaucaugauagaacuuuuauagcguccguaccuauugagacgcuuuuaguuccucuugaaaacugauaggguauuugcgucggaacaaagcccuuuucuuuucuuuuaaaggaaauaaaaccuuuucacugguacuaaggcugacuuuuaugccagaguuugucaguugagaucaaugucuagauuucuggcauucuguguugauacuuacuaauacccuuccauccuuccagauauugccgauguuucugucaaacagugucagcagcgguaugaggacaugaaaaaucgucgugauagugaauauauuuucagugcagaauuuauaacugcugacagcucaaagguacaguuucuuucuuuggucaauuuauuuuuuacauuuuuaguuuggguaaauaauuuguuuuaaaaaucaacucaauuuuuacuuuuuuaaaaaaauuuacucuuauuuuuugagacagggucuuacucugucaccuaggcuggagcacaguggcacgaucucagcuuacugcaaccucugccucccaggcucaagugauucuccugccucccagccuccugaguagcugggacuacaggcacaugccaccacacccagcuaauuuuuauauauuuuguaaagaugggguuuugccauguugccaaggcuggccucaaacuccugagcccaggugaucugccugccucccauagugcugggauuacaggcaugagccauggugcccggcuacucauuuuuuaaaauguguuuugaaacuuuaaaaaucuuggaauaugcauuuucacuuuugacuggaaauucuauuaugauaaauucccuugaaugacucacugaauacuuguaauuuuuugcuuuuaauaauuugaauugaaauuagcuguugcuuuucgguauggacaucauuuauuuuccaguauuuugaaauagaacugaacuuauacuauguuuuguucaccuuguaauuuauuaguuucccaacauaucagagccuguuugguuuuuuccuaccuuccaccuguuucugaauuucuuaaaaagaacugcuucaagggugaaagucucaccaugaacuuuuuguucuucauugacuuauugacucacugaacuguuauagauaccuuuaaucauacacauuuuguuugaaauuugaaagugaaaaagauaagugggaguauacugccagaaaguuguaauaccuuuaaaacauuuuugcauuuuuuaaaaaaugccaaacgccagauguuuuuuaacucaaguuauuguugaaugucauuuuauuuuagcugucaaguaaagugaugaaaggaucaaguugaaaugucauaauugacuaauauauuuuaaacaugauuucagaauuccucaguuuuuaaauacugugaaagugggaaucaaauuauucuguuaaacuagaauacaugcaugauuucuguguguccuuuauuguacaagggaaagauugugagggaaaggaagaaccuuacauucuagaaguuaauuuacuaaaaaguuuuuaaucuuuguuguaguuaccucacaaucuuaacucauuuuaauuuguuucaggaacuucugauugacaaauuucgugacccacaaauguguuuugacaucugcaguugucaguuugucugucauuacucauuugagucuuaugagcaggcugacaugaugcugagaaaugcgugugagagacuuagcccugggggcuauuuuauugguacuacucccaauagcuuugaauugauguaaguacuucuaaauauauugugguuuauaaaauauucaguauuaaguagcaaauguuuaucagagguagauuuuauuaaaauacgcuauuuuaaucuuauaaguguugaacacuuucauaagauauuugaguagacauucaaaauuuaaauucaauagacaaauuuacaggugaacuuuuaacaguucaucuuuguguguaaguuagagacugaaguuauagugauagacaaacugcaggucagauacacaggcacagagaugaaccagcugucaugagagugauaccuacuuccagcuuaauuuuauuggugugacuguuggugaucuuuuaguauauugcuucuuaaaaguagcucaaaucaggagagugcaguggcucaugccuauaauccuagcacuuugggaggccaaggcaggaggauugcuugaggccaggaguuugagaccagccuggacaacauagugagaccuugucuuuacaaaaaauuuacaaauuagccagcaugguggcacgccccuguaguccuugcucaggaggcugaggcaggaggaucacuugagcccaggaguugguggcuguagugagcuaugaucacaccaccacacuccagccugaaugacagauuaagaccuugucacuuuaaaaaaaaaaaaaaaagguagcccagauauaauuaaaaggcuaaucaagugugcaucauguaguuuuucacaugcauaaucugaucaaaauaagucuacacuaaucacaauuuuaaucuuuuuauuuugguugggggauaaccuugauagaagacgccuugaagcuucagaaacagaaucauuuggaaaugaaauauauacugugaaauuucagaagaaaggagauuauccuuuauuuggcugcaaauaugacuucaacuuggaagguguuguggauguuccugaauucuuggucuauuuuccauugcuaaaugaguaagaagucauuaaucuguucacucuuuucuuuuugucuuaagggaaagaaaagcggggaaaagcaauauuuauuuuacucuuuauuuuaaaugagggcuaaagaaaaaguauaaucuuguuuuuuuguuuuuguguuuuuaaaaaaaaaaaacaaaacaagacuagcuucacaucuaggggauuauugccauaggucucauaauagccuaacuuaguuuucucucauuccuggaauuuuuuaauccugugggugaaaaagggaaccaguugccuucagcuuguggcacaaaaugccugacacugcaaauagcaaaaguuuuuuuuuuuuuuuuagugacuacugguaacuuugaugauaaacaaugagucuucauaaaucaaagauccggccgggcgcgguggcucacgccuguaaucccagcacuuugggaggccgagacgggcggaucaugaggucaggagaucgagaccauccuggcugacacggugaaaccccgucucuacuaaaaauacaaaaauuagcugggcaugguggcgcgcgccuguagucccagcuacucgggaggcugaggcaggagaauggcaugaacccgggaggcggagcuugcagugagucgagaucgcgccacugcgcuccagccugggcgacagagcgaaacuccgucucaaaaaaaaaauaaauaaauaaauaaauaaauaaauaaauaaauaaauaaaucaaagauccuccuuuugacagagaugaguauuaaaaguuguuugcauuucacuauaacuuugaaauugccuaugucucacaggcaauguugaugauaaaauccugauucaggaauguauucucccaugugccugaauuccuaggaguccuggcaaacuguagacacaggaaaagcuggggguaacugggccuuaccagguaaggcuucaaggccuugugauacaccuugguuuccagaguuuccccgguggggagaguauaaaagucagcuuaaauguaggccaugucaugauugauugaacuugauuuucuacuuuuuagaaacaaaaaucuuuuguuuugaauauuaacugagaaaaagaagagguauauugucugcuuacuucugcuuggugcuuauuuuaauuguaacucagucagucuguaaaauuaggguuacaguauuuucaggaguucuauaauagcuuauucaauaauauaagaaagccaaguagcauugugacugaacaugaggaaaauacugugcauaauuuuauaaauauaaaccauuuacaaaauuuaaaaauaucaauuacauuuuccuuuuaauuuuuaaaacuaauaaacuggggaaauguuacugcucuucaacuuuauuuaaaaaagaacuuaauuguggaauguuauugaguauguuuaauauguuagcuugagauuuuaguuaacaguuuggugauuuuaguauaaucaaaaagauaauaaaacaaaagauuuguuuuaaaugcuaaacaagaccuagcggucuucuuuuuuuuuuuuuuuuuuuuuuuuuugacuuaaauugccuaaugaugguaaaccuaagucaucaguuuaauaucuaauuuuuuaaaagauuauuuauugaaacaguauuggaugaaauagaaucugaaaauguguggggguuuugagaugccuuuuugccauuucauuaagaaauuuaacagaaauaagcuuuuuguguggcaaaacuuauucaaauugggccucaauucuuugaaucaugauuuuuuuagguguaaaacuugguuucauuucuaaaggguuauuuuagagauuuacaaacgaaaaugaacugccuggaauaaaaaacuugguuucauuucuaaaggcuuauuuuagagauuuacaaaagaaaaugaacugccuggaauaaaaaacuugguuucauuucuaaaggcuuauuuuagagauuuacaaaagaaaaugaacugccuggaauaaaagacuuaauuuugcucauguugccuuuccaaggaggauuaauugaaguaacagaauccugccuuacguauaccucuuacauagaaaccucaguggcccuccaguguuugcccuuacccuauccccucaaaugccacccuguacacgagccuucccaccuaauuuucaggguuucuccccuuccuuccacucuuccuuuaacugcugccugaagucaucuccaggcucccucuuguugucuacagauacaugauuauaaacuuggcaaaugcagugaggaaaaaaacuaccugagagucuaacggagagaccuaauauaauuaagauuuaaggaaggugccuguaaagaaucgauguuugagucaggaucuaaaggauggaaaaguaggugggcagcugaggacuggagggaagaaugcuccugacaagaggacagcgugugugagggcccagcagugggaaagcuaggcuaguccaagauguugaaagaaggcccauccugauuuauaucgggggcugucccaaaaugaggcagcauuccuuuacagaugaaugucuucgagaccauguucuguauccuaagugcacuggagcccaguggaggguguuaaggggguagugacaugacucagguccgcauuucugaaagcuuaaucuggcugcgauuggaaaauucauugagggagaguaagaauggaagcaggggacaagcaaagugaguuuauggacuggugccacugaguggugauggugacugaagcagcaggauggugccaaaugcaggagguaagaaguggaccuauuugaaauugauguuuucuagguaaaauagaaaggacuuagugauguguauugagcacaguggguaaaagagaaggggagauggcauggaucacuagguggauuuacugaaauggcaaagauuggcaguaaaagagcagugauguucagccuuagaugugggacguuagagagugccagugacacaugcaggugaagauuucuaauaagcaguagaauccaugagugaugagagacagcugaacuaccgauagcugggggguggaagugaguagggcucuggacuguacucuacagaaccuugaaguuuagaaguuggguaaaaaaaaaccuguaagugaaaaggaaaaaaaaaaaaccugcaaagaagcaguucaugauguaggggaaaaauuaauaguguaucuugccagagaagucgagaugaaagugaaucuuuaagaaggaaguuggcagcuguuugcagugcagcugugagagaucaaguaaagugaaauggaaucaguagaaaagaguuuccuacacuuuuuccgcaucucacagcuccggagacucucauuuacuuccugaccuuuauguuauacuaauagagcccucugaaaccccugagauuuagaaugcauguuucuuuuaggugugauauguuacucuugauucauuuuguauuacuguauugugaauuuaucaagggagugguagcuuuuuuaguuaaguccagaagaugucauugcuguacaaaaguaaguugaggaauuacaaacauguggaagcuuuuucauuaaguauucuuuuuuggacagaauggcaaagaaguacaauaugaaacuagucuacaaaaaaacauuucuggaauucuacgaagaaaagauuaagaacaaugaaaauaaaaugcucuuaaaacgaaugcaggccuuggaggugaguauuuagaaaagauguacaaauuucagucauggugaacuuguuuggcuguucuugagauccuugcaaggccaucugaacaugaaauaguuauguguauuacgcucuucagcaccuaggacggagcuugauacagaaacugcauggugagugcucaguaaauacuugaugaaagaaugaguacugguguuaccaaauucuguuuucuaggauaguacugcuuuaaaauaggauuucucagccucaggacuguugacauuuuguucuggauaaugccuugcugugggaugcugugcauuguaggauauucaguagcauuccuggcuucuacgcacuagaugccuuccaguaacacucuuguccccaguuacgauaaccagaaaacucucuccagacauugccaaauguccccugguggacaaaauugccccaaguugagaaccaguucuuuacaacagugccuuuugguuacgacaguaauuuagaaccuuccuggccaguguccagacaagcucaaaccauacauaauuuuauugcaugguaauucuuuagcaggguuccagucuuuuagacuguguuguugcugagaccucuccuguccuaaugcagcagugaagguaucuauauaagcuucaauuacacagccauugauuguuuuuccuuuuucuccuuaccagacaauguuugguuggacagaccuaaaauauucagugagcauuuuuauuauugaucaguagaaucauauucaucaaauggacauuaaacuuccuuagagaguuuauucaguuuaaguacuuuaagcauacucugacuucuuuauccuuauaauuaccuccaugaaguaggcagaaugguaacuuuucacuaauuuuuuuccuauuuuuuuuuuuuuguuguuaaugacaggaucucgcucuguugcccaggcuggagugcagugaugugaucacagcucacugaggccuucaccuucuggaaggugauccucccaccugagccuccugaguaacugacuacaagcgugugucaccacaccugucucaguuuuaaacuuuuugugcugaugaaguuuugcuguguugcgcaggcuggucucaaacuccuggccucaucaagcaauccucccgccuuggccucccaaaguacugggauuacaggugugagccacugcaccuggccaguuuucacauuuuuuuagugggcagccugaggcucagaggauaaugacuugcucaaggcauacuaaccuuuagauuuucuucaguuuuuguagaugauacucaaacagaagucuccuguugaaguugcaccugcacccagccacucccacaauguugagugggaggacuuuuuauaaauucuaaauugucuuuuaagagacauaaucaguaaaauuucauauuccucauuaguuauauuuccuauacuuuagaucuaagaauguuuuuauuggcuuuauauuaggaauggaugcuuguuuuguuugucuuaaggaagaggagaaaacuagcaaaacuauguguggauaagucccccugucccacauauacagcauaucuuuagcauauugccuuuauuugauggugcuuugcaugauaguggucaauuauuuagccuuucucuuagcauauggguagugaauucacuuguguaauguaugucaaaaucuacuuagguaugguaggguaugggauaacaagaauuuuauggcauguuauuucagugaauaaugcaguccaugaugggaacugcaguauugaagcauuccaagugcagugaguauauaaagggccuuuugggaaggaagaagauugguagaggacaggcagagaaaccagagugcacaggagauguuugaggaaguagugcuaauggccuucacaguucuucagcagucuuccuucucucccaguacugcacuuggggauaugaccuguuaccauggcugucuggggacagaagcaguaauagcauguaguuugaaaaauccuuugguuuuccuacuucuugaccaagucacucuggugggcguguaaaggacuuggagcaggaaaggacaugaccagauaagaguuaggacacuacuuggguggcauaaugggggaugguuuggagggacuuugagaccagaccagagguggaaagagcagucggaugccacugcuuucgaccaggucagagguuuaaauggaucuguuucuugauauuugucccaaaaagucuuuuccugaagcauccagcuuuuaucuggguucagcacuagaaccaguacaacuuuucugcuuuccuggagcguuggaacagagagaagaaagaaugaaaagauguaggccauggaacuguagguccugacaccuguuuucuuuuuuucaccagcaaacauauucuagggacaguucuggaaaaguaacuccuuuuagaggagacacuaagauauauauguuuuaauaaguuuuggucccggcaugguggcucaugccuguaaccccagcacuuugggaggccaaggcgggcagauaaccugaggucaggaguuguagagcagccuggccaacaugguaaaaccccgucucuacuaaaaauacaaaauuagccaggugugguggugcauacuuguaaucccagcuacucaggaggcugaggcaggagaaucacuugaacccgggagguggagguugcagugagcgaagaucacgccacugcacuccagccugggugacgaaacugaaacuccaucucaaaaaauaaaaucaauuuuaaaaaauaacgauguuuuacagcuuuauaaucauguauugguuggucuuucaaaaugaucaguagagaagagaaacuggguguccagugauaagcagauaaucacauggaggauaaguugaagaacaaguuuacaacaaaauaguuugacaggcauucaaaaacgaaguucugaagcuuugugauaugguaaaacuacaauauguggaauuaaaguucaaaaaaaacugauugguaaucuguucuuucuuagagcccuuuguugggaugugauacaaaguaaagugguuuaugcuaaugauacagcagucucaaauagcugaguacuucuaaaacagcaaauaaauagguuaauuucuaaugccuaaacuugcugcaggauguuuauaaagaaaagagacaaagaagauugcaaagcagauauucauagaucauuuucuuaaaaguuuauuagggaguuguacguuuaaagugccuccuuucuagcugguuuguugcaauaagacaaagaauuauaaagaauuauaaaugaauuauuaaaaacauaaacuuuguagaguagaugguucuauuaaauguuuuauguaauuuauuauguuuugauuugcauguaucugguuuguuuuuuggugagagaguuggggagacagagucucgcucugucauccaagcuggagugcacugacaccaucuuggcaucuuggcacacugcaaccccuuccccccgacccuucucccccagccucaccuaaacccggccuaagugauccuuucaccucccccuucugaguagcugggacuacaggcacgugccaccacaccuggcuacuuuuuguauuuuacguagagacaggauguugaaauguugcccaggcuagucucgaaccccugagcucaagugaucugccuuccucggucucccaaagugcugggguuacagcaugagcuaccgagccaggccugauuuacauguauuaaaaggcaaaaugcagauacuauaaagggauaucacuuaaaaugaauuaaaaauggcacuugaaguaacuuggauaaacauuuggccagcauacccuuaaaaacacagcauguuuuucugacccuuuuccagagucuuagguaaauaugggaaaugucuguauuuuggaggcuggauuauuaaacagcguucuauguugucuugacuuuuucauuuguauuauuuguaauugcuauuuaugcuuuucauggcuauuaaauugccaucauuuuaauauuuagcucuuuuuaugacaucuuuaagcuuuguauuuauauauaaagccuuuggcuaacaguagagaaggugcaaguguuugcugcuaaaugguucuugguggugauuaaauuauguagcuucuuucagcugugaauauccuaagauuaugauaaaaguugaccauaaggcuggauguggugguucacaccugugaucucagcgcuuugggaggcugagguaggagaauucuuugagaccagaaauuuaagaccagccugggcaacauacugaaaccuugucccuacaaaaaaauuuuuaaaaauuagccagcauaguggcuugugcguguagucccagcuacccaggagguugagguggaggaucacuugagcucgggaggccaagguugcagugaauggagauccugccacugcaauacagccugggagacagagcaagacucugucucaaaaaaaaaagaugcuaguuuacaucugaucuuugacaaaccugacaaaaacaagcaauggagaaaggauucccuauuuaauaaauggugcugggaaaacuggcuagccauauguagaaagcugaaacuggaucccuuccuuacacuuuauauaaaaauuaacucaagauggauuaaagacuuaaauguaagacauaaaaccauaaaaacccuagaagaaaaccuaggcaauaccauucaggacauaggcaugggcaaagacuucaugacuaaaacaccaaaagcaauugcaacaaaagccaaaacugacaaaugggaucuaauuaaacuaaauuagauguacuuaugcacagcaaaagaaacuaucaucagagugaacaggcaaccuacagaaugggagaaaauuuuugccgucuacccaucugauagagggcuaauauccauaaucuacaaagaacuuaaacaaguuuacaagaaaaaaacaaccccaucaaaaagugggcaaaggauaugaacagacacuucucaaaacacgacauuuaugcagccaacagacacagaggaaaugcucaucaucacuggucaucagagaaaugcaaaucaaaaccacaaugagauaccaucucacgccaguuagaauggcgaucauuaaaaauucaggaaacaacagaugcuggagaggauguggagaaauaggaacgcuuuuacacuguuggugggacuguaaacuaguucaaccauuguggaagacaauguggcgauuccucaaggaucuagaacuagaaauaccauuugacccagcaaucccauuacuggguguauacccaaaggauuauaaaucaugcugcuacaaagacacaugcacacguauguuuauugcagcacugauucacaguagcagagacaugaaaccaacccagauguccaucaaugauagacuagauuaagaaaauguggcacauauacaccauggaauacuaugcagccauauaaaaggaugaguucauguccuuuguagggacguggaugaagcugaaaaccaucauucuaagcaaacuaacacaaggacagaaaaccaaccaccacauguucucacucauaggugggaguugagcaaugagaacacauggacacaggaaggggaacaucacacaccggggggccugucauggggugggggccugggggagguauagcauuaggagaaauaccuaauguaaaugaugaguugaugggugcagcaaaccaacauggcacauguauaccuauguaauaaaccugaacgauuugcacauguacccuggaauaauauacccuaguauaauauuuaaaaaaaauugguuuaagagaggauucuuccuuuuuuuuaauuuuuuucuguauuucaaaaguauguauaguuuguauuccugaaguaguacuuacggauuauucuccuaauuauguuauuucagugauuuagcauguuuaauucugaauuguaaauuuccguuauuguaacuaggacuuucauuucuuuccccagccauauccugcaaaugagaguucuaaacuugucucugagaagguggaugacuaugaacaugcagcaaaguacaugaagaacagucaaguaagguuaccuuugguaaguuuuaauuuaugaaaguauuuuauagagaaugaaaaaaagaacaugcuuauauggagacauaggaaaugauuucacuuguuuacaauacuuaggcucacugacuuacaaaucaguuguuuccacuaagugauguugacuuguuauaaccacagaauauggaauaaaauuuauuucaauggacugagaauggagugcuauaucuaaggcaaugaggacagugaaaaaauuacaggguuggugugcaaguucccugcuaauguaggcaccaaugaaccacagcauuucauacauagaaugcagcaguccaggaauuuaaaugggaaaaaauuacaucuucaccuauacuaauuucugcguaaaaguuuacauuuuaagaaugauuacuacaauaguaccacagugguauuagcugcugcugugacuuugucaucaguagaaguuacagauauuuucauagcacauuuuugcuaauaucuuagaauauuguuuucauuuaucacaucuggaaaaaugacaucacuagaacugccacuagaucuuguuauuauaguuaauggugugugcaaagcaacacauaucuuuaauauuuugauagcuacauaaauauaauuuauuuccuuugugugauauguacuuuauuuuguuauuccuuugaaaaaacacaaaaauuguauuuuuuccaccagugcuguuugauauuucaagauaggccuuuuuuauuuuuucauuuuccaaauuaagaauacaagauagggccggguacaguggcucacgccuguaaucccagcacuuugggaggccgaggcagguggaucaugaggucaggaaaucgagaccauacuggcuaacagugaaacccugccucuacuaaaaauacaaaaauuagcuggacguggugacgggccccuauagucccagcuacuugugaggcugaggcaggagaauggggugaacccgggaggcggagcuugcagugagccgagaucgcagcacugcacuccagccugggcgacagagccagacucugucucaaaaaaaagaaagaauacaagauaggccgggcgcaauggcucaacgccuguaaucccagcacuuugggaggcugaggcgggcggaucacaacgucaggagauugagaccauccuggcugacacggugaaaccucgucuuuacuaaaaacgcaaaaaguuagcuaggcgugguggcgggcaccuguagucccagcuacucggcaggcugaggcaggagaauggcaugaacccaggaggcagagcuugcagugagccaagaucacgccacugcccuccagucugggcgacagagcaaggcucugucucaaaaaaagaaaaaaaaaauaauacaagauagaugcauuuuccaguuacacacacacacacacacacacacacacacacacaaugcccucuucacacacauucacccuuuggaugagaauuugagaauuuggcaggaggauaaaagucugagaagaugacuuucaaagugaaucucaccgauuucuuuuauaugcucaggucacaauaugauuaacagugaaucgaauguguauuuacagugaaguuagggucuuuuggccaucucugcccauuauuuagaaauaagcauauguuuacuuccauauugaaucuaaaauuuucuuuuucucuuuuguaauuuuagggaaccuuaaguaaaucagaaugggaagcuacaagugaguauaucaucagcauagauuaacugauaauuucaaaaguccuguuucaaagugaucauuaaaaccugaaaaaaggcugggcacuguggcucacaccaguacucucaguauuuugggaugccgagacagacagauuccucgagcccaggaguugagaccggucugggcaacauggcaaaugcuugucucuaccaaaaauacaaaaaaauuagccagucaugguggcaugugccuguaguccagcuacucaggaggcugaggugggaggauuccuugagccugagaagucaaggcugcagugagcugugauuacaucacugcacuccagucugggcaacacagcgagacucucaaaaaaaaaucugaaaacuuugaguuuuucugacauuuuagguuguguuuguguuuacacacacacacaaauacguauaucucuacauaugucuaauccuccuuucuugcacagcuguguagugccaagagaagauacacuguacacagggucuuccucagcauaaacuugagugagcauguguaaacauucucauugccuauuuguuacuaaguagccaucuccauuugaaguguuuaccucagauuucuacuggaauuuuuggcuuauagaauacuugcaugucuuuuuuuuauuuggccacucugaugugacagugaaggcauaauaauacuagaacauucaaugaaacauccaugagcaggauguguuagaggugugcaugauaggggacaaauguggugcaaagauauucugaagugagguuccuguguucagaagagaagccagaagcacagcaaaucugugaaggccugugguucuucagcaguggguguugaggaagucagguugcagagccucauuguuacuguaggaauccccuuacaugguuguuggugauguugaggcacaaguggucauuaaggacaauccauuugauaaacauuauugauuuacgugaaguucugugaaagguaaaguaaaauaaagauguuaaaucucuaccuucuagaagucuacacuguaauggaaggaacaggcacaaauaaacacuacuaggcaaauuuuuaagugcuaaugauacuguaguggggcacaaaggugaaagagagcuuaaugaaaacuaaacuaaugacaucugggauguaguaauauugauauuacugaguguugaacaugugcaggugcguguaacguuuuuaauccuuguaauaacucacauguuguaacucauuuaauccucacaaugacuuuaugaguagaguauuauaucuccuuucacagaugagaagacuaacaacuuagcuaagaucacagagcuaaccugugguuagcuuaccuaagugaucugucauuuuaacuaugguuucauggaagccuggcaaaaggaaaaucuaguaagacuuccugaguuggauagagaagaagaggaaaggagucaagcaagaccaguauuuugaggcuauuugucuuugaacauugguacuauuacuagaaaucggacuggaggauguuauacacauacgaucaugcuugacacacuggugagcaugugcauaaacuauggauuuuauuacuuuuucccugcaguggagacugguugccugucuuagacauccugcuggucccaaaguagaguguaaauuuugaucacgagucaucaugauggcgguacuggcuguggcuuagaacuguauuuuuauauuauuaaguguggacuuuagucaucauguacaaaugaaaaauuagauggccccagacaauuggaagagaugggcuggacaugcgaagagagcaguggccaaauugcaccucggguguagcaccccaggauuguuuggcuguuugaugaauugcucuguucuaagcuagagggcuucguggguugagcguauuuugcaugccaucacgagucuaaaaggcccaggcuacauuuuagacuucuacuggucugaucauuaagcuaucaccagagcugcugcuccucuagaagauggcuuuaaaugagaaaggagagaauugcuauugauuuauuucuggaaguggaagugguucacgauuugauuuuuuuaaaucccaauugaaaugccugcauagaaggcauuuuauacaauaagugggacuuuuuaggaguuucaaguuagaaagaaaguugcuauuauguauugaaaaucagacucuagcauguuagugguuucaaaugacccuaaaugaggacaggacaggacugagggguuguuugcaauugcuauggguguguggggggugggauuuggcagggcugggcugcacaaaggucacacagagugggggacagcaugagugauacuggccagcugugagugcugacaugcugugcacgcugauguguugcaagugcuggggacugcuuugucuccuuaccuucuggcaagaaccacagaauugaugaacacccugccuguuuucuguccuaucgcugugcuacuagccacauuucauuucaacuaaaagaaauuggaaaccgguaaauaaggugaccaaaguaguauuuuggaaaaacugcuaugguguuccuguacaaguuggguuggaagagcaagaagcuggagucuugggaggccaucaggcaguuagcuguguucaucuacccucccuucaaaagaagucaucucaaggagugaggccuccagcuuagauggacuugaucuugacucacuguugaguauccuagcacaugccccaaacauccuugugauguuugcaggauuugucaccuuugcagguauuuucuugcccuaaaaucuauugguauuuuauuagaagauauacaggcauaccuuggagauacugcaaguucaguucuagaccaccacaauaaagcaagucacucagauuuuuugguuucccagugcauauaaaaguuauguuuacuguagucuguuaaguguguaguaguguugugucugaaaaccauguacauaccuuaauuuaaaaauacuucauugguaaaaaaaugcugaugaucaucugaaccuucagugaaucugaaucuuuucugcuuggugaagggucuuuccuccauggcggaaauacucuugauggauggugguugccgaagauugguguggcuguggcaguuaagacaaugaaguuugccucauugauugaccauucuuucacagaagauuucucuguagcaugcagugcuguuugauagcguuuuacccacuguagaacuuauuucuaaauuggagucacuccucugaaacccuacuggucuuuaucaacuaaguuuuuguaauauuaauauucgaaauccuugucauuucaacaauguucccaauguguuuaccagaaguagauucuaucucaagcucauccauaagaagcagcucuucauuuguucaaguuugaucaugagauugcagcaauucagucacaucugcaggcuccacuucuaauucugguucucuuguuguugccaucccgucugcagcuacuuccuccacugauguguugaaccccuugaagucaugcaugaggguuggaauccaguucuucuaaacuugcguucauguugauauuuugaccucaucccaugaagcaugaacauucuuaaugauaucuagaauggggaaucauuuccaucagguuuuuuauuuacuucauccagauccaucagaggaaucacuaucuauggcagcuauagccuuacaaaauguauuucuuaaauaauaagacuuaaaaaugaaaaguaccccuugaucaaugggcugcagaauggauguuguauuagcagccaugaaaauaacauugaucuccuuguacaucuucaucagaccuccugggugaccagguauauugccaaugagcgguaauauuuugaaaagaauuuuauuuuucugagcaguaggucucaacagugggccuaaaauacucaguaaaccgugaugugaacagauaugcugucauccaggcuuuguuccauuuauagagcaugagcagagcagauuuuacauaauucuuaagggccucgggauuuuuggaaggauaaaugagcauuggcuucaccuuaaagucacuagcagcauuagucccuaacaggagagucgcccugucuuuugaagcuuugaaacuagguauugacuucucucuagcuaugaaaguccuagauggcaucuucuaauagaagacugucucgucuucauugaagaucuuauuuaguguagccaccuucaucaaugaucuuagcuagaucuucugcauaacuugaugcagcuucuacaucagcacuugcugcaucaucuugcacuuuuacauuaugaagguggcugcuuuccuuaaacguccugaaccaacuucuaguuucagacuuuucuugugcaguuuccucaccucucucauccuucauagaauugaagagagagaguuagggccucugaauuaggcuuuggauaaagggaauguuguggcugguugaucuuugcagaccacucagacuuuuucugaaaaucagcaguaaggcuguuugcuuucuuauuccaguguguucauuggaguagacuuuuauuuuaagaacuuuuccuuugcauucauaacggcugauuucaagccuagcuuuuugccuauuuuagcuuuuuacaugccuuguucacuaagcuuagucauuucuagcuucugauuuaaagugagagaugugcaagucuuccuuucacuugaacauguggagaccauuguaggauuauuaacuggccuuauuucaauauuguuguaucuccaggaacagagaggccaaggagagggagggagagagaugagggaacagcugauuaguggagcagucagagcacacaugacauuuaugaguucuccaucuuauaaaggcaccucgauaaaguuuguggcaccucaaaacaauuacaguaauaacagcaaagaucacugauuacagaucaucaugacaaauaauaauggaaaaguuugaaauaaugcaagaauuaccguaaugugacauaaaaacccgaagcgagcaugugcuguuggaaaaauggugccaguagacuugcuugauaugguauugccacauaccuacaauuuguaaaaaacaccaauuuguaaagcuaaauaaagcuagguaugccuuuaauagguuucaacuugauucagaacaaggaauccuaaauucauuuagcugucuuugagucaaagcaggaaaccuuauuucagggagagagcucuuggggcuaauacauguagaaauagaaauaauaucucugaaguauugauugucguagagcuuuuggcuuacuuucuucacaaggcccuacaacacaauaauuggauaauugggugaauuguuaacaugucauguuauguauguuccuuuaauucuaguuuucuaaaauaucuuuaauauuuuuaauucuaguuuucuuuguuauacuuauuuaaaauuuaauuuuauuauaauuuuaauuuguuauacuucuaauuuaguuauacuuuuauuuuucuuaccuuaaacugauuuuuagagcuguugaacugguuuucccaugggcugcaauaucacugaguauuauaguaaguagauaauuguuuuaaaguaagcaaguaccaucccaugucugccuaaaaaugauucaaauaauagaggaacucuuagaauuaauggggauuuuccucuucagaagcugcuugagagccuaagaauuuucaccaaauuaugaacaagacagauuguuuuauuuauuguaaucauaugagaaacugaacucuuauuuauuucuucuuuagguauuuacuugguguuugccuuugagaaacagcagugagcacauaggcaguagucccagaggggccguguucuguccugcacaaauuugaacaacucaucucgauauauuugauauuucucugucuguugauuuuaauucuaaaugugcaggaugcugccagaaacuccaauguagaaauucaacauuugcugucugugacagaugaacuuuugcauguguauauaagaaugaguugggaccucugucuuuaaaaaucuauuuuuagguaauguucuaagaauuccauuugccucuaugaucuuagcucauaaaaauauaauaugacuugauaaagcaacuaaacucuuuccacaguguucagauuuguccuguguguguuuacaguauucaauuuauugcaguuauagaauuggucagagagcauuuucauagugugcucauuucuaugguuuuguuauauagcauuuuucaacauuuaauggucuguacaguugaauguaaguguucaauauguauugcugaaguuauaaguuuaaaacucaauuucagaugcucauaaaaguuacuuagcuaaaauuuuagcaauuuauugcauuuugaaauaaucauuaacaugcugcaauucaggagcugguuagaacauuuuaaguggcagcauagaauuuuggaauuuuggggcuuucuuuucagaaauugcuaccauaguaauuaauguuuccaguuaucaagauugugauuagacacauuuaccuuucuucauugaacaaauggugccauaguuauuuuucucaaaauuuagugaaaaucccucccauguagacauguugcacauuuuuuccaaauuuauacauggaacugcaguaggaauauucucaccaucugaugccauguacccacuucagaaauaagcaauacuuguuccucuguuacaaccucagcacuuugcaccguaggagccauuguuaaaguugucacuuguguaacugacugcuuuuccaaaacugguacuuaugugaacuguuguccuugcuuuacaccaccauuuggaaaacuuaccaguuuuuagauguagauguagugaaaaacuucaagaaugaagcagagcaauugaguauucuuuuuuaaauuauuaagccaugauuuacaaaaacauuacuuucuguaauucacaauacuuguuuuaaaaacauagugucuucauuagugugcaucuauuaacuguucaugguguuagaguugcaaacuuuuuagcaagaaaauauggauuuccucauuucaguuccuucugcagccugugaaucuccacaaaguguuaccaguuuacaaaaauaagucuuuuugccuuaagucauuuuggaaauaaguaauacugcaucugacucugguggcuguauuagcuaggaaagguuuguaaauggugucagugagguggggaaaggaagucuuccugucacauaugcagguucguuuucauucuagggcagugccaggaaguauauugauagcuuuguagguacaggaaaaacaucaucauuauuuccucuguucacauuuacuggucuuaauuaacagguaauaauaauacauguacuuuuagccugaaaccucuuccacgccauggguaacuugggggagagaagaauccuccaaacgauggaguagccagugguaauacaaagcagggagaacagaaagguagaguuacuaaggccuucagugaacagaaaggagcagagagcaagauuagaucugagaagaugcucuggggacugagcccacuguuguuggugucagggaggcuuacuggagccacaccugcaggcgcuguguucaggcaccaccuuccuccuugagcuuugccugucucuugccuuaucaguucuuccuccaccacccuacaccccccuccccccggccccaagccccugugucuccuuguuacaauuaaguuucuggauauugacuuaagaacuguuaggaagaggacuagaaaaggcuuccccugccuauccucuccgaucaccaagguggaagggagcuaguaggacucuuccuugacacaccuugucgucuaaauguucgguauucuauucaggacuuacgguaacuauuaugagggaggcauggcuuuccaccgucgggccaggaagagcaccuguugcugcaagcucagugaaguggggcacucccagaccugccaugcaguuuauccucugagaauggaauuggaaaugaagaccuaaccagcuauuggugggaaugacggaacuggggauugcgaugauugaucugggaacauggcuggauugugauuuaaccaagaaugcugauguugaauucuuugggccuagaauauacuugagaaagcacuaguggcuuguguucagggagaggagcuggcaguuuuuaaccacuucugugggagccguguucuaaccuguggaaaguauugcaauucugugagagugacucugcagagucacugcaccaucaggcuuggcccugcugugccuucaguacccagccagguucucuggguccagggugacucuccaaagaaauuggccuucagcuggagaaaacauuggguggagacucucacuuauguuaaugcaaucuugaaaugacugaaagguagauugccagcacagugaguuucccagccugcucccccauccacacuuggaaauugagggagcaugaccgcucucugacuucacauguuaauagaggaucagagcagaguugggaguauauuggucaggaucauagaaaagaagacaaagcuugcucagccaugagauggccagguauccaguuuuguuaacucucuuugggaauuucuuuuucagccuguuuuuuagcuuagugccauuaugucauuuugauuuguauucaaguacucuucaaguaucuuuguaaugaagguuuggcuacuuguauaggucugccugcagggugaaaaugccagugugaauauucuagcuaccaaacauuguuuuuuguugaaaaacugacuuucuguugucuaccucaggccuugugcauuuggguuaucucaagccagucaccacagagggucucuagggucugcaaaauagaggccaaauccagggaccaggcccuaauaauagaaguuguaccaaaaugccugugguacuugauggccuguuggucaaauaggaaguacaagugugugauguuagaaccucccuaguugcugcuauaucaaacacugcacacuugacaaguguuuucauuccccgcccucugacagaacaacauuccuaauucuuugaaggcaaccagugcaaaggcuacuacacuuguguaaugauauuuagcagaugcauacaggacuggaucccagggcacugucaguucuucccucccucucgugcugcucaguuuguccucugcucccauguaggccuaaagucaccccacuccuuagugccugcaccucaccacgauauugaggaagcacaggacauccaaggguacucuccaguuuggcuguggagacuugagcaagcccuaaaguccccugcucccuggacuucuccuggguugugcuuuuuugggggcaacauaccuuggacaaagcugagcugacagcuaauguuuauuagccuccuaccuaagucagucacuuugcuaaauucuucaccugugguaacucauuuugauuguuauaacaucucagcaccguuauucccauuuuaaugaugaggaaacugagucauagaggauacagacuugcccaaaggagagccaggauuuucacacccccuccucaagcugggccugcccuccaagugcuuguuauauaccuccacgggugucagcccagaugacuccucacccauccaccaccugcagcuugagauguuaacuauuagagcuccauucuuuugguucaaaacguugauacuuacuuagauguucccugagaggaguguuuauuucugaguaaggggcuuuguugaaagaggggguuagagagagcaagacagcacuugagugcacuggcaggaagcagagauaagacuugaauuucaguuugguagaccaccuucuuuagcagcccaaccuguagcaaaucuaguuuagccugcauggcagggagagggauucucuucccacccucaccauuugcaaguggcaggagcugagaaugccaguacgagaguguagccaaagugagaggcugagagcaaaggagacauuuuuuucaguuuugagucgaguauccagacagaggcaaaucauuuuguuuaacuuuuuauuaaaguguaacuauagaaacacaucaaugauuuuucacaaguggagcacgugcauacaaucggcaccccagaagccccccgucagauucccuuccaguuaacuaccucuccaagggaaaccacuauccugaguucuaagcgcauagauuaguucugucugguuuggggagauauauaaauggaauuaugcauucuucguaucugguuucuuuucaccaauauuauguuugugagauuuuuguugcauguauuuguacauggauuuucauucucaugguuguauaauauuucauugugugaauaaaccacauacuguuuaucugacag

SEQ ID NO: 18589 - RNA, 1784 nt, Homo sapiens
uuucuuacugucuuauuugggcucaaucugggguuuccaaaaggaugacugggggcauuacaggggcucaaggaguucaaggugcccagugcugcaaguagcacacguccacagccaggcuugcuuugaguggcucacaccggaucuguguuggagucugaacucuggccuguguacuuggaggcaugucaaucucauuucagcagccaacaaaggucagggcccaaccuauagcccagggagccccaucuucucccaaccuagacuggagcagagaaacccgaguucaggugcuaauucugccuuucacugcuguguggcgugaaucaucuuauuucagguuccacaucugugcugacuguacacgauggccaugagaacugcaaaauugugugagcuucuuguaaauuuguaaagcacuauaggguuugcuuuuuauuuuaaagaaaugcucggauuagaggugugagccagagguugcagugagccaagauugcaccauugcacuccagccugggcaaccauucaagacucugucucaaaaaaaaaaagaaagaaaaagaaaaagaaaaagaaaugacuagaugggguaaauacuaaggaaggacacgggggccaauggucagagcaguggccuggacaccaggaggcuugugugguccuucucugaagcaaagggcuggaguccuugcagcucucacaguccacucuuguaauaacuuuugguaugauuccuauuuucugcuuuguauuggacauucacaucuagacugcacccaaugaaaaaaauguauauaaagcagaggaccauugggucacacaacagugagcugcuagugcagaagagggacccuuccuguugaggccugccaggacagaggggcuuccuggguguagccauaucaauaacuuaugcacuugaccccugccccuggaaaugcagaguccaggaaagaaacggugcuggcaugaacaggagugugcauaagacauccaaaucauuugaaaacuggcaaauuagcaggcuguuggcaacugaguuuugaaggggcagcuaucuuuucaaauguuuccuguuccuuuuugcugaaaauucauguguguauccacgaaugggcaguaaguggucccguguaaccaccauggggaaccacagugcauuguucccgugggaugugucucaggagccuggcuucugugaaagcuggccucucuucugccccacgcaucucgguggccccauguccuacagcagcuucaggcauggagcaggugcaccaggaaugcuuguuauuguugcaaaacaaauguguauugacucuucugccugcuagaccugaguacuaaaugaguuccaauccuaugggcagaaacuucaacccugugguugacacuggccccgucuaggaacccaauucucuuuaggcuaauuuucugcucuggugcuucaugaguugcuacaagaucugaccuuucauaaaaaggucuuuauggaaaugcucaaaugccuuuuaaucuuuauaaauagugcagaaauaacccuaguauuuagaugugucuucauuuggaaggaauacauguguguagugacuugguaaauaucuguacauaaaugagccaacccuuagcacccaacacaaagugucucccccaaaaagaauauauauaacugucaaauauuguaugauaugguauguuaaauaucugcuucuguaggaaauuuguuugauguaaaaacguguguucaaggaaaugguuaauaaaauggaaggagcagaccaccu

SEQ ID NO: 18590 - RNA, 1120 nt, Homo sapiens
gggggacagcugaagcacccacuucacgacuuaacguuucaggaauaugaauucuauguucagaaaauuuccccacacucuucuucgcuggcacauucacugauguagaaaaugccaggagccccgggggugugauguuuccgguggauaaugucucccguucccugccccggggcccagacaguuggugcuuaagcgucuacaauguagaguuuccugcauuuuccucgggccgccauuugucuacuugucccauccaggacaucucccuaaauaaucucuaaguggaaaaaucacgguccucuaggagauuuauccgggaacgaacgugcguggggcaguucaaauuccugagcucagauuucguuucccgcggucagauggugcggucgguggggcccgagggaugcgcacagcugugccugagaggugcugcucucccgccaccgaagucgcugggaaauucugcugcacugagacauuuuaaugucggauguucuaauccugcgggcaaaaaaaaaaaaaaaguuugaaccagguacugggcuuuugucacggugaaccccacccgcgccccgcgccgucccuucauucacucaggcgagguggcuuggauuugcaccucguugaagaagccucccaugcgacaucuccgccagcaccccgcgcggacuuggcugggcggcggcggggagucagcuugucaccgcacggcggccgggaccgcagccccugggugcgcagugcgccucucgcugcgcccuccuagagcgcgggucccgugccugugcccggcgcgacgcgaucucccugcuagucgggcuccgcgugcuccccgcgcuucccgcagccuccgcgcagcccgcagcgcccuccagccccgccucgcggccgcgggaacccggcgccugcagccccgcccggaaccgaccgccaggcgcuguugccgccggccacgcaacgcggggccucugccuggcaccagccccaggugccuugucucgggucgugcugucgcgcgacacuggggacccaacaggccgccggcuacucagcuggccccgcagcuucccugcggcucagcggccucccacccaggagaaaaccacauuugaugaga

SEQ ID NO: 18591 - RNA, 2977 nt, Homo sapiens
ugauaguucuauaagaauaaggcuuuuucuucccuugggcaugagucagauacacaaggacccuucagguguuacuagaaggcguccauguuuauuguuuuuuaaagaauguuuggcacucucuaacguccacuagcuuacugaguuaucaggugcaggucagacucuuggcuacagugagaggcagcuucuagacagaguugcuuaaugaaaggguuuguaauacuuuacaaaccauuaccuguaccuggccuggccuccaaaauauuaacauucuuuuucuguugaaacucgcgaguguaacuuucauaccacuugaauuuauugauauuuaauuaugaaaacuagcauuacauuauuaaacgauuucuaaaaucaaaacauacuuaaucugauaccaaggaagggagggagugguuauaagcaaaugaaaacaaauuuugagagacagagcaaaaguaaaaucauucuauagaaaagguguguuuauuucuuaacucuugaguucuuuuaaaauuagaaccuaaaugaugcagucagggguaugaccaauuccacaugagugucaccuguacauuuuauuaccacuaccuccaguuuccaaggcagggaagaagaggggaauagucaaagcaauaugacuagcuagguuugggcugcuguuugggcugcuguuuuuccuggacuuuuaugccaaacuacauaaauacuucuuggaauuccugauuuacgcucaacuuugaucccuggacccuagggccauuaguuuccuugaagcaguccugcugguggaugagcagggaaacuuguagacccugggaagccaauugguagagggugccugcccgccccaucagacugucccaacuggggugggggugaggaucauagugauuucuuuuuaaaagcuaguaugacuagugagaauggauguccaagggcuuuucucuuccucccccgaguccacgauucuucauuugugaucaggguugggguaacuucaccuuggugaucauauauucuuuuuacaaaccaauccagccaagauauaugugcuuuucuaaacagcuuguaaaagcaaaaacacaauguauacacauauaaaacugauuuuuuuuuuuuugcuuauauacuuugcucagguggagaacaagguaugaaagccauuauauggugucccuuggggaccaucccauaaguccaggguguucccaauauacccacaagacaacauguucaaaacuucaucaccugguccccacaaaccuaccacccucuuccauucccucacucugguaaaagcaagccaucuucuccaguuacgcaaggcagaagcccaggagugagcacaaugcugcccuuucccuugcuucugacuucucaucaauccuauuagaacuacugacugcaccccaccucuccuccauccccacgaucacugccuucauaugaacugccuuuccuguccucuggacuuucaguggcuuccuuuuuugcucaccuguccacuuucuuccccuucccucucuccaucccuccacauagucaucagaaagaucaucaaaacaggcaaaugugacuguauuauuucccucacuuaucuuuguaugcaguuuagagugauuuuuaagagcacacacuuugaaauuaggagaaccugugucugaauccugauuuuugccauuugugugacuugucagguuauuuaaucucuuugagccugucccuccucagugaaauaggaauaauaauaccuaccucauagaguuguugugaggauucagugagauagacuguuucuaaaguguguagcacagugccuggcacauagugggugcucacauuggagcacacuauugucgcuaucccugcaggugugaguuuuacauccuuuccaagaggcauuugcuaauaacccuaacuaccgccuaucccugugacacuauuuucugccucagcacccuauuucuuuuguagacauuuucuaagucuguauuuuauuuauuuguuggcuuuuugucuauuucucuacuagaauguaagcuccaugagagcaaggauguguuugucugauuucccguuacagccccagcacuuagcugagugacuggcaccuaguaagcacucaguaacuguuugcugaauaaauggaagaauggucaaaaggcucuucuugaucugaucccugcuugucugucuggccucaugcugccacuauuccucacugcaccuucagcucaagaaaaaccucuuuacuugcuucuuugaagugccccuugggccucugugucuuuguaccuguuguucccuuugccugaaacacccuuugccugcccgucuacauggugaauuccuaaucauugaugaagucucagcucaauggcuaccuccucugugaagcugucccugauuucuucaggcagauguucuuucccgccuucccuguucccaccgcacuuuguaaauaccuccauggaagcacuuuauuguauuguauuguaauuuuuuuuugcaugucuguuucuacuauuagacuguaagcaccguaaaagcagagauugugcuuuuucauccucauguuccccgagccuagcccagugccuggcacguaauagcuugucauuaaauauuuguugaaugaaucugugaaugaacaagagucaugcaguuggaaaaguguuagaagcuguauguauuauaaaggaaagaaaugcccuugguggcuuccaggguguuuuuuuuuuuuuuuuuggucuaaagaggagaucuagagaguguuauacaaucucuuugaauauaagauuacucguuuggauuuuuaaaauaauauagaucuucauaaauaauugcaaagauauaaacaagcuuugugauuucucaaaugcuaugaaguccaaaauaaauauuugcacuauuaguauuuccauaguaaaugcuaugagaaaauguacagcaauaaauuuugaagcuuuaaaac

SEQ ID NO: 18592 - RNA, 23137 nt, Homo sapiens
cauucggagagcggcguggggcguagccgccgccgccgcgcgcgccgggggcugguuaaggccaugaaacaaaagaaacacugagaggggagccgcugccaccuccaccagcccgccccgccgccguccccacccacccaccuaguuaccuaccucugccuccuuccccugccccuccaccccgcccucuccggucuccgggcggcccuggcgcuccucggcccggguccccagccccgccgccuccccagaggaaagguguuugcgagcugagcagggcccuggcccuguccgccauggggcucgccgccugccgcgccugacccggccgccgccgccgccauugacagcgcgccgccgcgaugcccagcggcagcuccgcggcccuggcccuggcggcggccccggccccccugccgcagccgcccccgccgccgccgccgccaccgccgccucugccgccgcccucgggcggcccggagcucgagggggacgggcuccugcugagggagcgcuuggccgcgcuaggccucgacgaccccagcccggcggagcccggcgccccggcgcuucgggccccggcagcggcggcgcagggccaggcccggcgggcggcggagcugucuccagaggagcgggcuccgcccggccggcccggggccccggaggcggccgagcuggagcuggaagaggacgaggaggagggggaggaagcggagcuggacggagaccugcuggaggaggaggagcuggaggaagcagaggaggaggaccggucgucgcugcugcugcugucgccgcccgcggccaccgccucucagacccagcagaucccgggcgggucccuggggucugugcugcugccagccgccagguucgaugcccgggaggcggcggccgcggcggcggcggcgggggugcuguacggaggggacgaugcccagggcaugauggcggcgaugcugucccacgccuacggccccggcgguuguggggcggcggcggccgcccugaacggggagcaggcggcccugcuccggagaaagagcgucaacaccaccgagugcgucccggugcccagcuccgagcacgucgccgagaucgucggccgccagggugagugcagggguggggagguccagcugggcauggccccgggcguggguggggagacgagagaaaggagcgugggacggaaaaggcgaacccggcgaggcccccaaguccaccgcgaaggggucugggaggagccgagggucgaccagaugugaagaugggucaccuugcgaaaacccacgcuuuuccgcccgucuugccugguaaaaagugugaaguuucucgggcgacccaguccggugguguucacguuacuugggcuguauucguggaacaccaggcuggcguggcaccagaaaccucagugaggugguaaaaggucgggcucgaggaguuguggguucgcuguuggguacggaaagcuucgagauugcaaguuugcgccgccgagugucuucuaaaagcguucagccucccuuacaagaacuuguucagauggagaaaagaacagaaauggaggccuguagacagagcucacuggggagggaagggguguucaaauggucgguaucaccgccauccccugccccuccgcuguugagaaacuuagcuuuggaaaagcagcccaacucacugccgccuaucuuaacuguauuucucucgguacguuucaacucucggaaagacacacugacacacuggcugucuuuuaaaacuguucagugugcaggaugaagaaaaaauggacacuaagguaauuaagaaacuucaucgguuuauacaguuuucaguuaauucuccucuucacuugccagcacaccaguacugcagacagacuccucccacauuguucagacaaaggaccugugucucagauuccaggaguagauuugugaaggugggggaaggggaugccugggguaccucuguauccgacauuuuuagggaagguccuaaguucuuuaugguagcauuuccccuuuaugaaaggggcagauguuaccugcugccaccgcaugacaaugugguuuagccugguuguugcaugccucuuuacuguuagguugagagcauuguuggggucaaauaaagagagaugauggcgcugccgcuuaaaugaucucaucuuucccagguggucuaaaguacacauaaauaagagcucugucgaaauggugguuucacauaucagacuuggcuuauuucuuuccuaucuguaggauuuuaauaaaaacucaucugaaaucuggauaaaggagauagcuuaguucagacugccugaugauuggcacuuacagacacuguucaaagcuggaccuuucaauugaaagguagcuuaugcuugucguucuucugguuaaugaguuucagauuccuggauuguuugguuuuggcgauacuuagaguaauaauccaggagaaaacuuuuguuuacaugggauaaaauuacaacaucucaauuuggaucagaaugaguugaccauucauguaagaacacugaggaaucgcuauguaccaagcuuguauuuugccagguuuugaguuugugguauugagaaugugaaguuaauucagacuuucugcccuuaagaagauaacagucuaauaaacaguagaauggcacuaacuauaguguauuuaguaugacaaagucucagguaagagaacaucuauggagagggccuuggaaaauggguaggaaggagucuaacaaauggagauugaaaaacuguggaggaacaaugugaggagggguguggaggacuagccuagguauaauugccaaguaguguuguuuugauacuugaggucuguaaaggggagugguggaaaagggggaaggcaggcguucacaccagaaugugaagaagccugaaugccauaugaagaugccacuucucaggacaaguugcuuccgugugcuuaugguaacagucuaggguaacaaaggaagaaaacauuuacgugccaguuuuacugaaggacaagauaacauauuuuauagauuuaguuuaauacaaacuuuaguccuucauuauaguagacaccccuuaaagcacugcuaaauggcccuuacuuguguauguuguuaaucuuuauagaaaucaguuuuuuaaaaguaaagugaauuccaaguuuuuauuuuguaccagcuauuacgugauaggaaaugagauaaagccuuaguuuuucuuuugagggcuguguuuauuugguuaauaaggaaauguugaauuuaauuaugucuuagaucauggagacaaauugcuggcucuuccauuuaaaccuuguauuuucccagaguugacaauacuguuaaaaguaugucaucauccucuaucuuaaaagcagaaaaucugguccuuuugcuguucugaaccauacaacuuguggaucauugaccccuuugccacccccaugucccagcagcauaguaauaaaccuguaaaguguuugcucacucguauggagaacgaagugacuucuaauguucacauucuuuuacaguauuauauuuccccacgggagagaaucuguccuaaguaaguaaaacagggcaaaucauuucauuuucuuguuugcuuugaaggagcuaaacuuucauccuuaagauuaaauuauccauuucugccauuuuauguauuaccugaagccauaauuuucuauuugacaucucuuaauugauuuuggaaauaauuaugucacagauggagacauuuaugacuucagcucugaagcaaagagcaggacaaauggaauucugagucacauagacuagcaacucauguagauggccucugaguuccaguguuuuucuaaaacacaaacuaccgcuuuugauacugaugaaaguuggcagaguguuugaccucgaauuuauacuccccaguagcauauggucauuuguaaauguuaaauuggccuuguuuuuuaaagcauugcaucuguugugaaacaacaauacuguaaaauaaagccaggaacugaagaggcuuguugauauaaucaaagaaguuuuagaauauggacaucaaaaauaaaccugacaacagauuuuaagaccuaauuuuauaaacuuagaacgucucuguuuuuaaguauaguaccugcaagacauauuaacagugauuaacaggucuaauuuuagucagcagguuuuguuccaauuuguacagucauuuauauccauuuagacuaaaaagugaauuaaaauagaacuguauacccauucuuaauacauuauaaauuaauacuaaaugucauaaauucaguuguuuagagacuuguaacccaagauuuuguauuacuauuaggauaaauguguaucuuucauuagacuuuaauuaauggucuauguguguucucuagccacauagucuagaaaagucgucucuagcuucuuuuuauuguacacccuguccaaaaaaaaugugcauacucccaauaucuggauauuuauguaugaauaguaagugugcuuaauauauuacacauuauaaaacaaaauucuuuauuaacaauuaauacuuuacacuguuucaauuugucuucccaauuucuuaggguggaaccacccuucaagcucuaacacaacugaaauaggguuuauacgucugugaccaggagaaaaagagaaagcuuggucuugcuguacauaaauuuucucuucaaggagaaguacauauuucaugagaauaaauaguuucagaaugaugcuacagcacagugucuuuuucuuuuauggggaugagggugcauuguuggacuucucuuugcuuaguacuauguuaggugcuucaccagugccguuuaacccugcuaggugguuacugccguuuagagagguagaaacagagguucugagagcuaacuugcucaaauaguugagauuggauuuagcauaguuugacaucagaaauaaaauucuuuguacucuacauugccacuucaguauugaagcauucugcucuggaagguuaguauuuuggauuaacuugugcccuaaucguaggauacugaauuucuaauaugcauaauuuaaaauaccacuauccaaauuaguuuacuugauaaaauuuuggugucuguacuacccacaaggcacaguuuuaauuguaauauaguucuaauguguccagcuaaaaauuuacugucauuuguaguacagaaaguuaauuugcguauauauauagacacuagcuuuaaaaauuaaauauuacaauuuuucuaggcuuuaaaauuuaaauuucguuaauaaugguuuguauuaguucugggacccuugagaaggguucaguuacuguaauuguuuuugcaaauggguggggaaucuacugccuuucuuccugccuuauucagcuaaugaacuauucugauucacuagggaggaaaugggaaaugaagugguaauucaaggguguauuuuguaccccuugguuaccaacaaccugaaaaugauccagggaaccaaguauuuguguuagucuguuagagauuucuaucuagaaaauuuucaaacaauguuuauagguuggaauucuaggugguucuuuacagcguaaguuuuuaaggaaagguagcauuuaguuauaagggaaugcuuaauauauugcugauuugguuuugaauacuuuugccuuaaacauaaaaauguuuuaguauguguauuuuaauaucguagcuuauacaauauguaaaaauaccuauuguagcuacaccaaacugccugugacagucucuguucagcugugguauauuggaaagaaccaaaucagaaauagauauuccugugccaauaacucacuguguaaucuugaacaagucacuuaaacucccuaggcuucagauuccucuuuugcaccugggcauaaucauaucuacaauuccuguagagacucuggaagauaaagaaaucgacauauaugaaacuguaagugcuaagcacauuacuuuuguuaagguaaaucugaaauuaauuuggaaccaccguuuaaucauguccaccuuuuuuggcuuuagcagauaguuugacucauuauauucuuccaauguaauagaacuagaaccaacggauaucugaaugccuuuuagauacuuggcacuucugucaagaugggcuuguuaugcugugguuaacaaagaacucugacaccucaguguuaaaacaacuaugguuuauuucuuguucauaggggcucugcucauuuuagucauucagggacacaggccaacagcagccaccaucuccaguguuacugaucuucuguugugccagaagaugaaagacuacagcauagcacauacuggucuuaaaauguuagauccggaaguaaugcuuaucacaucugcucauauuucauuaaagcaaaucaucuggccacaccuaacuucaaaaggcugagaaaguauaugacaacuaugugcccacaaggagagccaugaugacuacuacaguacuauuuuauaauuuauaggauuguuauagaauucuaaacagugucauuccugccauguagaauuuguaaccaaacucaagaugagaaaguagauaauguucauaagauacuaaaggaguguauuugcacuuaaaaauaaaaaaagcuuuuuaagaagcuccaaguagaucauggauaguuauguuuaaaucuccauugauauucaggugauccuuaagugauaccuuuuuuauuaaacugcauucuuaaugcuucccaaguagcuuauaugccauaauuuguggauuuacuuuuaacauuuuccccaugcuaccauuaguuacuauauagagacuuacaaagauuaaaucugauauuuaagccuugaaaauaauuuucuaauguuaggauuaccaaacccagauauacuaaauugaauguaugcauagucuaauacuguuugaguaguucaagucuuuauucuauaacugacuuugagaauuuuaaguuacacuaacuauaggaccucuuccaugccaguguuugagauguaaggacacuucaaguguuuguugcccuuguccgguaaguacggacuacaauuccucauugcaugcagagaagccugguuuggucacaaguaaagucuaucauggaauaauaagacuaagccuuaaaauaauaaaagaaaauccuuuaaugaaaacugcagauguaguugaagguaagcauaaguaauuuggucuugaacaugauugaaggggaaguggggagggaauggcuucaaacaacuagaaaagaucucccaaaaugguuaccaauguaaaaguauauauuugcauuuggggcugaccuuuuuauuauuauuucccuucucugugccucccuuucccuuugccuucucuucugccuuucuaccagugccauuuaguauaaugcaggaaaggacauuggacuuggaguuagaaaccuuguguuuugcacuugcugccugugaccuuggauaaaucacuuaaccucucugagccuguuuucucuucuggaaaaaaccuacuucaucuacuuguucuuccagguuucucucuccccucucccucauuuguugugaggaucaagucugagaagauagcauuaguagaaauugacaguacaauugaaaguacagagaugauaaauuauauaucagauaagguaaauuuuuacugcuaaauuucuuuuauacucugaacaaaugcuaguuaaagccaaaaaaugucauuuuaguaaguuuuucguaggcuauaccaauaaauuauguaaguuauauuuuuuaaauuuauaauaugucuuaaaauuuauuuaaaaucagagcuuuggaaauguauuuccuggcaaagaacuaagcaagucuggaagagaaucauuuacaaaugaaucuaauuccauuguaugguacccagacagauaauucuaagguuucuguuaacauucuccaaagagcaugaacauaauuucaagcuccccaguuaggaaaacuucugccuuucaucucuaauuuacacccucuucugguuuuuucuuucagguuuacugaaaggccaaauaauaaaacuuuucauuaaauauuuuuuauugucuugucuaaaauaagugaaaaaagagggguuuuagauuuaauuuaacuucuguuuuuuaaaauaccuuguacaugcagggaauucuucuccacuccuaaaaauacacuagaaauauucuuauugggauuuaggaaaauaaggcagcuugagagaacauugguuuaggggucacuaguuuauaacuggacaauuuuaggcuucgguuuuccucaugucuaaaaugagauuuaacuagguggucugucacauuucuuauauucugauuuuuguccaaagagagucccuaaaaugagguaaaaguaaaccagauuucauauuaccaguuagauugacuuugcaaaaucuucucaauuuugcaaaguuuaugauauguuuuaucuuuaggaguuucuuuaaauguuuuuaacucccuauaaaaaucaguucacuugucuuuuaauaacaacaaacuugugucaggcacugugcaaaaacuacaugugucaucucauuuaauccauucuuaauuccaccgaacagauaaacaagucuauggaguuacaaacaacuuauccaaggucucaagccauuauuguuugagacuucaacgugccuaucucaguaagugguagaacaaguagacaaaaaucagcaaggauauuguagaagaucugacuacugucaccaaccaacaguauaagaaaagaaaauaggucacuauguguacaugaacauguaucacuaaauacuuucagugcuugaaguuaauacaagucagugaagguagaacugaaucuuagucaucuuugcauuauuaauauugguuaaaguaccuaaaacaaaguggaauacuuccuuuuuauuuuauugaacuaaauuuuuuucuuauaaacuugccauuuuauuguuuauaucauuguacuuuccauauuguuuuaauugggguuuucuucccucuugccuuuauucccagcauuuuuuuuaauuuuuuuuuuuuuugagacagggucucacucugucgcccaggcuggagugcaguagagcaaucucagcucauugcaaccuccgccucccaggcucaagugauccccaguagcugggacgguaagugcacaccaccacgccuggcuaguuuuuuguauuuuugguagagacgggguuuuacuauguugcccaggcuggucuugaacuucugagcugaagcugagcucaagcaguccacccaccucggccucccaaagugcugggauuacaggcauaagucaccacaacuggccaaacagcuuuuuauguaaggacccagucaaccucaaguuguuuggcacuuuuguuugaaguacaguagaugcuacuugauugaaggcauuaaauguuuauaugaauacugauaaugaaacuaaaaucacauaaaugaagguguuugaaguauugucauaguaaucccuaaagugagacaaacaguauucuugccuuaaaauagcuacaaggaggccacuugaacccuagaaaggaaagcuauuaguuuuauauuaugcauuuaggaauacauugcauucuuaaauuauuacuuaaaauguugaauuaauguuguguacaugaaacauucuuacugggauuuaguugauacucauuagucuuugaagauagaauacuagaauugauuaauagaacuaauggcaauuccauauuuacuguaacaccuuaauacaguauuuuauguguuucuauaaaaugaaaggagcuuuugaauauucugucuagacuauuccaaggggaaagggaccuuauuuuguauaaaauuauuaauacaaccccuucauucauucuuauauaucaugaaacgugagaugauuuaggguuuuuguuuguuuuuguuuuuguuuuuuuugagacggaguuucgcucuuauugcccaggcuggagugcaguagugugaucucugcugaccucaaccuccgccucccggguucgagcgauucuucugucucagccucccaaaaugauguguuuuuaggggaaaauagugugaugaaaggaguguggacuuaagacaacuugggcuaagcacuuaauaacaggcauuguaguaagcauuuuuaauacauuauuucauuuaaucuuugcaaaaaacaaacgaaggaaguaucuuuaaucauaguuugcccuaacguugaaacagcagguuccgaguccugcagauagucaguuuuuugcugcuuauauuguuucccuugaacuggaccuuaauggauucauacaugauagcuauaauaaugaguugugccuauguuuguauuauucuuaaguucguggagccuuucacacauacaguuuuaucuuuuccaaauggccauguuuguuauucagauaacucagggaggaaaaggaauacuaggaggguuuuccagauuauguaaggaaauacccgagcagagauagaagaggaacaagacauguuugggggaugaagucugggagaagguggguuguggccacuuaauaugcagaagggguggggacuuaauuucaggccaaagaguuuuauuuuucuugaagguaagaagagcuacucaagauguuuaacuccccucucucuuuacccuucaaaacaaaaccucuugggaaauuuuugaagaaaaaccccaaggacugccaaaagugaaaauauacacauaaugcaguugugauguuugcuuguaaggguuugagcuuucuuuagucaccuuguauuuguagcuaauguaugaaaugaauggaaaacauaaugcguuuaguuucuagaaaacaaguuccuuuuugcaaaaucuacaacacaaguacuugauguucauaacaguggucauacauagccccagccuugcauucuguccuuuguucucagcauuuuucuguucauuauugugauaggccuuguggugagucccccgucuugucucuuuugcaucuuuuaugcacccacuagucuuaacaugcauaucuguuuauguuacugucuaucuccaguuuuuucuacuacacgauaaagucgaaauucccuugccugacaucagagacuucugucuccccauccagcuuuaucccugccauucuauccuccagugacgugaagcucucacacugcugaacccaguugucugacugugccauccuguacucuugauuccuugcuuuugcacuugcaguucccucugcucuccuucccaucuggcaaaaccauuuucuuuaagccucaguucagaugccuuuaaagcuuucuuuuauuuacuguaaguaguaaagucaucuccuuuuguauguaccuacugcuuuguagguaccuuuaaaccgguuacuguauucaguguugcuuuacuuuuuucccucuagacuaagcuugagagcagaaaugaugcugguucauuuauaccaccuggaaguagcacuagcaucuuuauagggaauuuaacaugugaauggguaaguucagguauuaggcugcacuuuaucucacaauugauaaaaugcucuuagaguucacccaagcagugauuuugcugggaacgccuaggauaaguggaagccacuuuuacuguguaucacguaccaaaccacuaaucucccaacauaaacauaaucuccuaguaaaagucauuguaaacacuuggcuucuauauuuucucccuauuugauauuuuuauuuuaauauuauuuguuuauuauagagaggggggggucucacuauguugcccaggcuggucucgaacuucuggccucaagcaauccucccaccucugccucccaaaguguugggauuacggacaugagccaccacacucagcccuuacuugauuuuuagauuuaucccuucaccuauuccaaugcccgugauuccucaaaccuuuccugacccuaccuuaugucuauucgcugcccuggccuuuggguuacuauuccugaauugggauuuaaaagcuagguacuuggaagaaaaggaaaauaauugaaggaaaggagaaagguaaugucauaggcagaguaaucccacccacccaacaaguccauauccgaauuccccaggaacucugaauaugucaccucauuuggcaaaagggauguugcagguguuuaugcagacgugauugaggguauggaccuugcuuuggggagcuugagaucaucuggaugaucaucuggguauaaucacaugagacccuaaaagcagaaaaccuuucccaguugggucugagaucugaaaaagaagaugugaagcaugagaaggacucagccuccauugcucgcucugaagaugagucacaagccagggaauguagguggccucuagaagcugggaaugacccucagcugacagccagcaaggacacucaguccuuucacugcaagcaaucaaauucugccaacaaccugcaugugcaaggaacuggaucccucaagcuucuugcaaggaacauagcccuugcaaacaccuugauuuuagcccuguugagacccauaucagaugucugacccaccaaacuguaaaauaacaaauauauguaaaaacaauaaauuuuugucauuaaagccacugugguaacuuguuaaggcagcauuaggaaacuaaagcagguaauagggaauuaaaggacagaaauauuuuuggacuuuaauugaacuauuggcaauuccauauuuacuguaacaccuuaauacaguauuuuauguugaaaacugcuucuuaauuuuuuuuuuucuuuucuuugggucagggucucacucuguugcccaggcuugaaugcaguggcacgaucucggaucucugcagccuugacauccuaggcuuaggugauccucccaaccucagccucccaaguagcuaggaccacaggugugcaccaccacgcccagauaguuuuuuauauuuuuuguagagaugggguuuugccauguugccuaggcugguuucaaacuccugaacucaagugauccucccaccucagcuccccaaagcguugagauuacaggcuugaggcaucacacacagccaaaagcuacuucuuacaauaauucuugagagacuuccagaaugucuuguaggguauugaauaagaauguaauauaucuaacauuuuagucucuccucucuuggggcagugauuguggaguuuuuaagggcucugagaaucucuaguaguuuuuauuacuuuguaacaguuacugcuaauuuagcagcuuacaacaacacaaauuuauuaucuccauuucuguaggucagaagucuaggcauggugugucuguucagggucucacuguguucaaaucaagguauugggcaggacugcagugcuuaucugcggcucauguccucacccaagcuugcugguuuuugauaaaauucauuuugaguagggagugggagguggguguugcaggaugaugaccucuaccuccauuuuccuucuagcucacagcuccuagaagacaccugaaguuccuugccuuggggucaccauaggcaauuuacaacauacauuguuugcuuucuucuuccagguuagccagagcacaucucucugacuucucuucugagucaugcuaggaaaaaaaaaaauuuuuuuaagagacagggucucacucuguugcccaggcuggagugcauuggugugaucauaacccacugcagccaugaccuccuggacacaagcaauucuucaccuuauuagccucccauauagcuaggacuccagggacacaccaccauacauggcuaauuuuuuuuguuguuuuuauuuuuguuuguuuuuuuguagaaacagcguccugcuauguugcucagccugucauuaacucuuggcuucaagcaguccucuggccucagccuccaaagugcuaggauuacaggcaugagccaccacaaucagccaaaaccucugcuuuuaaaaaacuuaugauuaggucaggcccacccagauaaucuggauaauuuuacuauuuuaagcugaacugauuuggauuguaauuauauuugcaaagucccuucacaggggccaccuagguuaguguuuguuuaacugaaaguauguguacauacuaggcccaggaaucuugaggagccaucuuaggauucugccuaucauacugucuacuauagcuuuuuaaaggauuuaguggugaaugaugaacagcuccauggacuuucauuuucugcuuaauuguacacuacuggugaccuaaauauuaacucaauucuuuaucacauggugcuuuuucuguugggaagugggaacaaaugguauggauaggccauguggucuuuuugcugccaucuaaaugaaccgugguuuaaaaacaaaaacaaaacuugaaaaauccugcucugaguauccaagauauguugcugguggcuagaaaauaaauaauggguuuuuaaaaauuugguguuacaaauaugucugagcugucuggccuccacaagcuacuuuaggugaccauagagcagaacuauaguauuaccauuuucaacuguauggaaauuucaucuguaaagucagaucuuaaacccagguuuucucaauaaugccacacucccuccuuuucacuaucacuguacugguucuuaguuguaaguacaucauuucacauguguuaauggaacuagaaaguggccuuaaaggugauguugucuagugguuuuaaacuuuucugacaggaaaaagaacauuuuauuuugcagcccauuauauauuucacugaaacauuuggaacauauugaguucuuuuuuuaaaugcugacugcaccuacugaauugauacugcaacccaugguuugaaaaacacugaagauuaccuucauuuuaauuucuuuucuuucaaccccuuucccagcggcagaggaccuccccgucuuaauuucuaaggcuaggaaaagcucucuuuauuuacccuggagaagcaaggcagaauccuuugcuguauuagggagugagaggaccagaguucuagcugcagcuaaaggguuuuaaggugaaacauagccccagcaacagugauguaggaaaggaaaauggguuccuacaccagugagguuaaguuggagacucuuuuuuuagggaauuuacuuccaaaucaagauaaaauuaguucuugaccucuaaacagucuagucuagacuucugcccauugauuaccuugaauacaacuugccauauguggauuuuuaucuguagcuauaagaaguguaguccucacauuuuuaaauuucaaaacuuuguucaacuuugaggcuacgaaaucauuuacccugcuguuuguacaguagucccccccuuauccaacagggaugccuucccaagaccuuaaguggaugcuugaaaccgcagaguaccaaacccuauauauacauacuauguuuuuuccuauauguacauaccugugauaacauuugauuuauaaacaagacagaguaagagauuaacaauaauaaaauagaagacuuauaacaauauacuguaauaaaaguuggugaacguggucuuacucacucucaaauaucuuuuuauucuguacuguacccaccugcauuuggacuaugguugacugaaaggagcugaaaugauagaaagugaaacugcagauaagggaggggggcuacuguaauuuaaaauaauaucaguagcacuaaccaaacgucuaaucaauaugcuaagacuaguaaaguguaucauuucuguauauuuaauuuguuuuucuuuucuaacuuaaucauauuuauuugaaaaaguaauguguauguaugacucaaaauuuauuaaaaaaaauaaauaagaauauacagugaaaacugccucccuccuucccugucccccuaggucaaccacuuuuaugaguguauagcauuccauuauauagcuguaccagccucaugcuaauucaaacaauaauuauaaaauacagaaguuauuuugcacuugugcacauauuucuacaggaucaauuguacaagaagauuguagaagcguaagaauauaugggcuuauaacugugauagcucuuagagggcaguuuauacucucacagcuaaauaugagaguucuuuuccccacucuuuacuagcauuguuguaagguuuuuguuauuugacaaucuuauagguagaaaauaauaggucaguucccuugaaaaugggaauuuccaucuucagagccauuuguauauuuacuuugauguuagcuguuucuuucacccuuuuauuggguuuuuguuguuuugauuuguaggggagagaugugugugugcaugcguguauguguguguuuguguguguguaagaaagugagaaauuagccauuucuaauaauguuauaaauauuuuagguuuuuuuacuuuguuuuuggugacuugugccauguagcaacuuaaaaaauacaggcuaauauaucauaauacggcuucugaauuuuauuucacucugagauuauaaauucuauuauuuuuaaaaauaucuucgaguuuucaaauaaaaacucaaaguacucaaaaaagcuaauaccuucgucaccugcaaaauuacaaaacaagauuguuuuucuccuuuaguuugugucaccuuuuaaaaaguaucuauucgaguaguccccaacauuagaauguauuuguaguugagaaaucauguuaguuguuuggaacucagaauauguguuccuacagaaacagugguaugauuggugagcuucccuauaaucccuaaucugaguuuaggauacuauaaucaaaagauuuagggaagugaagaaauaguuuccucugucuuuauuggcaguggcuuaaacuggguugguggccaggcacgauggcucacgcccguaaucccagcacuuugggaggccaacgcgggcagaucaccugaguucaggaguuugagacuagccuggccaacauggugaaaacccgucucuacuaagaauauauuuuaaaaauuacccgggugugguggugggcaccuguaaucccagcuacucgggaggcugaggcaggagaauugcuugaacccaggagacggaaguugcagugagccgauauggugccacugcacuccaaccugggcgacagagacuccaucucaaaaaacaacaacaaaaaaaaaccaggguuggcuuugcugucuuccuuuuacuuuuuucccugaucugcaaaaccuaauaaacacaugacccuuuuggguguagaccaggccugucuuucuccccugucucaagaguggcccaugcucaaaccauuugucuucucuguacccaaugaaccauacauuaaacaccuauuuauuaauaccaaccauaggcuagauaguguucuguggacccucaagcauauuuccucaguuaauaauauaccuguuagguauuuaacagaaaauauucuacuaagggugugacugacaguugcuuauaguaucaaaaguauuugauuaagggauuuuuacauaguuuucuuuuuucucuuuuauuucuguuuuccuuuuuuuucuuuuauuuauuuucaguuuucuaauggucaauauuaguaagggaugaaagggaccaacccuagacccuuagacuaauucucccuuuguccuuaaugcaauuugcccaguguuuuucugcagaauauugucugucucuuguuaggaauguaacuguggcugacugccuucuugccaccuugucaaguuguagcccacugugaacuuacauauccaaauaguaacuccccugaguauagaauaugaccaguucuguguuuauacaccccuuucagaauuucuuaagcaucaauagaaagugaucucaauucugcacaccaaacugcaccugcugcacuaaaugagggaaucuccuggacauuuagccuguauaaaugauacguagauguggaaguuucauuguacucucuguucuucuaacugauuuucuguuguagaacaaaagcacauacaggcugaacacuucuaauccgaaaaugugaaauccuaaaugcucaaaaagccuccgauuuuguuuuagagcuccaaaaucugaggcuuuuugagcaccagcauaaugcucaaagaaaauacucacuggagcauuucagauuuucagaguagggaugcccaacuggcagguaugaugcaaauacuccaaaaucucaaacauuccuggucccauguguuuuuggauaggggauaacucaaccuguguagucaacaccuaguggcuugggaaugcuuuggaagggcaaacaaacaaguuccacuuugugcaaaaaagugaucaggucaugugcuuuauuagaaagcaucggccaggugcgguggcucccgccuguaauccagcacuuugggaggccgaggcaggcagauuacuaggucaggaguucaagaccagccugaccaacguggugaaaccccaucucuacuaaaaauacaaaaaauuauccaggugugguugugcaugccuguagucccagcuacucggguggcuggggcaggagaaucacuggaacccgggagguggagguugcggucagccgagaacacaucacugcacuccagccugggugacagagcgagacucugucucaaaaagaaaaaaagcaucaucugacuaaagugauauaggaauauuaauuuauugaggacaaaaaaggaagggagcauuuaagaaaaagacaugcucagauugugacacuucaguagcaccuagcuucuuuuuuuguuuguuuguuugguuuuuuuuuuuuugagauggaguuucacucuuguugcccaggcuggagugcagugggacaaucucggcucacugcaaccucugucccccggguucgagcaauucuucugccucagccucucaaggagcugggauuacaggcaugcaccaccacgcccagcuaauuuuuguguauuuaguaaagacgggguuucaccauguucaccauguuagucagccuggucuugaacuccugaccucagguuauccaccugccucacccucccaaagugcugggauuacagcaccuagcuucuuuauuuugacaaacuaagaauaguaugauauauucaugagaacacaucuaugcuggcaagcucaaguuagggucuuugaaaaguauaaccccagaguuuuauuccuugguuguguacuugacauuuuaaguuacaguuugaagcccucuaaucuucacauaguuggcacuaguaaucugugauuacucaaaaaaaaaaaaaaaaguugguuaaaguggagaauuacguaaaguuauacauaugugucuuagauguuuuauuuuaacuuaaauauacuuaggauuuggggucauggccuuuuauuugaaauugugucugucaaucagagcaguccuugaauaaaaccacacccagcacccacauuccauacaaucugcaguaucuguuucuuuuaaauggagcaggacuuuacaaugauuacaaaaucauucuauauuacuuuuuuuuuuauuccagcccuuuacagcugucucaccuauucauaauucaguagcagcuuuuucuuuaagauacucaucuuuuuugcauucauguuucacuaguuuaugcaguaauuuagauaauuuaguuacuagcgugaguacaccuaccacaaacaacaugggaauaaacaaaacugaaucauagcaggccuagaauuuaacuggugggagcagaagugagaugaccuacuagccaugagcacgguguuuuugucaucaauugaguuuuacagaggaaagaguaauguuaaguuaaagugguaagauaauuagguggaagucaguuuaauaacuucugucagauaauugugaaaaucgagguucuuggacuagcaaaaagaccacagauuuuaagucaaacuagguuuacuucuggcucugccacuuccuagcuaugugaaaaacucuaaaacuuaacccauaaccagauauuuagcuuaaaaggugcauucugugauuugucuuuauauauaucauugaaguagauguugauucuuaugaaauguuuucuuucuaacagguuguaaaauuaaagcacugagagccaagacaaacacguauaucaagacuccuguucguggugaagagcccauuuuuguugucacuggaaggaaagaagauguugccauggccaaaagagagauccucucagcugcagagcacuucuccaugauucgugcaucucgaaacaaaaaugggccugcccugggaggauuaucauguaguccuaaucugcccggucaaaccaccguccaagucagggucccuuaucgugugguaggauuagugguuggacccaaaggagcaacuauuaaaagaauucagcagcagacccacaccuacauaguaacuccgagcagagauaaggaaccugucuuugaagugacagggaugccugaaaauguugaccgagcacgggaagaaauagaaaugcauauugccaugcguacaggaaacuauauagagcucaaugaagagaaugauuuccauuacaaugguaccgauguaagcuuugaagguggcacucuuggcucugcguggcucuccuccaauccuguuccuccuagccgcgcaagaaugauauccaauuaucgaaaugauaguuccaguucucuaggaaguggcucuacagauuccuacuuuggaagcaauaggcuggcugacuuuaguccaacaagcccauuuagcacaggaaacuucugguuuggagauacacuaccaucuguaggcucagaagaccuagcaguugacucuccugccuuugacucuuuaccaacaucugcucaaacuaucuggacuccauuugaaccaguuaacccacucucuggcuuugggagugauccuucugguaacaugaagacucagcgcagaggaagucagccaucuacuccucgucugucuccuacauuuccugagagcauagaacauccacuugcucggaggguuaggagcgacccaccuaguacaggcaaccauguuggccuuccaauauauaucccugcuuuuucuaaugguaccaauaguuacuccucuuccaauggugguuccaccucuagcucaccuccagaaucaagacgaaagcacgacugugugauuugcuuugagaaugagguuauugcugcccuaguuccauguggccacaaccucuucugcauggaaugugccaacaagaucugugaaaagagaacgccaucauguccaguuugccagacagcuguuacucaggcaauccaaauucacucuuaacuauauauauauacauaaauacuauaucucuauauggacucguaaaggcauggguauaaugguaccccccaguaaacuuccuaaugauuucuuaugacuguuaucaggcuuuauugggauuaggcuaaaguuguuaguaaacuuauaaaaggcugcuaugguaacacuaaaccuaaguggucucuugucuauuaguuugguuugaauuauuaguacuauccuguagacccagagacauaguuuauauaagaauugcuaaagcugaaguucaacuuggcugagugaagauaaucauagguugugugagccuaugaaaaaguguauacgucuaagauuucaaaacaaugggucccaaagccuaaccacuuuaagaguuuauggaggguacuuggcauuacagacgauucauacacuuccagugcugccuucuuuacacugccaguuuugacaaaacagguuuguuuuuuauuuuacaacaacauaugccuaauucugcaggauugcaaguaacuuuuuaaugcauugugauuacuuauugguaaugauagggcugauggcaguuuacuagaucacugguuauaauuugggacaaaaacugcuacaucaacuuucaucucgcccagagugcucaaggcugguaugaucaguggaucaggaaugcaauugugaauuccugcccauugccucucuuggugaauguggaaauggccaccuggguuuucccauaucaggaagggcuuugggauggcaccuauauuggcugauaauugaggaugcaaacauuccauucauuagugugaucgagcuguuaauuuuuagacuauagaucaaaaugugaaacauuuuauguucaauccauauuugucuugcacauuauaaauauauuuuuauuuuuuaguaauuuaggggagggaggagggagaaagggauaaugaugcccuuggcauaauucacaaaagcagcugugacaaccuccaaucaguuuacuucauuucaaaacuauuuccaaucacaaggaaagauuuauuuaaaauauacucguacauuucaccuguggaugucuauaacuucauccucaguauguucccaaaucugugcuggcauugaaaggacaaaacauuauacuaguggguuuuucuacuaauuauuuuuugaagcauuauuuucccaacacaaaagagcuuuuuucucgguauaaugaaaauugaaauccuauguguauucaauaguaaauagacaaauuuuauuuuuuauuuccacuugaagaguuacauuucguauaaaaguuuacaaauaacgguuuuuauuuugauuuuuucaguauaaaaaaaguugccuugauggcauauuaugauguaaugcuaauugcuuguaggauaguaaauggucaguauugaaaccuaaucucuagcugccgucuuguagauaugaacgaauguucaccaagcauguauuuuguauuuuguugcauuguacacugcaacuaauaagccaaggaaucgacauauauuaggugcguguacuguuucuaaaaaccacaaacuaagaaugauaaauuaucaauauaguuuaguauuugcuaauuuuacuacacucuuuuguuauguauauguagggaagucauagggauuauaaauucaauuugaguaaaauuuaaaaccauauauuuuaugauaaagggccuuuaacuuaagauggccaaagcacugauauuauauauuugcuguaaagagaauuauaagaguuuuauuuuucugauauuaaaaguuacuuaauaaagacuuguuuccauuaacuugaaugua

SEQ ID NO: 18593 - RNA, 23137 nt, Homo sapiens
uacauucaaguuaauggaaacaagucuuuauuaaguaacuuuuaauaucagaaaaauaaaacucuuauaauucucuuuacagcaaauauauaauaucagugcuuuggccaucuuaaguuaaaggcccuuuaucauaaaauauaugguuuuaaauuuuacucaaauugaauuuauaaucccuaugacuucccuacauauacauaacaaaagaguguaguaaaauuagcaaauacuaaacuauauugauaauuuaucauucuuaguuugugguuuuuagaaacaguacacgcaccuaauauaugucgauuccuuggcuuauuaguugcaguguacaaugcaacaaaauacaaaauacaugcuuggugaacauucguucauaucuacaagacggcagcuagagauuagguuucaauacugaccauuuacuauccuacaagcaauuagcauuacaucauaauaugccaucaaggcaacuuuuuuuauacugaaaaaaucaaaauaaaaaccguuauuuguaaacuuuuauacgaaauguaacucuucaaguggaaauaaaaaauaaaauuugucuauuuacuauugaauacacauaggauuucaauuuucauuauaccgagaaaaaagcucuuuuguguugggaaaauaaugcuucaaaaaauaauuaguagaaaaacccacuaguauaauguuuuguccuuucaaugccagcacagauuugggaacauacugaggaugaaguuauagacauccacaggugaaauguacgaguauauuuuaaauaaaucuuuccuugugauuggaaauaguuuugaaaugaaguaaacugauuggagguugucacagcugcuuuugugaauuaugccaagggcaucauuaucccuuucucccuccucccuccccuaaauuacuaaaaaauaaaaauauauuuauaaugugcaagacaaauauggauugaacauaaaauguuucacauuuugaucuauagucuaaaaauuaacagcucgaucacacuaaugaauggaauguuugcauccucaauuaucagccaauauaggugccaucccaaagcccuuccugauaugggaaaacccagguggccauuuccacauucaccaagagaggcaaugggcaggaauucacaauugcauuccugauccacugaucauaccagccuugagcacucugggcgagaugaaaguugauguagcaguuuuugucccaaauuauaaccagugaucuaguaaacugccaucagcccuaucauuaccaauaaguaaucacaaugcauuaaaaaguuacuugcaauccugcagaauuaggcauauguuguuguaaaauaaaaaacaaaccuguuuugucaaaacuggcaguguaaagaaggcagcacuggaaguguaugaaucgucuguaaugccaaguacccuccauaaacucuuaaagugguuaggcuuugggacccauuguuuugaaaucuuagacguauacacuuuuucauaggcucacacaaccuaugauuaucuucacucagccaaguugaacuucagcuuuagcaauucuuauauaaacuaugucucugggucuacaggauaguacuaauaauucaaaccaaacuaauagacaagagaccacuuagguuuaguguuaccauagcagccuuuuauaaguuuacuaacaacuuuagccuaaucccaauaaagccugauaacagucauaagaaaucauuaggaaguuuacugggggguaccauuauacccaugccuuuacgaguccauauagagauauaguauuuauguauauauauauaguuaagagugaauuuggauugccugaguaacagcugucuggcaaacuggacaugauggcguucucuuuucacagaucuuguuggcacauuccaugcagaagagguuguggccacauggaacuagggcagcaauaaccucauucucaaagcaaaucacacagucgugcuuucgucuugauucuggaggugagcuagagguggaaccaccauuggaagaggaguaacuauugguaccauuagaaaaagcagggauauauauuggaaggccaacaugguugccuguacuaggugggucgcuccuaacccuccgagcaaguggauguucuaugcucucaggaaauguaggagacagacgaggaguagauggcugacuuccucugcgcugagucuucauguuaccagaaggaucacucccaaagccagagaguggguuaacugguucaaauggaguccagauaguuugagcagauguugguaaagagucaaaggcaggagagucaacugcuaggucuucugagccuacagaugguaguguaucuccaaaccagaaguuuccugugcuaaaugggcuuguuggacuaaagucagccagccuauugcuuccaaaguaggaaucuguagagccacuuccuagagaacuggaacuaucauuucgauaauuggauaucauucuugcgcggcuaggaggaacaggauuggaggagagccacgcagagccaagagugccaccuucaaagcuuacaucgguaccauuguaauggaaaucauucucuucauugagcucuauauaguuuccuguacgcauggcaauaugcauuucuauuucuucccgugcucggucaacauuuucaggcaucccugucacuucaaagacagguuccuuaucucugcucggaguuacuauguaggugugggucugcugcugaauucuuuuaauaguugcuccuuuggguccaaccacuaauccuaccacacgauaagggacccugacuuggacggugguuugaccgggcagauuaggacuacaugauaauccucccagggcaggcccauuuuuguuucgagaugcacgaaucauggagaagugcucugcagcugagaggaucucucuuuuggccauggcaacaucuucuuuccuuccagugacaacaaaaaugggcucuucaccacgaacaggagucuugauauacguguuugucuuggcucucagugcuuuaauuuuacaaccuguuagaaagaaaacauuucauaagaaucaacaucuacuucaaugauauauauaaagacaaaucacagaaugcaccuuuuaagcuaaauaucugguuauggguuaaguuuuagaguuuuucacauagcuaggaaguggcagagccagaaguaaaccuaguuugacuuaaaaucuguggucuuuuugcuaguccaagaaccucgauuuucacaauuaucugacagaaguuauuaaacugacuuccaccuaauuaucuuaccacuuuaacuuaacauuacucuuuccucuguaaaacucaauugaugacaaaaacaccgugcucauggcuaguaggucaucucacuucugcucccaccaguuaaauucuaggccugcuaugauucaguuuuguuuauucccauguuguuugugguagguguacucacgcuaguaacuaaauuaucuaaauuacugcauaaacuagugaaacaugaaugcaaaaaagaugaguaucuuaaagaaaaagcugcuacugaauuaugaauaggugagacagcuguaaagggcuggaauaaaaaaaaaaguaauauagaaugauuuuguaaucauuguaaaguccugcuccauuuaaaagaaacagauacugcagauuguauggaaugugggugcugggugugguuuuauucaaggacugcucugauugacagacacaauuucaaauaaaaggccaugaccccaaauccuaaguauauuuaaguuaaaauaaaacaucuaagacacauauguauaacuuuacguaauucuccacuuuaaccaacuuuuuuuuuuuuuuuugaguaaucacagauuacuagugccaacuaugugaagauuagagggcuucaaacuguaacuuaaaaugucaaguacacaaccaaggaauaaaacucugggguuauacuuuucaaagacccuaacuugagcuugccagcauagauguguucucaugaauauaucauacuauucuuaguuugucaaaauaaagaagcuaggugcuguaaucccagcacuuugggagggugaggcagguggauaaccugaggucaggaguucaagaccaggcugacuaacauggugaacauggugaaaccccgucuuuacuaaauacacaaaaauuagcugggcgugguggugcaugccuguaaucccagcuccuugagaggcugaggcagaagaauugcucgaacccgggggacagagguugcagugagccgagauugucccacugcacuccagccugggcaacaagagugaaacuccaucucaaaaaaaaaaaaaccaaacaaacaaacaaaaaaagaagcuaggugcuacugaagugucacaaucugagcaugucuuuuucuuaaaugcucccuuccuuuuuuguccucaauaaauuaauauuccuauaucacuuuagucagaugaugcuuuuuuucuuuuugagacagagucucgcucugucacccaggcuggagugcagugauguguucucggcugaccgcaaccuccaccucccggguuccagugauucuccugccccagccacccgaguagcugggacuacaggcaugcacaaccacaccuggauaauuuuuuguauuuuuaguagagaugggguuucaccacguuggucaggcuggucuugaacuccugaccuaguaaucugccugccucggccucccaaagugcuggauuacaggcgggagccaccgcaccuggccgaugcuuucuaauaaagcacaugaccugaucacuuuuuugcacaaaguggaacuuguuuguuugcccuuccaaagcauucccaagccacuagguguugacuacacagguugaguuauccccuauccaaaaacacaugggaccaggaauguuugagauuuuggaguauuugcaucauaccugccaguugggcaucccuacucugaaaaucugaaaugcuccagugaguauuuucuuugagcauuaugcuggugcucaaaaagccucagauuuuggagcucuaaaacaaaaucggaggcuuuuugagcauuuaggauuucacauuuucggauuagaaguguucagccuguaugugcuuuuguucuacaacagaaaaucaguuagaagaacagagaguacaaugaaacuuccacaucuacguaucauuuauacaggcuaaauguccaggagauucccucauuuagugcagcaggugcaguuuggugugcagaauugagaucacuuucuauugaugcuuaagaaauucugaaagggguguauaaacacagaacuggucauauucuauacucaggggaguuacuauuuggauauguaaguucacagugggcuacaacuugacaagguggcaagaaggcagucagccacaguuacauuccuaacaagagacagacaauauucugcagaaaaacacugggcaaauugcauuaaggacaaagggagaauuagucuaagggucuaggguuggucccuuucaucccuuacuaauauugaccauuagaaaacugaaaauaaauaaaagaaaaaaaaggaaaacagaaauaaaagagaaaaaagaaaacuauguaaaaaucccuuaaucaaauacuuuugauacuauaagcaacugucagucacacccuuaguagaauauuuucuguuaaauaccuaacagguauauuauuaacugaggaaauaugcuugaggguccacagaacacuaucuagccuaugguugguauuaauaaauagguguuuaauguaugguucauuggguacagagaagacaaaugguuugagcaugggccacucuugagacaggggagaaagacaggccuggucuacacccaaaagggucauguguuuauuagguuuugcagaucagggaaaaaaguaaaaggaagacagcaaagccaacccugguuuuuuuuuguuguuguuuuuugagauggagucucugucgcccagguuggagugcaguggcaccauaucggcucacugcaacuuccgucuccuggguucaagcaauucuccugccucagccucccgaguagcugggauuacaggugcccaccaccacacccggguaauuuuuaaaauauauucuuaguagagacggguuuucaccauguuggccaggcuagucucaaacuccugaacucaggugaucugcccgcguuggccucccaaagugcugggauuacgggcgugagccaucgugccuggccaccaacccaguuuaagccacugccaauaaagacagaggaaacuauuucuucacuucccuaaaucuuuugauuauaguauccuaaacucagauuagggauuauagggaagcucaccaaucauaccacuguuucuguaggaacacauauucugaguuccaaacaacuaacaugauuucucaacuacaaauacauucuaauguuggggacuacucgaauagauacuuuuuaaaaggugacacaaacuaaaggagaaaaacaaucuuguuuuguaauuuugcaggugacgaagguauuagcuuuuuugaguacuuugaguuuuuauuugaaaacucgaagauauuuuuaaaaauaauagaauuuauaaucucagagugaaauaaaauucagaagccguauuaugauauauuagccuguauuuuuuaaguugcuacauggcacaagucaccaaaaacaaaguaaaaaaaccuaaaauauuuauaacauuauuagaaauggcuaauuucucacuuucuuacacacacacaaacacacacauacacgcaugcacacacacaucucuccccuacaaaucaaaacaacaaaaacccaauaaaagggugaaagaaacagcuaacaucaaaguaaauauacaaauggcucugaagauggaaauucccauuuucaagggaacugaccuauuauuuucuaccuauaagauugucaaauaacaaaaaccuuacaacaaugcuaguaaagaguggggaaaagaacucucauauuuagcugugagaguauaaacugcccucuaagagcuaucacaguuauaagcccauauauucuuacgcuucuacaaucuucuuguacaauugauccuguagaaauaugugcacaagugcaaaauaacuucuguauuuuauaauuauuguuugaauuagcaugaggcugguacagcuauauaauggaaugcuauacacucauaaaagugguugaccuagggggacagggaaggagggaggcaguuuucacuguauauucuuauuuauuuuuuuuaauaaauuuugagucauacauacacauuacuuuuucaaauaaauaugauuaaguuagaaaagaaaaacaaauuaaauauacagaaaugauacacuuuacuagucuuagcauauugauuagacguuugguuagugcuacugauauuauuuuaaauuacaguagccccccucccuuaucugcaguuucacuuucuaucauuucagcuccuuucagucaaccauaguccaaaugcagguggguacaguacagaauaaaaagauauuugagagugaguaagaccacguucaccaacuuuuauuacaguauauuguuauaagucuucuauuuuauuauuguuaaucucuuacucugucuuguuuauaaaucaaauguuaucacagguauguacauauaggaaaaaacauaguauguauauauaggguuugguacucugcgguuucaagcauccacuuaaggucuugggaaggcaucccuguuggauaagggggggacuacuguacaaacagcaggguaaaugauuucguagccucaaaguugaacaaaguuuugaaauuuaaaaaugugaggacuacacuucuuauagcuacagauaaaaauccacauauggcaaguuguauucaagguaaucaaugggcagaagucuagacuagacuguuuagaggucaagaacuaauuuuaucuugauuuggaaguaaauucccuaaaaaaagagucuccaacuuaaccucacugguguaggaacccauuuuccuuuccuacaucacuguugcuggggcuauguuucaccuuaaaacccuuuagcugcagcuagaacucugguccucucacucccuaauacagcaaaggauucugccuugcuucuccaggguaaauaaagagagcuuuuccuagccuuagaaauuaagacggggagguccucugccgcugggaaagggguugaaagaaaagaaauuaaaaugaagguaaucuucaguguuuuucaaaccauggguugcaguaucaauucaguaggugcagucagcauuuaaaaaaagaacucaauauguuccaaauguuucagugaaauauauaaugggcugcaaaauaaaauguucuuuuuccugucagaaaaguuuaaaaccacuagacaacaucaccuuuaaggccacuuucuaguuccauuaacacaugugaaaugauguacuuacaacuaagaaccaguacagugauagugaaaaggagggaguguggcauuauugagaaaaccuggguuuaagaucugacuuuacagaugaaauuuccauacaguugaaaaugguaauacuauaguucugcucuauggucaccuaaaguagcuuguggaggccagacagcucagacauauuuguaacaccaaauuuuuaaaaacccauuauuuauuuucuagccaccagcaacauaucuuggauacucagagcaggauuuuucaaguuuuguuuuuguuuuuaaaccacgguucauuuagauggcagcaaaaagaccacauggccuauccauaccauuuguucccacuucccaacagaaaaagcaccaugugauaaagaauugaguuaauauuuaggucaccaguaguguacaauuaagcagaaaaugaaaguccauggagcuguucaucauucaccacuaaauccuuuaaaaagcuauaguagacaguaugauaggcagaauccuaagauggcuccucaagauuccugggccuaguauguacacauacuuucaguuaaacaaacacuaaccuagguggccccugugaagggacuuugcaaauauaauuacaauccaaaucaguucagcuuaaaauaguaaaauuauccagauuaucugggugggccugaccuaaucauaaguuuuuuaaaagcagagguuuuggcugauugugguggcucaugccuguaauccuagcacuuuggaggcugaggccagaggacugcuugaagccaagaguuaaugacaggcugagcaacauagcaggacgcuguuucuacaaaaaaacaaacaaaaauaaaaacaacaaaaaaaauuagccauguaugguggugugucccuggaguccuagcuauaugggaggcuaauaaggugaagaauugcuuguguccaggaggucauggcugcaguggguuaugaucacaccaaugcacuccagccugggcaacagagugagacccugucucuuaaaaaaauuuuuuuuuuuccuagcaugacucagaagagaagucagagagaugugcucuggcuaaccuggaagaagaaagcaaacaauguauguuguaaauugccuauggugaccccaaggcaaggaacuucaggugucuucuaggagcugugagcuagaaggaaaauggagguagaggucaucauccugcaacacccaccucccacucccuacucaaaaugaauuuuaucaaaaaccagcaagcuugggugaggacaugagccgcagauaagcacugcaguccugcccaauaccuugauuugaacacagugagacccugaacagacacaccaugccuagacuucugaccuacagaaauggagauaauaaauuuguguuguuguaagcugcuaaauuagcaguaacuguuacaaaguaauaaaaacuacuagagauucucagagcccuuaaaaacuccacaaucacugccccaagagaggagagacuaaaauguuagauauauuacauucuuauucaauacccuacaagacauucuggaagucucucaagaauuauuguaagaaguagcuuuuggcugugugugaugccucaagccuguaaucucaacgcuuuggggagcugaggugggaggaucacuugaguucaggaguuugaaaccagccuaggcaacauggcaaaaccccaucucuacaaaaaauauaaaaaacuaucugggcgugguggugcacaccugugguccuagcuacuugggaggcugagguugggaggaucaccuaagccuaggaugucaaggcugcagagauccgagaucgugccacugcauucaagccugggcaacagagugagacccugacccaaagaaaagaaaaaaaaaaauuaagaagcaguuuucaacauaaaauacuguauuaagguguuacaguaaauauggaauugccaauaguucaauuaaaguccaaaaauauuucuguccuuuaauucccuauuaccugcuuuaguuuccuaaugcugccuuaacaaguuaccacaguggcuuuaaugacaaaaauuuauuguuuuuacauauauuuguuauuuuacaguuuggugggucagacaucugauaugggucucaacagggcuaaaaucaagguguuugcaagggcuauguuccuugcaagaagcuugagggauccaguuccuugcacaugcagguuguuggcagaauuugauugcuugcagugaaaggacugaguguccuugcuggcugucagcugagggucauucccagcuucuagaggccaccuacauucccuggcuugugacucaucuucagagcgagcaauggaggcugaguccuucucaugcuucacaucuucuuuuucagaucucagacccaacugggaaagguuuucugcuuuuagggucucaugugauuauacccagaugaucauccagaugaucucaagcuccccaaagcaagguccauacccucaaucacgucugcauaaacaccugcaacaucccuuuugccaaaugaggugacauauucagaguuccuggggaauucggauauggacuuguugggugggugggauuacucugccuaugacauuaccuuucuccuuuccuucaauuauuuuccuuuucuuccaaguaccuagcuuuuaaaucccaauucaggaauaguaacccaaaggccagggcagcgaauagacauaagguagggucaggaaagguuugaggaaucacgggcauuggaauaggugaagggauaaaucuaaaaaucaaguaagggcugagugugguggcucauguccguaaucccaacacuuugggaggcagaggugggaggauugcuugaggccagaaguucgagaccagccugggcaacauagugagaccccccccucucuauaauaaacaaauaauauuaaaauaaaaauaucaaauagggagaaaauauagaagccaaguguuuacaaugacuuuuacuaggagauuauguuuauguugggagauuagugguuugguacgugauacacaguaaaaguggcuuccacuuauccuaggcguucccagcaaaaucacugcuugggugaacucuaagagcauuuuaucaauugugagauaaagugcagccuaauaccugaacuuacccauucacauguuaaauucccuauaaagaugcuagugcuacuuccaggugguauaaaugaaccagcaucauuucugcucucaagcuuagucuagagggaaaaaaguaaagcaacacugaauacaguaaccgguuuaaagguaccuacaaagcaguagguacauacaaaaggagaugacuuuacuacuuacaguaaauaaaagaaagcuuuaaaggcaucugaacugaggcuuaaagaaaaugguuuugccagaugggaaggagagcagagggaacugcaagugcaaaagcaaggaaucaagaguacaggauggcacagucagacaacuggguucagcagugugagagcuucacgucacuggaggauagaauggcagggauaaagcuggauggggagacagaagucucugaugucaggcaagggaauuucgacuuuaucguguaguagaaaaaacuggagauagacaguaacauaaacagauaugcauguuaagacuagugggugcauaaaagaugcaaaagagacaagacgggggacucaccacaaggccuaucacaauaaugaacagaaaaaugcugagaacaaaggacagaaugcaaggcuggggcuauguaugaccacuguuaugaacaucaaguacuuguguuguagauuuugcaaaaaggaacuuguuuucuagaaacuaaacgcauuauguuuuccauucauuucauacauuagcuacaaauacaaggugacuaaagaaagcucaaacccuuacaagcaaacaucacaacugcauuauguguauauuuucacuuuuggcaguccuugggguuuuucuucaaaaauuucccaagagguuuuguuuugaaggguaaagagagaggggaguuaaacaucuugaguagcucuucuuaccuucaagaaaaauaaaacucuuuggccugaaauuaaguccccaccccuucugcauauuaaguggccacaacccaccuucucccagacuucaucccccaaacaugucuuguuccucuucuaucucugcucggguauuuccuuacauaaucuggaaaacccuccuaguauuccuuuuccucccugaguuaucugaauaacaaacauggccauuuggaaaagauaaaacuguaugugugaaaggcuccacgaacuuaagaauaauacaaacauaggcacaacucauuauuauagcuaucauguaugaauccauuaagguccaguucaagggaaacaauauaagcagcaaaaaacugacuaucugcaggacucggaaccugcuguuucaacguuagggcaaacuaugauuaaagauacuuccuucguuuguuuuuugcaaagauuaaaugaaauaauguauuaaaaaugcuuacuacaaugccuguuauuaagugcuuagcccaaguugucuuaaguccacacuccuuucaucacacuauuuuccccuaaaaacacaucauuuugggaggcugagacagaagaaucgcucgaacccgggaggcggagguugaggucagcagagaucacacuacugcacuccagccugggcaauaagagcgaaacuccgucucaaaaaaaacaaaaacaaaaacaaacaaaaacccuaaaucaucucacguuucaugauauauaagaaugaaugaagggguuguauuaauaauuuuauacaaaauaaggucccuuuccccuuggaauagucuagacagaauauucaaaagcuccuuucauuuuauagaaacacauaaaauacuguauuaagguguuacaguaaauauggaauugccauuaguucuauuaaucaauucuaguauucuaucuucaaagacuaaugaguaucaacuaaaucccaguaagaauguuucauguacacaacauuaauucaacauuuuaaguaauaauuuaagaaugcaauguauuccuaaaugcauaauauaaaacuaauagcuuuccuuucuaggguucaaguggccuccuuguagcuauuuuaaggcaagaauacuguuugucucacuuuagggauuacuaugacaauacuucaaacaccuucauuuaugugauuuuaguuucauuaucaguauucauauaaacauuuaaugccuucaaucaaguagcaucuacuguacuucaaacaaaagugccaaacaacuugagguugacuggguccuuacauaaaaagcuguuuggccaguuguggugacuuaugccuguaaucccagcacuuugggaggccgagguggguggacugcuugagcucagcuucagcucagaaguucaagaccagccugggcaacauaguaaaaccccgucucuaccaaaaauacaaaaaacuagccaggcgugguggugugcacuuaccgucccagcuacuggggaucacuugagccugggaggcggagguugcaaugagcugagauugcucuacugcacuccagccugggcgacagagugagacccugucucaaaaaaaaaaaaaauuaaaaaaaaugcugggaauaaaggcaagagggaagaaaaccccaauuaaaacaauauggaaaguacaaugauauaaacaauaaaauggcaaguuuauaagaaaaaaauuuaguucaauaaaauaaaaaggaaguauuccacuuuguuuuagguacuuuaaccaauauuaauaaugcaaagaugacuaagauucaguucuaccuucacugacuuguauuaacuucaagcacugaaaguauuuagugauacauguucauguacacauagugaccuauuuucuuuucuuauacuguugguuggugacaguagucagaucuucuacaauauccuugcugauuuuugucuacuuguucuaccacuuacugagauaggcacguugaagucucaaacaauaauggcuugagaccuuggauaaguuguuuguaacuccauagacuuguuuaucuguucgguggaauuaagaauggauuaaaugagaugacacauguaguuuuugcacagugccugacacaaguuuguuguuauuaaaagacaagugaacugauuuuuauagggaguuaaaaacauuuaaagaaacuccuaaagauaaaacauaucauaaacuuugcaaaauugagaagauuuugcaaagucaaucuaacugguaauaugaaaucugguuuacuuuuaccucauuuuagggacucucuuuggacaaaaaucagaauauaagaaaugugacagaccaccuaguuaaaucucauuuuagacaugaggaaaaccgaagccuaaaauuguccaguuauaaacuagugaccccuaaaccaauguucucucaagcugccuuauuuuccuaaaucccaauaagaauauuucuaguguauuuuuaggaguggagaagaauucccugcauguacaagguauuuuaaaaaacagaaguuaaauuaaaucuaaaaccccucuuuuuucacuuauuuuagacaagacaauaaaaaauauuuaaugaaaaguuuuauuauuuggccuuucaguaaaccugaaagaaaaaaccagaagaggguguaaauuagagaugaaaggcagaaguuuuccuaacuggggagcuugaaauuauguucaugcucuuuggagaauguuaacagaaaccuuagaauuaucugucuggguaccauacaauggaauuagauucauuuguaaaugauucucuuccagacuugcuuaguucuuugccaggaaauacauuuccaaagcucugauuuuaaauaaauuuuaagacauauuauaaauuuaaaaaauauaacuuacauaauuuauugguauagccuacgaaaaacuuacuaaaaugacauuuuuuggcuuuaacuagcauuuguucagaguauaaaagaaauuuagcaguaaaaauuuaccuuaucugauauauaauuuaucaucucuguacuuucaauuguacugucaauuucuacuaaugcuaucuucucagacuugauccucacaacaaaugagggagaggggagagagaaaccuggaagaacaaguagaugaaguagguuuuuuccagaagagaaaacaggcucagagagguuaagugauuuauccaaggucacaggcagcaagugcaaaacacaagguuucuaacuccaaguccaauguccuuuccugcauuauacuaaauggcacugguagaaaggcagaagagaaggcaaagggaaagggaggcacagagaagggaaauaauaauaaaaaggucagccccaaaugcaaauauauacuuuuacauugguaaccauuuugggagaucuuuucuaguuguuugaagccauucccuccccacuuccccuucaaucauguucaagaccaaauuacuuaugcuuaccuucaacuacaucugcaguuuucauuaaaggauuuucuuuuauuauuuuaaggcuuagucuuauuauuccaugauagacuuuacuugugaccaaaccaggcuucucugcaugcaaugaggaauuguaguccguacuuaccggacaagggcaacaaacacuugaaguguccuuacaucucaaacacuggcauggaagagguccuauaguuaguguaacuuaaaauucucaaagucaguuauagaauaaagacuugaacuacucaaacaguauuagacuaugcauacauucaauuuaguauaucuggguuugguaauccuaacauuagaaaauuauuuucaaggcuuaaauaucagauuuaaucuuuguaagucucuauauaguaacuaaugguagcauggggaaaauguuaaaaguaaauccacaaauuauggcauauaagcuacuugggaagcauuaagaaugcaguuuaauaaaaaagguaucacuuaaggaucaccugaauaucaauggagauuuaaacauaacuauccaugaucuacuuggagcuucuuaaaaagcuuuuuuuauuuuuaagugcaaauacacuccuuuaguaucuuaugaacauuaucuacuuucucaucuugaguuugguuacaaauucuacauggcaggaaugacacuguuuagaauucuauaacaauccuauaaauuauaaaauaguacuguaguagucaucauggcucuccuugugggcacauaguugucauauacuuucucagccuuuugaaguuagguguggccagaugauuugcuuuaaugaaauaugagcagaugugauaagcauuacuuccggaucuaacauuuuaagaccaguaugugcuaugcuguagucuuucaucuucuggcacaacagaagaucaguaacacuggagaugguggcugcuguuggccugugucccugaaugacuaaaaugagcagagccccuaugaacaagaaauaaaccauaguuguuuuaacacugaggugucagaguucuuuguuaaccacagcauaacaagcccaucuugacagaagugccaaguaucuaaaaggcauucagauauccguugguucuaguucuauuacauuggaagaauauaaugagucaaacuaucugcuaaagccaaaaaagguggacaugauuaaacggugguuccaaauuaauuucagauuuaccuuaacaaaaguaaugugcuuagcacuuacaguuucauauaugucgauuucuuuaucuuccagagucucuacaggaauuguagauaugauuaugcccaggugcaaaagaggaaucugaagccuagggaguuuaagugacuuguucaagauuacacagugaguuauuggcacaggaauaucuauuucugauuugguucuuuccaauauaccacagcugaacagagacugucacaggcaguuugguguagcuacaauagguauuuuuacauauuguauaagcuacgauauuaaaauacacauacuaaaacauuuuuauguuuaaggcaaaaguauucaaaaccaaaucagcaauauauuaagcauucccuuauaacuaaaugcuaccuuuccuuaaaaacuuacgcuguaaagaaccaccuagaauuccaaccuauaaacauuguuugaaaauuuucuagauagaaaucucuaacagacuaacacaaauacuugguucccuggaucauuuucagguuguugguaaccaagggguacaaaauacacccuugaauuaccacuucauuucccauuuccucccuagugaaucagaauaguucauuagcugaauaaggcaggaagaaaggcaguagauuccccacccauuugcaaaaacaauuacaguaacugaacccuucucaagggucccagaacuaauacaaaccauuauuaacgaaauuuaaauuuuaaagccuagaaaaauuguaauauuuaauuuuuaaagcuagugucuauauauauacgcaaauuaacuuucuguacuacaaaugacaguaaauuuuuagcuggacacauuagaacuauauuacaauuaaaacugugccuuguggguaguacagacaccaaaauuuuaucaaguaaacuaauuuggauagugguauuuuaaauuaugcauauuagaaauucaguauccuacgauuagggcacaaguuaauccaaaauacuaaccuuccagagcagaaugcuucaauacugaaguggcaauguagaguacaaagaauuuuauuucugaugucaaacuaugcuaaauccaaucucaacuauuugagcaaguuagcucucagaaccucuguuucuaccucucuaaacggcaguaaccaccuagcaggguuaaacggcacuggugaagcaccuaacauaguacuaagcaaagagaaguccaacaaugcacccucauccccauaaaagaaaaagacacugugcuguagcaucauucugaaacuauuuauucucaugaaauauguacuucuccuugaagagaaaauuuauguacagcaagaccaagcuuucucuuuuucuccuggucacagacguauaaacccuauuucaguuguguuagagcuugaagggugguuccacccuaagaaauugggaagacaaauugaaacaguguaaaguauuaauuguuaauaaagaauuuuguuuuauaauguguaauauauuaagcacacuuacuauucauacauaaauauccagauauugggaguaugcacauuuuuuuuggacaggguguacaauaaaaagaagcuagagacgacuuuucuagacuauguggcuagagaacacacauagaccauuaauuaaagucuaaugaaagauacacauuuauccuaauaguaauacaaaaucuuggguuacaagucucuaaacaacugaauuuaugacauuuaguauuaauuuauaauguauuaagaauggguauacaguucuauuuuaauucacuuuuuagucuaaauggauauaaaugacuguacaaauuggaacaaaaccugcugacuaaaauuagaccuguuaaucacuguuaauaugucuugcagguacuauacuuaaaaacagagacguucuaaguuuauaaaauuaggucuuaaaaucuguugucagguuuauuuuugauguccauauucuaaaacuucuuugauuauaucaacaagccucuucaguuccuggcuuuauuuuacaguauuguuguuucacaacagaugcaaugcuuuaaaaaacaaggccaauuuaacauuuacaaaugaccauaugcuacuggggaguauaaauucgaggucaaacacucugccaacuuucaucaguaucaaaagcgguaguuuguguuuuagaaaaacacuggaacucagaggccaucuacaugaguugcuagucuaugugacucagaauuccauuuguccugcucuuugcuucagagcugaagucauaaaugucuccaucugugacauaauuauuuccaaaaucaauuaagagaugucaaauagaaaauuauggcuucagguaauacauaaaauggcagaaauggauaauuuaaucuuaaggaugaaaguuuagcuccuucaaagcaaacaagaaaaugaaaugauuugcccuguuuuacuuacuuaggacagauucucucccguggggaaauauaauacuguaaaagaaugugaacauuagaagucacuucguucuccauacgagugagcaaacacuuuacagguuuauuacuaugcugcugggacauggggguggcaaaggggucaaugauccacaaguuguaugguucagaacagcaaaaggaccagauuuucugcuuuuaagauagaggaugaugacauacuuuuaacaguauugucaacucugggaaaauacaagguuuaaauggaagagccagcaauuugucuccaugaucuaagacauaauuaaauucaacauuuccuuauuaaccaaauaaacacagcccucaaaagaaaaacuaaggcuuuaucucauuuccuaucacguaauagcugguacaaaauaaaaacuuggaauucacuuuacuuuuaaaaaacugauuucuauaaagauuaacaacauacacaaguaagggccauuuagcagugcuuuaaggggugucuacuauaaugaaggacuaaaguuuguauuaaacuaaaucuauaaaauauguuaucuuguccuucaguaaaacuggcacguaaauguuuucuuccuuuguuacccuagacuguuaccauaagcacacggaagcaacuuguccugagaaguggcaucuucauauggcauucaggcuucuucacauucuggugugaacgccugccuucccccuuuuccaccacuccccuuuacagaccucaaguaucaaaacaacacuacuuggcaauuauaccuaggcuaguccuccacaccccuccucacauuguuccuccacaguuuuucaaucuccauuuguuagacuccuuccuacccauuuuccaaggcccucuccauagauguucucuuaccugagacuuugucauacuaaauacacuauaguuagugccauucuacuguuuauuagacuguuaucuucuuaagggcagaaagucugaauuaacuucacauucucaauaccacaaacucaaaaccuggcaaaauacaagcuugguacauagcgauuccucaguguucuuacaugaauggucaacucauucugauccaaauugagauguuguaauuuuaucccauguaaacaaaaguuuucuccuggauuauuacucuaaguaucgccaaaaccaaacaauccaggaaucugaaacucauuaaccagaagaacgacaagcauaagcuaccuuucaauugaaagguccagcuuugaacagugucuguaagugccaaucaucaggcagucugaacuaagcuaucuccuuuauccagauuucagaugaguuuuuauuaaaauccuacagauaggaaagaaauaagccaagucugauaugugaaaccaccauuucgacagagcucuuauuuauguguacuuuagaccaccugggaaagaugagaucauuuaagcggcagcgccaucaucucucuuuauuugaccccaacaaugcucucaaccuaacaguaaagaggcaugcaacaaccaggcuaaaccacauugucaugcgguggcagcagguaacaucugccccuuucauaaaggggaaaugcuaccauaaagaacuuaggaccuucccuaaaaaugucggauacagagguaccccaggcauccccuucccccaccuucacaaaucuacuccuggaaucugagacacagguccuuugucugaacaaugugggaggagucugucugcaguacuggugugcuggcaagugaagaggagaauuaacugaaaacuguauaaaccgaugaaguuucuuaauuaccuuaguguccauuuuuucuucauccugcacacugaacaguuuuaaaagacagccagugugucagugugucuuuccgagaguugaaacguaccgagagaaauacaguuaagauaggcggcagugaguugggcugcuuuuccaaagcuaaguuucucaacagcggaggggcaggggauggcggugauaccgaccauuugaacaccccuucccuccccagugagcucugucuacaggccuccauuucuguucuuuucuccaucugaacaaguucuuguaagggaggcugaacgcuuuuagaagacacucggcggcgcaaacuugcaaucucgaagcuuuccguacccaacagcgaacccacaacuccucgagcccgaccuuuuaccaccucacugagguuucuggugccacgccagccugguguuccacgaauacagcccaaguaacgugaacaccaccggacugggucgcccgagaaacuucacacuuuuuaccaggcaagacgggcggaaaagcguggguuuucgcaaggugacccaucuucacaucuggucgacccucggcuccucccagaccccuucgcgguggacuugggggccucgccggguucgccuuuuccgucccacgcuccuuucucucgucuccccacccacgcccggggccaugcccagcuggaccuccccaccccugcacucacccuggcggccgacgaucucggcgacgugcucggagcugggcaccgggacgcacucggugguguugacgcucuuucuccggagcagggccgccugcuccccguucagggcggccgccgccgccccacaaccgccggggccguaggcgugggacagcaucgccgccaucaugcccugggcaucguccccuccguacagcacccccgccgccgccgccgcggccgccgccucccgggcaucgaaccuggcggcuggcagcagcacagaccccagggacccgcccgggaucugcugggucugagaggcgguggccgcgggcggcgacagcagcagcagcgacgaccgguccuccuccucugcuuccuccagcuccuccuccuccagcaggucuccguccagcuccgcuuccucccccuccuccucguccucuuccagcuccagcucggccgccuccggggccccgggccggccgggcggagcccgcuccucuggagacagcuccgccgcccgccgggccuggcccugcgccgccgcugccggggcccgaagcgccggggcgccgggcuccgccgggcuggggucgucgaggccuagcgcggccaagcgcucccucagcaggagcccgucccccucgagcuccgggccgcccgagggcggcggcagaggcggcgguggcggcggcggcggcgggggcggcugcggcaggggggccggggccgccgccagggccagggccgcggagcugccgcugggcaucgcggcggcgcgcugucaauggcggcggcggcggccgggucaggcgcggcaggcggcgagccccauggcggacagggccagggcccugcucagcucgcaaacaccuuuccucuggggaggcggcggggcuggggacccgggccgaggagcgccagggccgcccggagaccggagagggcgggguggaggggcaggggaaggaggcagagguagguaacuagguggguggguggggacggcggcggggcgggcugguggagguggcagcggcuccccucucaguguuucuuuuguuucauggccuuaaccagcccccggcgcgcgcggcggcggcggcuacgccccacgccgcucuccgaaug

SEQ ID NO: 18594 - RNA, 4238 nt, Homo sapiens
caauagagaaucuuuuauuuugaauugagaagaaauucugaugauuagagugucaguaaguaguaggaaaagguaagaauacauguguuucuaaucucccaccaccaccuguuguauggaacaaauuggauuacuagcaaggguaagguuuauugacaaugagaaguuuuaguccaagauuuuaguuaaaauauuuuaaaauuuuuugauucauaaccaagaaguugccucagaucacugugaagcuuuaaaaugcaggugccuuugcuccuccucccuccaggcccccgggggcagagcccuggcuggugucucuucaggaggaccccugacacaccgauucugcccucacaaucacugccuuaaagcaggcagcagaaucuuuuggagaacuaacaagauucugaugcugaugcauagggccugggguggggccucagauucugcuuuuuuuuuuuuuuuuuuuuuuuuuuuuaaacagggucucuuucuuuuuccuuucucacucaggcugcagugaguggcgugaucuuggcucacugcaaccuccacuuccugggcucaaacgauccucccgccucagccuccugaguagcugggacuauaggcgcaagucuaugcaaccacccagcuaauuuuuguauuuuuagaagaguggggguuuugccacguugccugggcuggucucgaacuccugaccucaagugauccaaccaccucagccucccaaagugcuggaauuacaggcaugagccacugcacccagccaagaauguccacuucugacaagcucccaggugaugccuaugcugcugguacagugaacaacaugcugagaggcauugcuccaggauacugcauguagugagcaguucuuuagcguuuaugugucauauacuucaaguuacaugaaaaagaucaacugaaauuauguucuuacacagaauaguuuucaucuaguuuuauuauguuuuuacaggcuguuuacaagaacaaaaauagagaauuuuugaacauauuuuucugaaaacauaaaaacuagaguacucuuuaauucuaaauuauagauuuguagcauacuuaguaaacuuaguaaccaauuuucauuuguaaaagauuagcuaucaaauggacauuuauuucucuuaguuuucuuaugacaugacuugccuuauauccuuuguccuuuuucuguaacuugucagccucuggagaaauaggauuuuacauuuuugcaaaugaguugccaaugaauuaagaucaaaacgucauuauuaaggaguaugaagcauuauuuacuggcucucagauaacagaaaacccaaaagggaugguggcggagugaagaaagccuugccuugggaaaaauacuucaaaugcucccauaguuuuuuuuccucaagcccagucaguauccuucaaggauaacuuuuucauaccuuuuuuuugguuuguuuguuucugcuagcuuuaugacagagguuauaauauucuuuucuccucucuucuuugacguguuacguugucuuuuuuuuuuuuuuuuuaacuucuucauacucuuaaaaagcuccagaauggccaggcgcaguggcucacgccuauaaucccagcacuuugggaggccaaggcaggcggaucacgaggucaggagaucaagaccauccuggcugacacggugaaacccugucucuacuaaaaauacaaaaacuuagccaggcgugguggcgggcgccuguagucccagguacucgggagucugaggagugaacccgggagguggagguugcagugagcugagaucgcaccgcugcacuccagccugggcgacagagugagccuccaucucaaaaaaaaaaaaaaaaaaaaaaaaaaaaaaaaaaaaaucuccaggguucuguugaauucaccaaaauggggucagcucuggugagccuauguaauacucgagaacauuaauauaaacccauagcucuuuacugggcuuccauuuaaagggaaguccuaagaaugaaauggcaccagcauccuguuuccauccaagacaagaccacacguguucaggugccauguauucauauagcucucaacugauuggugauuugcacuuugugcaucuaauuauuaaaaugaaacucucuacaggugagcugaaguaacauacuucauauuuaaaaaguucacagcaauuugaccauagaaaacuuucucaucugaaaucaggguaaguuuuuuuaauguaagcagagaaaaaaauaaagcaguguuuuauuucaaauuucaguaaguucaggugggccuaauuaagacaugacuauuauuacaaauccuauucuugccagaaguuacuuagauagauuagugauuagauuuuaaaaacauuauuuuccuuucuugaauaaggaaaauugugcaucucaaagagaaaaguaaauauggaaauauguucauaguucaguugcauaaaauagacacauuaagucaagugauuugaaugcuuagugucuuuugguaaacagcauuuugucaacaaacuuuucauauggcuauagaaucuuguuuuuuccaaauaaaaacuuugcaauugggaguuauuccuccauucagcacacuuuuuaauguuaagacuaggggaaacuuguggguauauauucagugguuuucaggauuuucuuuuauguucuagaaaaguaauuuuuccuuuccuaguuuuaaguauauauucaagcaaaucguugauuccuauacagccauuggauuaucaccaacacauuugguauauacagugggccgauaaugacaaacuaaaguuugugguuaauaccuacucuauaccagacacuguucuaaggauccgacauauuuaauccucuguuuacccucuguuucugugccugauuuacagacagagacagaggcacagagagguuaaaugacuugucaaaggucuuaugauguguggcagagccuggguuuuuagcucaaaccccucucagugaagaaagccuucuguguaggcaauuucaucuaauaccuucaugaauuguuacuucagaugagaauucucacuuauucuuuuuuuuuuuuuuuuuucuuuucuuugagacagccuugcucugucucccaggcuggagugcaguggcgcaaucucagcucacugcaagcuccgccucccggguuaugccauucuccugccucagccuuccgaguagcucggacuacaggcgcccgccaccucgcccagcuaauuuuuuguauuuuuaguagagacgggguuucaccguguuagccaggauggucucgaucuccugaccucaugauccacccgccucggccucccaaagugcugggauuacaggcgugagccaccgcgcccggccucacuuagucuuuuaccaguucaucugauuuuuacuuuguucccauuuauaauucaaauauaauauaaacgucuuauucauuuagucuucagcauuuuaaguauucgacacgaacauuaaagauuugguguugaauuuaauaaauuacaccaaaaagucucaguagccaauucacuaacaucuuuugauuugguaaucuucacagaaucaacaacuguuaacacuucugugcaaauaaauuucaguugugcuuauauauuauaauauucacuuuaggaauccaccugucaauuugcaauucaauuauaagguauauuuuaagugauaucuauguauuguauacacauauuccauugaaaggugagaauaauuagaaaguaguaauauaaaaauguguaugaaauaagaacuuucuuaaaagaccuaguuuagcuaaauauaugacaauauaaaaugucugcccaauguuuuauuauacuuugucuaaugaccuuuaaauuuaacugaaauuaaaaccguacuuuugcaguugauauuuuuguguucccuuuguuaacauaccaagcacuaauuauugacuucaaggaagccacguauugcaagucauugcuuagccuuucacaucugaguguugauaagaugacggaauggguagucuuguaguaauugcuuaugggaaugcuaguuuaagaggaaugccuuguauagaacauauuauaccagauugacuuguuaaaaaugguuccaagaaucagucuaaaaacuucagaauuaugugaauuauuuuuucucuguugugauauguuguaaugagauguguguucuuauauuuucuuaguaaaauuuucuuaagcauaaaau

SEQ ID NO: 18595 - RNA, 12206 nt, Homo sapiens
uucaaauacuucuguguaucuuuuacagugcuaugggcgcauuugauaaauauauugguuuuauauuuuauacuuauggaaauaauuuauuuaaaaccuacucuggggacuuagagauuauaagaaauuuauaaaguacauugagugucaaacaaguuugcagauggagcauagucuaagugcauuaccauacuucccuaaagaaaauaaugucggccaggcacaguggcucacuccuguaaucccagcaccuugggaggcugaggcaggcggaucaccugaggucaggaguucaagaccagccugaccaacauggagaaacuucgucucuacuaaaaauacaaaauuaggccggacaugguggcuuaugccuguaaucccagcacuuugggaggcugaggugggcggaucaccugagguugggaguucgagaccagccugaccaacacggagaaaccccaucucuacuaaaaauacauaauuagcugagugugguggagcaugccuauaaacccagcuacuugggaggcugaggcaggagaaucguuugaacccggaaguggagagugcggugagccgagaucgugccauugcaugccauccugggcaagaagagcgaaacuccaucucaaaaaaaaaaagaaaaagaaaaagaaaaaaaagaaugucuaacauucuggccuucugaaaucccuaagauugaauagcaucuauauggucacaucauugaaggaccacuucuggaaaccccuuaaacaucaggaagaguuuauuuuuguuuaaagaacauagaccagugauucccaauucauggguuauagacuccucaggaacuuaccauguaaagaaaucucauuugugcuucaaauauuguauacuuaauaacuuuucacauuuuuguaaauauuaucuuuaaggauauguugcugcuguaauuaauaaaauaguaauuaaaggcaguauugaauucugaaucuucuuaaauguaugucuguaaucacuguauacucaagguauaccugcucuuuguuuauaaaacuuuuuuauugugguaaaggaagcauaauauaaaauugacaauuuuaacuauuuaaaaguauacaauucagugacauuaaauuuauuuaguguugugcaaccaucaccacuaucuaguuccagaacuuuuuuauuaucccaaguagaaaccuaguauuauuucauuuuauuuuauuuuuuugagacagguucucacucuguugcccaggcuggagugcaaugacacuaucauggcuuacugcagccuugaccuccccgggcucaggugauuuucccaucucaccuucccgaguagcugagacuacaggcacgugccacuacaccuggcuacuuuuuguauuuuuuuguagagaugaggucuugccauguugucuaugcugguuuugaacuccugggcucaggugauccgccugccuuggccuccuaaacuguugggauuacaggcaugagccaccacaccuggccaaaauuucuuacacuuuaaaaggugggacaccauuaugcuagguuauaagcaggaguuuaggugcuaauuugggcuuuaccauuuacuagccaugaaacuuuggcaaacccuucaacuucucuaggccuuaguuuucuucauguaaauaauauagguaauagcauuuggaaacauuuaaagggcuauacaaguauaaaauuggauuucuccuuuucuccccaugcucauuuggcuaacuuuucucauaauuuucugaaauucagcucugcauccuuucccacacagcagaaggugagcagugguugagcaagugaaucuucaucuguauuuacagccacuccucauggcuugcauuaccgccugugcucugccuccugucagaggagugcaaacccuauugugaacugcgcaugcaagggaucuagguugcacacuaauuaugagaaucuaaugccugaugaucugagguggcacaguuucauccugaaaccauucccuacccccugaaauagagucaacaagauaaaaacucaugaaaauguaacuaucaucaaugacuucaauaacaacuaagacaugaaaagaaaaauugucuucagcuggcugugguggcucacaccuguagucccagcacuuugggaggcugagguggauugcuuggggucaagaguuugagaccagccuggccuggucucuaccagccugaacucgucucuaccaaaaauauaaaaaaauuagccaagcacuguggugcaugccuauaguuucagcuacucaggaggcugaggugggaggaucacuugagcccaggagguggagguugcagugagaucgugccacugcacugcagcuuggguggcagagugagccccugucucaaaaaaaauugucuuccaugaaacuggucacuggugccaaagaggauggggaccacugcucuaggaaguuuucagugacccuuuuuccuaauuccucaccacacugggugaguuacuccccuguccuuugagcauucuugugcucacuucugucaauaccauguaucauacucaguuggaauuaucucauuccuccauugaggacaaugaccauaucuuagucuguauccucauuaucuuaccccacaguacuuagcacacacagagccucaguacaugcuggguagauggaugaaugcauaaacagaugagcaaauaggaaaacaaaaucugacaugauuggugcucggaguuucacagauaauuaaacauagguuuuguuuccagaaaauaaguuuggauuagauaggaguuuuguuaccuacucuuguaaaacaaguuaggaaauaccccuauucacaccucuuuuccccauguacugauuuauguguuuucuuaucauuuuuugagcaagugaagcuucaucuguauuuacagccacuccucauggcuugcauuacaaagcccauuucaucuuacaaagucuuaaaaauugagugaugcaguuuuuuuuuuuaaauaagaauagggggaggaagaaggaaaaaaguaagaauaauuuuauuuauuuauuuauuuauuuauuuauuuauuuauuuauugagauggagucucgcucuguugcccaggcuggagugcaguggcgugaucucggcucacugcaagcucugccuucuggguucaugccaugcuccugccucagccucccuaguagcugggaguacaggcgccugccaccaugcucagcuaauuuuuuguauuuuuaguagagaugguguuucacuguggucgcgaucugcugaccucgugaucugcccaccucagccucccaaagugcugggauuacaggcgugagccacuacgcccagccaagaacaauuuuaaauuacauuaaaaaguuuucaguugagugauaugauuuggcucugcaucaccacccaaaucucaucuugaauuuuaauaauuaccacgugucaaagguaggaccagguggagguaacugaaucgugggggugguuucccccaugcuguucuugugauagugagugaguucucacaagaucugguggcuuuauaagggacuucccccuucgcucagcacucauucucucuccugccacccuggguagaggggccuucuaccauaauuguaaguuuccugaggucuccccagccauguggaacugugagucaguuaaaccucuuuucuuauaaauuacucagucuugguauuucgucauagcagcaugagaaugggcuaauacaaugaguauauuuuauuucaaauuuauguauuaacaccuaauuucuguaccaaaacaacauaagccauagaacaugugaugugaauaauuguggauuugugaugaacagagcuugccacuuaguuauaauuugcccuuuuagugcaauuucaucucaauuaacacauuuucagaagucuaaacaagcauuugagugcuagugaggcacuggcuacauagcgccuauccguauugagguuaagggaaugcauuuuaucuccugcuuauaaauguguguaaauggauucuaucuccugaaucguuugccuucuaucuuacauuucucauuacaaacguaaaucaguauuaaagagucugauuuguauuaaagaguuguuuuagucuuagauuauuucuguuacucucaggauaugucuuauauuagauuguacaaggcuuaaagauacagauaaaaugugcuuuaaaguaugaaaugaguaccagaaaauaaauauuugguugaaucagagagaugagaaaauauauaacaaaugaauuggcuauucauuuuuaguguggauuuaaagcuuuuagagguagauauaagugauacuuucuuuuacacuguaauaaugcuuccauaggguagagugcucaaacaagaaauuugggaaggauucaggcugaggucuauuaugauuacaacaguaaaaguguacaauuguuugauuacaaggugagccaacucuaaacuauguacauagccuccgacccucaauuuuguuuuucacuuuuguucuuccugccucuguguuggcugccuuagcaagagagaugccaacauuuuuauugaugacccagugggcuaaagguauaggaguccuucugaaauuuuuuuaaaaaaacaccugaacacuauugauauaaccuaguaauucucaaguaacuccugcuaucuacguuuuuuucuuuuucuaguuccucccguaauacuacuaaacaucucuuuuaaaccaaguauucuuuucaagauguaagauugugaagagauuuuacuacagauucuuaauuuauuucagccaaauucaaauauccuaauggacucuauuuagaauaaugaaccauagauugccagaacuaaaagagcuaaguacauaguaaauaccuaugcaaaccauuaacuuaauucgagaaggaguguuaaagaagagaaucaauaacuccuuuauuuuguagauuccaucccuaagauuuaaggacaugcucaagcuuuguaucuggaacucugguuuucugguuauuaguucucugaggguuuuguuaauuuauuuguuuauauuuuaacuucucccggcuaguucuuuaauaaauuuagaauuuucuucugguuauuuacacaaauaauaugacuaauaaaagauuuaaaaaucacauugcuauuauucuaucaccuuuuuuggugagacagagauuuacucuuguugcccaggcuggagugcaauagugcgauuuuggcucaccacauccuccgcucccagguucaagcgauucuccugccucagcaucccaaguagcugggauuacaggcaugugccaccacgccuggcuaauuuuguauuuuugguagagacgggguuucagcguguuguccaggcugaucucgaacuccugaccucaggugauccacucgccucagccucccaaagugcugggauuacaggcgugagccacugugccuggccucuaucaucuauuuuuauuuggccaugauucucuuaaaaguauacuuacuuuuaagauuauaacauauacuuuuauaugcaauuuuaccacugggaaaaguauacuauaaauauaucucuaaaauguuugauaagcuguauaauaaauauaugggugcauaauaguguaguagccuuuggauuuggaauuccaguggcugaugagacucccagcuuugcaccuuuacuggcccccuagcauguuuaccugaauguucaagugucuguuuaagagauuugugucaauauugacucguggagaaacugcaugugccuaaaguaaaauaguucagggucuuucaggaucagcuggaggaaguacaccucugcuauguaaauugggagggagggaauugcuguugcauagaugagaaaaagggagacuugggaaaaguggcaaagggagauggagaaaguaggagaagaguagauaagaggaugaucauuucugcuuaauacuaaacuaaccaggccauucauuuuaaacuaaugucaucaucacaggcuugcuucacuuauuaacaccagccuagcaaauuuaagaacuuaaucaacuguuaacauaaauaucuauacauaaaauuauuuaaucauuuuauuuuuuacucugcauuauaaauaaaucacuuuugagugucccuuaaaucuaaauaggaaauaggcagugcagccuuguguagucaacuccauuuaucuuuggcaauaaggauaggcaaagcguacuuuuuuuuuugagacaggaucuuacuuugucacccaggcagaaguauaguggcacagucauggcucccugcagccucgaccuuccaggcuuaggagauccucccaccucagccucugaguaccugguacuacaggcaugugccaccacaccuggcuaauuuuuguauuuuuguagagaugagguuucaccaugcugcccuagcuggucucaaacuccugggcucaagcaaucuauccgugcuggcaucccaaaaugcuuggauuacaggcaugaaccacugugccuggcccaaagcacuucuaaaugaacugcauaguucauuuaaacauacguuuuagccuuuuccuuuacccuuuugcuagaguuggaaaaaaagacgcaagagugacaguuuugguuuuaccuucuuuguauuucccagccuucaauaaaaucauacaaggagaaacaugagacacauguuuauuauugucuagcgucuccuccauuauugaaaguggguauuaaagucuccaacuuguugaauugucuuucuucaauucuguuagcucugcuucauguauucuggaccucuguuguuagguaugucuauauuuauaauaguuauaucuucauaauagauucacccuuucaucauuguaaaauguccucuguaguagcagcauucauuuuaaagucuguuuugucuauuguuaguauagccacucuagcucucuuuugguuacaauuugugugguauaucuuuuuccauccuuuuacuuuccacuuauuugugucccuuacagacagcauauaauuggauuauguuuucuuucuucuguuuuuuuuuuuuuuucugggacagagucucacucugucagccaggcuggagugcaguggugcaaucucggcucacugcaaccuccaccuccuggguugaagcuauucuccugccucagcuucccaaguagcugggacuacaggcacccaccaccacaccuggcuuauuuuuuuuuuguauuuuuaguagagaugggguuucaccauauuggccaggcuggucucagaacuccugaccuugugauccgccugccuccgccucccacaguguugggauuacaggcgugagccaccacgcccagccuaauuuuauauuuuuaguagagaugaaguuucuccauguuggucaggcuggucucaaacuccugaccucaggugauccaccugcuucagccucccaaagugcugggauuacaggcaugagccacugcgccuggccgacauuauuucuuuagagaaguaugguaaugcauuuagacuaugcuccaucugcaaacuuguuuuucucuuugucuagguguagaucucuuuugaguuuauaauacuuggaguuguugagcuuacuggauguguggauuaauguuucucauauuugggaaguuuuggggcauuaucucuugaaauauuauucugcuucuuucucuccucuccucaaacuucauuaugcauauguuggcauacuugauggugucuuacagaucucugagauucuguucaucuuuuuuuugagacggaaucucccucugucaccaggcuggagugcgguggcacgaucuuggcucacugcagccuccgccucccggguucaagcaauucuccugccucagccucucgaguagcugggacuacaggcacaugccaccacacucagcuaauuuuuguauuuuuaguagagaugggguuuuaccauguuggccaggauggucuugaucuuuugaccucaugaaccacccaccuaaggcucccaaagugcugggauuagaggcgugagccaccgcaccuggcaguucauauuucuuuauucuuuuuucuuucuaucuuagacuagauaaucuugggugaccuauuuuuaaguuugcugauucuuucccacuugcucaaaucuacuguugaaccccucugguaaauuuuucauuuucauuuauuguacuguugaugaaaagauuaaaacucuguaaaauauuugaagagauuuauucugagccaaauaugagugaccauggccugugaaacaaccccaggagauccugaaaauauguaccccagguugugggggcacagcuugguuuuguacauuuuagagacacaugagacaucaaauacauuuaagauacacauugguucaguccagaaaggugggacaacucgaagugggggcuuccagguuauaggcagguuuaaauuuuuucuuauuggcaguugguugaguuauuaucaauagaaauaaaugucuggauuaugauaggaggcuuuggagaccagaguuucuucaugcagaugaagccuccagguaacaggcuucagagagaauagauuguaaauguuucuuaucaggcuuaaggucuguguugauguuaaugcuggaggaguauagugaggcauguccgaccccccaugccaucauaaccuaaaccagccuuuucagguuaaauguuaagagugcccuggccaaggaggaaguccauucaggugguugggagaccuuagaauuuuauuuuugguuugcaguacuuucauucccagaauuuccauuuaauuucuuuguugguagucucaauuuggugggacauuauucucauacuuuccuuuaguucuuuagacauggugucuuuuaagucuuugaauguauucaaagaugugaauguaaagucuuuaucuaguaaguacaauguuuaggcuuccucaaggacaguuucaugauuuuuuguugaaaacuggacauuuuaaauaagguagcaguucaggaaaucaaauacuccucccaggguuuguuguauugcugcuacuuuugcuuguuuagugauauuuccaaacuaauucuuuucuuuuuuugagauggaguauugcucuuuugccuaggcuggaguacaggggcaugaucuuggcucacugcaacuuccaccucccagguucaagugauucuccugucucagccccccgaguagcugggaccacaggcacaugccaccacgcccggcuaauuuuuguacuuuuaguagagacaggguuucaccauguuggccaagcuggucucgaauuccugaccucaggugauccgcccaccuuggccucccaaagugcugggauuacaggcaugagccaccgugccuggccuccaaacuauucuuuauaaagucuguauucuuguacaugcccacugaagucucugauugguuaguuuuguggucagcugauaauuagacaaagacuuaaaugcuuggaacuaguaaauuucccauuuuuugccaaguggcucugugugcauguugcggcauaccuccagcacugaaccaggcaguuuacaacuacccagaagccuucacuuccuucuugcacagagccuuaagguuagccagaggugugagcuaggaucuuuucaggucuuuccuggauguguccacagcucauguaugugaccuucuagagucccgguaauaccucauggcuuuugaaagcuccaaccccauggucaucucauucuuuagcuuuuccuugugagcuuuuuguuacccuguuguuuuucucaacuguuauccacugcuuugggcagcugcuaugcuaaauuauugccucugauuguuuccaacaagcacuucuggggaaauggcuuuucagauggggugagcgccaaguuaggucaaaugaagauagccuugcaaguggggucuuccagggaaccaccagacaggucaaauaaugacauuuuccuggaauagggcuuagaagaaucuccagccccuucuuccugcccugguggcuuccaggcugcugauuuucauaguaauugugagguguuaguuuucgauuuaaaacucacaaagcuuguugcuuacugaaauccagccauuuuuccugaauaacugcucccugauugcugcauuucuuugguaaauuuccagaauguugaagaaguugcuucugguuauuuguccaguguucuuguugcuuuuauggaggaaaagauuuuccaaaggccuugcuccagcauuuucauugacauugcuuugauacgaagaauuuaacccauagucaaaugccagaaauugaaaaagauuuucuuaugacauagauuaauuuuuucuuaagcaucauuucuucuauccccuuuuaaugguauuucaugguaugaauauaccauaggaugcuuaacucuuucguaguuaaugggcuuuuuguuagcuuguaauauccaagagaacuagaaacaaugcuacaacuaaacuuuuuguauaugccuuugugugccauuaagaauguuucucuagaauggcucccuggaagucagauugcuugaugaauaauauguauauaaaaaauuuaagaauacuuuaaaacugucuuccaaaggccuaaacuaguuuauauucccagcagugguuugugagaauaacuauuuuccacacccugaccaauacugacaucagucuuacaaaguuuugaaagccugggcaaaaauaauaugucauugauuuuucaaauuugcauuuaaauuauauuuugaagaacaaugucauugcuaccccaguaaguaauaauuuuuaauccuuuuauuucuccucuuuagggaauggcauuuacuuuacaagaacgacaaaugcuuggucuucaaggacuucuaccucccaaaauagagacacaagauauucaagccuuacgauuucauagaaacuugaagaaaaugacuagcccuuuggaaaaguaagaguugcuuagauguuucuuuuuuuauugguauucugauuagaaaacuuaugagcauuaugguuauuauggcaugagaaauacacaaucuuauauaaguuuguguuuugucaguuaacuacuuuuauaaagauuguguuucuuucacuucggugaauacuucacaaguauucacuauuguaaaacuuaacaaauuaguuuuuaugcuuacagucagagcaauucagguuugaauggaauauuagaagcaaaggauaccaucuaauuugcacucauuuuauucaaaaacuuuuauugaucaccugcuuuguguuugacacuguaccagccacugaggcuauaaaguggguaauagauaggaugaccauauauuauaucaccuaaucuaggauacuuuggagaauaaaaaagagguguacccaaagcuaccccuggcaaacuuuuuuuguuucuuuuuuugagauggagucucgcucuguugcccaggcuggagugcaguggugcgaucucagcuuacugcagucuccgccucccaaguucaagcaguucuccugcuucagccuccugaguaguugggauuacaggcgcccaccaccaugccuggcuaauuuuuuuauuuguaguagagauggaguuucaccauguuggccaggcuggugucaaauuccugaccucaggugauccgcccgccucagccucccaaagugcugggauuauaggcaugagccacugcgccuggacuuuuucuuuucuuuucuuuuuuuuuuuuuuugagacagggucucacucuguugcccaggcuggagugcaguggcacaauuucagcucacugcaaccucugccucccgggcucaagcaguucuccuaccucagccucucaaguagcugggauuacaggagugcaccaccacacccggcuaauuuuuguaguuuuuaguagagacaggguuuaaccauauugcccauauugcccaggcugguuuugaacuccuggacucaagcaaucugcccgccuuggccucccaaagugcugggauuacaggcuugagccacugcaccaggcagcaaacuuaauauauaugaccaacccaguaacucauagcccugucuucuaaaagucaucaacagacaguuaugcuaugauuguuauuggucucuagaccacaauguacaguacaaugagaaaaagguacaagcagauauauucugagagcaugcagagggcaucuagcucaa

SEQ ID NO: 18596 - RNA, 18900 nt, Homo sapiens
cagcggcugagccugcgcuucggaagcauggaugugcgccugcgcugcgcuagggcgcggcgggcgguuugaauuuugcuuacagagucccgucucaccauccugggcuuccaacggagacugcgguauccgcagcuggagacccagcggcgaguagccuuuugcucccggacggacuugagguuggagucuguguguuggggacccugccuuuggaagcgcccgagguagcugcuuggcagcugggggccgcggaccgcgccgggcuugggggaggacggggcuggaggcuggguuggaugcuuuagacccuccccuucucucucaccggcggagugggugggaaacugguucuuucccauuucucggccuccuuaccgaucccaaacuguaaagccccaaccccucacagcacaggaaaaaugauuaccugggcccauuucuuugacaguguaacacauuuuuaaaaaauguguccuuauuuugcguguuuaaagaaaauaccaauguugucuuuauauacaaauagugcguuuguccuccugaauccuuaaggaaaggacccaggcuuauccucuuuccccugguuugggauccaucgauggccuaaggcucuaagacaagucaguacgguaccgugguuagaaacugaauguuguagaaaugaaagaaauugcucuugaauuuuugugcuuaaccuucaaagacaugugauuuacuugacauugaccauucuuggauuucgaaagugaacagaaauuuguguggcuuuucuuguuacgaauauguuuauguuuuuuucuucagaggcuuaaaggauggccucgucagaucuggaacaauuaugcucucauguuaaugaaaagauuggcaauauuaagaaaaccuuaucauuaagaaacugugguaaguaaaacagauuccacugacuuuguauauacaaaaugcauuuugauuauuccacucugaaugauaucuuugcuugguuaagugacugcaucuuagguaauuuuagauuuuugcauaacgauuuuuuaaauaguccaaugucauuuugaauauuguggaggauacuaaaaauguaagguacauugaacaaugaacugaauauucauuagaauuauuuacuuauguuuuucugagacacauaggccaauggugagauuugaagguuauguggcauccaugguucuacagcuaaauagagauacagucaugcguuccuuaaugauggagauguguucugacaaaagcguuacaugauuuugucguugugcaaacaucacaucauagaauguacguaaauguacacaaaccuagaugguauagccuacuacauaucuaggcuauauagccuauugcuccuaggcaacaaacccguauagcaugugacuguacugaauaccuuaggcaaguguaacacaauggugaguauuuguguaucuaaacauagaaaagauacaguaaaagauuaaaaauggaacaccuguauaggccacuuaccauugauggagcuugcagaacuggaaguugcugugggugagacagugacugugagggccuaggacaucacuguauacuacuguaggcuuuauaaguacuauacacuuaugcuacacuaaauuuauaaaaaaugaaaaacuuucuucaauaauacauuaaccuuagcuuacuauaacuuuuuuacuuaauaaacuucuuaguuuggcuuagcuuuuuuauucuuuucuaauagcuuaaaacaaauacauuguacagguguacaaaaauauuuuuauaucuuuaugagcuuuuuuucuauuuuuuuuuaacuuuuuaaaauuuuuuugucaaaaacgaauacacacacacacacacauuagccuaggccuaugcagggucaggaucaucaacaucugucuuccacauucacaucuuguuccacuagaaggucaucggggcaguaccacacauggagcagucaucugugauaacaaugccuucuggaauaucuccugagggaucugccugaggcuguuuuacaguuaacuuuuuuuuuuuaauagguagaaggaguacacucuaaaauaacaauacaaaguauuguauaguaaauaacauaaacuaguaaccauuuauuaucaauuauuauguacuauacauaauuguaugugcuguacuuuuguaauacuggcauuagaguuuguuuacaccagcaucaccacaaacaugugaauaaugcauuguaccaugauguuaugauggcuccgaugucacaaggcaauaggaauguuucagcuccguuauaaucuuauggggccacugucauauuuaugguccauuguugacugaaucacuguuauguggcacauuauuaaaaggcaaguuaaaaaaacugauguagagcuccauagggguaaaaguaguucauaacccaucuuagagccugcuuuggaggaagcuuauuacucuauaucacugggaaauaacuaauugaaaaugaaauaaauuauuuaagcauccaugaacuuggagauuuuaaguauauuugaaaauauuuugacgugcugaaauuggaugaugcaaugaaaguucagagaaacagaugauccuugucaaaucuaaaaugucuaaagaauuacauacucccuaaccuuaucugggaggguaacgguuuauuggcagacagaauuccaugugcugggaagguuguguugaacuuguauuguaguuuguauuaugaauugguaguuugaaaacuuucucaaauaugaaauuauaauguuagauaggccauuucgaauuauaccuccccucucagggacguugauauucucaguccuguauugauaacuacuaauaaaggagccucauacauuuuacaguuuaugguucacauacucuggaaaguuaaagcuaaagggacuggguucaucuuaaggagcccccugaccucacaccugaggaaacugagacucucggaagucagguggcuggcccaggucccucagcucaugaguacuugguugggcgacaguuucuguuucuugauucccauguuaguacucuuucuauuuuguugccauuuuuauugaaguaauuuguaaaagacuuuuagauguuuaauaaugagucuuguuuaaauucacuuucugagguuaugauuagucauggauaaacaaauauaauuuggagaucuauacaacuaucaagccuugaauucacaugacccaccaaagcauaggccuggcugaagcagucagacccaugagauccuuacacaguugucaacugucauuuuguauggggggauaauaauuuguguggcuccauagccuauaaaauaaagucugguaguuuguuugcuacuuuggcuucuguaacugacuagauuacuacauaaaaaacagugaccagacacacaccuguaaucccagcacuuugggaggccaaggcaggcggaucgcuugagcuuaggaguuugagaccagccuaguaacauaguaagacccugucucuacacaaaauaaaaaaugagccaggugugguggcguuuaccuguagucccagcuauucaggaggcugaggcaggaggauugcuugagccugguagguugaggcugcagugagcuccgauggugccacugaacuccagccugggugacagagaaagacccugucucaaaaaaaaaaaaaaaaaaaaaagugguaaacaacacccuaaaauuuaggugacuaaaaguugagauaccaguguauggggaagaaauacuguguucaacuaauucuacugaaauuauucucagagacaucaguacucucauuuacuuauuaauuaguuuuacuuguuaugagcugagugucaaaugcaaguaguguugcucuauuagauagaaugauauacucaugaugaugaugaauggcaguuagcauuuacugaguauuacguucuacaugcagggcuaagcccaucuuauauguacuuucaccuaucuucacaguaaugagguagguacuuggugucucugacuucaggccuucuaccugguucacucuacugccuccuuaaucuacacauauugccaaagucugcuuuuacuuauguguaugucauuguuagauagcuggaaaugcagaugggaagcuucaauuaugaagguaguuuuucuucugugcuuuuaaucugcccuuaaauuuuuuaaaaaacuacuucuuuuauuucuagggaggaagggacucugauuuucucaccuagagaggggugcuaggaggugggauugggaccaugagaauauacuacuuuauaaaugucuuauguuuguuuuugccagguacccaggguuaucaccagcuugugacuuuuuauguuacuuugucugcuuaggggugguuuugaauaguguggauaguguuaauaugaauuccaaauccauauuacaaauucugaaagagaguuucaccucaaccucacucccaccccuuccacacacacacugaagggccugucuaaaacauaagcuuauuucucuggugagugauuacaacuuucacugaaaauauauucauaaagaagaguccuagccucguuugagauucucacuuccaacacccuguguuuuaaagccccaaaaccuuggaucuuaucccuauuaaaaucaaauauauucaauugcugagauugacaaccuccuguccagcauugcuccacacuccucagauuagggcugcugcagccucagcucacacacccugccugguaugagggggaaccacaguucccucuucauauuggaaccccuggaaauuugccuuuuucucaugaaagcuuagcuguggacguagaaggaugcuuguuuuaccucgcauuucuaaguguuuuaauaaguggaagaauuugccagaaacaaaagacgcaggagagacauuguccuugccucucgccuccuucuguuccauacuacuuagaaaugagguuucaggauuguccauggagucauuuucuaggggcuaaagcaguagaccuuuuuccaccccucucuaagguacagcuaucuauucuaagaguucgcaugaguacuuauagcuacugcuuuucuauacacuuuguuuucuauuuuauuuuuguuuauaacaggccaggaaccuaccuugaaaacuguauuaaauaaaauaggagaugagaucauuguaauaaaugaacuucuaaauaaauuggaauuggaaauucaguaucaagaacaaaccaacaauucacucaagguaauguuucucuaaugaggaagcaguaaaaaagacaauacauacaaacucccuaaucauuaaguaauuuuuaaggaugcuuuguuuauaauguuuuuuguuuauaaauuauuaaugguacaguaugccauuuauguuuuauuuuccuaguauaguggaauuuggagcuccacagcugcuacuuucugcugauggccaguggaauugaacuuuacuaaaaaggagaguuugcuaauaauucuugguagcuuuaauuuaaacaaugauguucuaguagagugguauguaaagaacaccugcuuugggugaggagauauggauucuuaccuuggugguccuugguacucucugccacccugagaaagcuauuuuaccuguugggguuucaagaaccucaucugaaaaaauaauggaucauauugaacuguuucuuagcucccuuauaugucuauauuucuauauuuuuauaaaagguaauauaaggguucucagguaaagaaaaacuugagccucauucacaugcacauuuuauucuaaacaagccuucaaauugaguucagcuaauaaaagugcuggugcacuuccugagggggaaauaaucuguaccauaauuaccucacauuguuagagcuggggaauugcucagugggauugaacaagggaccucccugaccccauucagccuuauaauccuuaaagucuguaaagauuguucagcuauaggaaugggcaugauuaugccuaucacucuaauagucaaaauggaauugguauccaugaaugucauucaccucuucaaggaaaagacauuauauaaauucaaaacagaaaccaauaccggcauuucaguucuaaccugcccaagaauguccaggguuaggugugggccuagagaaugcucaacucagaacugaaggcuauuuggaauuucuguucacauugugauugggagccagauggcgggaauccaaaggcacaaaauauuuuccuuauuaaaauguguaugaguucauagccucaaguucuaguaaaaguuagagaccaaaacaccccagcuuucaaguagaaauuuucauuaagcuggcauguagguagcccacaguggaagucauccuaaagcagcaucucaugcuugccagcuggguauauuaccaugcugugauaauaugguugcuguuacacagguaacacuggggagcauuugguaagccaacaaacgcaauuuaugagaaugaaaaacauaaguucuuuauauauuucuuaguuaucucccaagauuaaaguauuugagaaagacuuaacuuuaguccugcuuuguaauugcaaugugauuauagugauuguucccugaaaaaaauccaguagagaaaaauauuaccaccauccaaaaacagcucuagaaaccaauuuuuuauugcuggauucauugcuuuuucacuucauucugcauuuucgguacuccagucaaugugguuuuuuuuuuuuuuuuuuuuugagacgagccuuucucugucgcccaggcuggagugcaguggcgcgaucucagcucacugcagccuccuccucccagguucaagcaguucuccccccucagccuccugaguagcugggacuauaggcgcgugccaccacgcccggcuaaauuuuuguauuuuuaguagagaugggguuucacaguguuaguggggauggucucgaucuccugaccucaugauccacccgccuuagccucccaaggugcugggauuacaggcaugagccaccgcguccagccacagucacugugauuaugguucacuguuuucccugcucuuuagaauaucuuaaaacacacauggggaggacagagacuuauuugugagcacuuuuaaauuuuaggaacucugugaaucucuugaagaagauuacaaagacauagaacaucuuaaagaaaacguuccuucccauuugccucaaguaacaguaacccagagcugguaaguguauuuauaauuauucuugcuaucuggauuuauaaacccaugaaaacaaguucuucaaagccuuuuguucuuucauauacuugcaguuuugucagcgaugaucuaguuuuuugucaccuauacuaaaaacaguauuuccauguucaccaguuuucuuaucuuggugucucugaggaaaaucuaacacuucuuucccaguuugccaagggcaagucucucuagccucucuuuuuucacucauuucuuucccugagagcaguuugucaacugacguuuguuccuugacauuuuaggcagguuaauuuuuuguuaugagaauaggacauugaguaguguucuugaucucugccuacuagauucugguagcaucccuccaucccacccauucacgacaaugaaaaaugucuccagacauugccaaaugccucugagggcaaaaucuuccccgaccauugagaaccacugccuuuggguaaaaauaagcuuaaggaaguuaccauuuuaaaaauagcuaaagaggcugggcacaguggcucacgccuauaauccuagcauuuugggaagccaaggcaggcagauugcuugagcccaggaguuugagacuagccugggcaacauggugaaaccccaucucugcuaaaaauacaaaaaauuagccagacacaguggcacaccccuguagucccagcuacucagggagcugaggcgggaggauugcuugagucuggcaggucaaggcugcggugagcccugauggugcuacugcacuccaggcugggcgacagaguaagacccugccucaaaauaaauaaauaaauaaaagccaaaggaacaauaagcuuagcucuuuuuuccccucaaauguccauccucucucucuucccccuuacaaggugugucugugcuucugcuuuuuccccgaggcccuaacaccuggcuuuuggcugucauugccaccacaccuagggugguugaaggucaugaagaggucaaaaaucccucgucagcccugguucuacuucuaagauuucauuuugcauaccaccuuuuuguuuuugaaauucuguuuucugcccugccacugugcuuucuuaguugucagcccacuucucugacuuggcugccuccuuuuucucuccccuuuuuuaaauuauagaucucuccuaccugcuuuacucauucuuacccaacuccacuguuaaugcucucaaauguccagcucuagccuugauaugacaucuaguuccagcgauuuaauggccugcuauuuucuccucaaauuuuccaucuugaagaccuggcucucuuguuucucuuguuccccacauauccucccaucaccucggugaggacuuggcaucuuuauccugucuugcucuuucucagccauuaccugucauuggacauccaguaagaauuugaucaggggaauaggaggaauuuucuucuaagcugacuauggccuagccucaacucucagggauaggugagagcagaaccuuucuguaguugaaaaugguuauuuucagcugauaaacacagcagggcauaagggagccaaucaggugcuuccucaacacauggucaagacaaacaaguacagguacgauucagccagucucacaguggaaucucauauguuaggauucacagaaggauuaucaugcauugggcaucuuuaucuugacagcgugcagcguggccgagucacaccaccucagugaggcugguugccaucugugucuggcauuugacugucaucuugggaucuugcuuccugccuuucuggggauucccuuggcuugcuccugaggccauccucccacucauaauuccagggcuuugcuuaacuucuaagcuuuauauuauguuacauuucuuguuaccuuuuuauuauacaaauaauacauguugcuagaaaguguuuguugucagaaaauaaaacucaucuguaauuuaccauucagauaagauaggguauagcuuuccagauuuuacuuaacuacacauaauaacagguauaagaaauauuacagguauuucuuauacuuguuauuauguguaguuauagcagcccccuacuguuucuuauaucuggugucgucuuuccuaugucuugacuugcugcuggcaacaucccuggcaguuaaggaaccuagaagcuauaguguguuucuagacuuuguugcuagugggacaggagcuauauuagucggcuucucacucgcuguaaaaauugggcagauugaauccaggggugacccaugaucauugcuggcaacuaaaaugacuccgcaauacacagggacugacaugagcaaccaucaggauaaauuagaauaaauagaagucuaagauaacugauguuuccagauucagaguuagggacgucaggaagacaagcuguuaagggguuagaacaaugagaucacauggacacaggaaggggaauaucacacucuggggacugugguggggucgggggaggggggagggauagcauugggagauauaccuaaugcuagaugacacguuagugggugcagcgcaccagcauggcacauguauacauauguaacuaaccugcacaaugugcacauguacccuaaaacuuagaguauaauaaaaaaaaaaaaauuaaaaaaaaaaaaaaaaaaaggaaaaaaaaaaaaaagagaagcuauuaagccguaaagcuguuaacuuacugacuuugaggagcuggugggacaacugaugaagauaucauguuacacguaaauaaauguagcuauauuacugaagauuugggaacuuaauuuuucaacauuuccuucaccguuuaauguucaugaacaauagacauagggauagaaaaaaauguuggcaauaagauuauaacaggaugaguuacguauuuaauauuauuuucaguugggaaaacugucaguaugcugcuuauuucugaaaauugccuguauguauguacaucuguauucuguaguguuaagggaucagaucuugauccugaagaaccaaucaaaguugaagaaccugaacccguaaagaagccucccaaagagcaaagaaguauuaaggaaaugccauuuauaacuugugaugaguucaaugguguuccuucguaaguauuuaagauaaauaauguucaaccccuuaauaaacauaaaugaucguuuaaauaauaaagcuuaauuauauuaauuguaauaugcuauguucaaauauugaucuuuuaaaaaaguuucacauuauacuaugaaaaugcaguaaauuuuuugaagauuuuuguuguaaaaccccuucauagagagaucuagagauggaucaauucauugcuuaaguccucuguuggaccuuuuuguguuacagauuuaccaaucauauuauagaaguagccucaguuuugugguaauuuuaaggaaaucgaguguguuguguagaauugagaaugagaauggacaguguuguguuugguuuccguuugugcauugcaccccgcacuuguuugagccugugcuauauuccaggcccugggucacucagaauagaggaaugaauaagacaaaaugcuucccccaaagaggggggcgggucucccuugccuuuuacauauggcaauaauggggaaccaaugaugaaaaucgacauuuuuaaacucauaauuccagggcuuugcuaaacuucuaagcuucauguuauguuacauuucuuguuaccuuuuuauuauacgaauaauacauguuacuagaaaguguuuguugucagaaaguaaaacucaucuguaauucuaccauuagauaagauaggguauagcuuuccagauuuuauuugacuauacauauguaacagguauuucuuauaccuguuauuauagcaauguaguuauacuguaaauacaacuuacuauccuuuuauugugauaauuuuucuaucauuaauagucauauaauauauagcuauccaauaacuuguagcauuuccucauuacauauuuggguugacuuuauuguuauaaauaaugguacaaugaaauaucuuuuagacaaggcuguuuugcaauuuuuuuauuuccuugggauagucuuaggaggagagucccugaggcaaagaucaugauuauuuugcuucuagagaguuuuucauaccaguucauuuugguuguuguuuuauuuaauaaaguauauuucuuagaaccuuuguuagauuuacagaaaaauugagcagauaguacaguguucucauaccgcuucuccccugcacacaguuuucccuaguaauagagcauugguaugacauaucuguuacaguugucaaaccaauauugauacauuacuauuaacuaccauccuuagucuauguuaggauuuauucuguguuguaccaucuauggguuuugacaaacguauaaugucaugugucuaccauuacgguaucauacagaagaauuucacuauccuaaaaaguuucacuguccuaaaagugccuuguaucccaccucuuucuaucucccacugaaccccagaauguuauaugguuagagucauacaguauguagccuucucugacuggcuucuuuuacuuagaaauaaggauuuaugaucccuuguaccuuuuugugguuugauagcucauuucuuuuuaacacuaaauaguacuccauuguauggauguauugguuuguuuauucauucaccuauugaagcaaucuuaguuccuuccaguuuggugcaacuaugaauaaagcgcuaaaaacguucaugugcagguuucguguagacauaaguuuucaacucauuuggguaaauacuuaggaguguaacugcugagucacguaagaguauguucaguuuuguaaaaaccugccaauggcuauaccauuuugcauucccaccagcaaugacagaacauuccucuugcuccacauacucuuuaucauuugguauugucaguguucuggauuuuagccacucuaauagguguauagugguaucuaauuauuuuacuuuacaauucccuagugacauuugacauugagcaucuuuucagcaaguacugcaguccucugcucuaccagcugagcuaucgaaggaagcacugagcaucuuuucauauugauauacuuauuuuccauuugcauaucuucuuugaugagauaucuguucaggucuugagccuguuuuuaaaguggguuguuuguuuucuugucauugaauuuuaagaguucuuugcauaucuuucuuccucuccucuaguagucucauuaccuguauguuauacuuuuuuugauugccucacaguucuuggguuuucuguucuuuuuuguauuucucuuugcauuuuaguuugggaaguaucuauugacguuaucuauugauguaucuucaaguucgcugauucuuucuuuagcugagucuagucugcugauggagcccaucaaaggcauucuucauuucuguuagaguucuuuauuucuagcauuuccuuuugauucuucuguagaauuuccaucucugcuuugucugucuauucuugcauuuuauccuuuuuccauuagaguccuuagcauauuaaacauaguuauuugaguuagugguuugauacuuccaaaaucucugucauuucucaaucugcuucugaugcuugugaugcucucagccuguauuuuuaucuuaugccuaguaauuuuuguuaaaagcuggacaagaugugucuggauaauaggaacugaaguaaauaggcuuuuagugugagauuuuauguugauacgucuaggagcugggcuauguuuaaugguugcuacgguuguaaaugucagaagcuucaauuucuucuaguucccauuucuuuuguuuguuuugauuuguuuuguuuuugagauggagucuugcucugucgcccaggcuggagugcauuggcacgaucucagcucacugcaagcuccgccucccagguucacgccauucuccugccucagccuccagaguagcuaggacuacaggcgcccgccgccaccaugccaggcuaauuuuuuguauuuuuaguagagacgggguuucaccauguuagccaggauggucuccaucuccugaccucgugauccacccgccucagccucccaaagugcugggauuacaggcaugagccacugugccuggcccuaguucccauuucuuuugucuccucuguugucuuuggguuuccuuagaaauuuuuucuuaauagauucugugucuuguagcuugcuaaguguuaguucacuaauacguuccuguaaccuuguuguaguggugguaagguguuggagaggagaagcauucuauaaucuuaugauuaaaucucaggcuuuuuagggguacugcaucucuggccugugaccuucuaagguguuucuuagcuagacggggcugaaaucaucuaacuacccuuccccuaggucagauaagguucuggucaaguaguuuuccuugagggcaggucuuuguuuuggauaacagaacugcucuacuuuuccuuggccuauuucaaaauaauuacuuuuuccuuccucuugcugaugcucaagagaauuuuucucugaucuucauuuuaaaaacuuggggggaaggcaggggugguuccuggaaguaaaacucauggaaguaugggggggcucccuaaacuggauccccaggaguuuuuaacucucaagcuaguucaaacugagccuuagcaguuuguccguuacuauuuaaauguuccuacaguuacucacuccaguggcuucugucccuaggaagcugucauucucugcauuuguuugucucuccuguuuugggggcaguguuuggcccugugaccucaauucucugaaaagaguuaccagcuuucaguuugcuccuguugugaggaugggagugacaguuuccaagcucuugacacgucagagugcuacauaccaguuuuuacuccuguugguagugugugagaaagcccaaccuaaucucacaccugcuaguguuaccuccuacuuaaaaauugcuaccaauuagccacuugaaaaauaccuggcucuuucacaacuccaagacuagugaugacguugacauugcucuuuagucuuuuucugggggggagagggucauuuugucauuuccuuuaccuuucuuuuuuuuuuuuuuuuuuuuuuuuuacuuuuuuuguuuuugagacagucucacucugucccacaggcuggagugcaguggcaugaucucggcucacugcaaccucugccuccugggcucaagcaauucucaugguucagccucccaaguagcugggaccacaggcgugugccaccacacccagcuaauuuuucuacuuuuaguagagaugggguuucagccauguuggccaggcuggucucaaacuccugaccucaagugauccaccugccucggccucccaaagugcugagauuacaggugugagccaccacacuagcagucauuuccuuuauugacagcuuuauuuucaugaaaacuguuugaugcucugaugcuauucagcuuugaucuuuguuauuguugcucauuggcugagcuaaugugaagagcuaauguggcugugaggaacaguggaguagaggauuuuuggaaaaugcuuccauaaagagcuauuggaaggaaauuagaauggucaugguagaguauucauuuuucaacuagggguuauuuaaugaaugagaaaugaaguuagaagauuagggugaaaaaaucauguuuuccaagcauagaguuuuuauuuacuuuaaaacaaauggugcugagaguagaguuaaaguggaaaacauugaaggagauuagggaugacuauugaggaaaucaaggugguaguugagaagauuugaaggaauacauaagugcauuguggagagcugggguauaagaguuuguagaaauugugguuagaaaaaacaggacagcaaaaaugaauuuagaaaagagaggaauaaugaaaaugaguguuuuuuuggaaauaugaacauuuucuuuuaaauaaacuuccauaucauuguaucaaggaaguuuugacuagaaagcugcuacuuugaauagaaaugaaggacagagcuuaaccuacugaacuuacaauuuguugaagagacaaauugaagcagaucaucaaguuuuguuuuugguguguucaaaacauucaaaauugagagucuccuguuuuuauauuguaagacuccauggugacugggaggacggacaagagggagguugaagaguagaauucagagugaaagagagugcucuaagggaacuugagcuagggcauagaaaacaucauggcuaugcuuugguucuccucugcccaggcagcuuccagucacucacuccuauauauccccuaccccaucaguucuccuuugucuuaauuuucauugucaacuuuguuguggucuucuuuguugcccuucaucuucccuuccuccuccuccuuuuuuucucuuucuuucucugaacaaguaauaguuuuuguauagcacuagagugcuauaaguuguauaauuuauuaauauuuaaguuuuuccuuugcucacauuuaaaacuguuuaaauaaacugauauguugcaguuaaucaguccauuugaaucagaauuugagagcuuauuuaaaauuauaauaucaguucuccauagguaaacaauagagguuaauaauuagagaagguaagcaccaauauguugucaucucuauuuaauuauucagcugucugguuuauuuggaaguugauauaagauuguuuuuauaaaggguacuguaguuuuacuguuguacaaagucaucauacuuauguuuuucaaggaaaguaauuuuguaugaugauucuuuaaaacaauaauuagccauauacuuuuuuacagguacaugaaaucccgcuuaaccuauaaucaaauuaaugauguuauuaaagaaaucaacaaggcaguaauuaguaaauauaaaauccuacaucagccaaaaaagucuaugaauucugugaccagaaaucucuaucacagauuuauugaugaagaaacgaaggauaccaaagguaaaauggcagcauauauguguguacaugugaacuguucagaguauaacuaaaucacgagaaauguagcuaguucuagaaaauucuaaaucuagaguguuaauucccaaccaggagcaguuauccuaccaggagacauuuuaccaugucuggagacauuuuugguuguuacagcugggugcuccuggcaucuaguagguagaggccagggaugcugcuauaacagccggcagugcacaggauagcacccacaaaauaaauucucuggcucacagugucuguagugcugagccugagaaacauugcuuuagagucuauugugaaacuaugcccaauguuuuaggaaauugaauaguaaugauaauagcuaguccuguugauauagcuacuuacuguauggcagagagugugccaagagcuucaauccuuacaacacccguaucacuuacuguuauuacucccaauuuguagacuaggcaaagagagcuuaacuuacuuguccaaggucauccaguuaaaugauaacacuguuacggguuuuauucuuauaaccacuaugucacauugccucuugaaaagugaauuguucaagcgauaccaacagauagcuagugaccuaauaaauaucaugcaugcaacuucuguugauagaauaauuauuauuuuagcaagaauacuaguucuugguuuuauuggauacuaacaguaaaaacgacuaauaccauucauauucacaacuuaauguauuaaagacucuuuugcaaguuggccuuauaaaaauuagcacuaauaucuuuauuuuuaggucguuauuuuauaguggaagcugacauaaaggaguucacaacuuugaaagcugacaagaaguuucacguguuacugaauauuuuacgacacugccggaggcuaucagagguccgagggggaggacuuacucguuauguuauaaccugagucccuugugaacuuuugaacauaccaacaggguauagaguauagaggcuauuucuauaauuuucuuauauauaauuuuuuuaacuuuuaaucuuuuuuguuuccuuuuuuuuuuuuuugagacaggaucuugcuuugucacccaggggcuugcuuugucacgcaggcuagagugcaguggcgcaaacauggcucacugcagccucaaccucccaggcucaagugauccucccaccucagcccccugaauggcugggacuacaagcgugcgccaccaugccuggcuaauuuuuguauuuuuuggagagaugggguuucaccauguugccuaggcuggucuugagcuccugagcucaaacaauccacccuccucagccucccaaagugcugggauuacaggcuugagccaccacaccugaccuauucuuguuucuuauaaaaauaaaacuuuuuuggauaaagcuuauuucuuguuuuuuucuuuuucuuuuuuuuuuuuuuugagacagucucgcucuuucacccaggccggacugcagcggcgcuaucucggcucacugcaaacucugccucccagguucacgccauccuccugccucagccuccugaguagcugggacuacaggcaccugccaccacgcccagcuaauuuuuuguauuuuuaguagagaugggguuucaccguguuagccaggauggucucgaucuccugaccucaugauccgcccaccucggccucccaaagugcugggauuacaggcgugagccaccgcgcccggccaacuuauauauuuucaagauucaccuccucucaccaaauauuuaacuaccugcugaauacgccucuguacuaggcacauaauggaacuaaaaaaugcucauguccaguuuuuguguugagugaacaaugcugcagacccuaauaagauuggguacagaucggcaugcgccuguagucccagcuacucaggagaauugcuugaaccuaggagguggagguugcagugagccgagaucgugccacugcacuccagucugggcaacagagcgagacuccaucucagaaaaaaagaaaaaaagacuggguacagaugugauauuggaagaaaaagaucaagcugaugagguuaggauacccaggcccuuuggacuuaaagaucacuagugucuaaauuccaucgauggcauuucagucuauagguaaacuuccuggaagcuggauuuggagacaguuuaucaucugauuauugggcuuucguauagguccuuagggagcagcuuaccugaaaugcauuuaguguacaccagucuguaaacuucaaccuguaaugaaaguguaauaaauguacauugaguugaugugauaaugugauauaauaagaaauauauauuugaucuuccuaucuaguuccuuguucagagcuccuaaaacccuuguaauuuccaaagugauggaguacaucuuuuguucuaguauuuggucuuugaccccaguuccugacacaaagcuccuaaauuccuuuaaauuucccagugauaggagaauuuuuuguucuaaugaggucacucuugaugggcaccuggauaacucaggaugggggcugcucacaaagaccacaucaugauuggaaguuucaaacuuucagucucccaccuccagagagg

SEQ ID NO: 18597 - RNA, 5645 nt, Homo sapiens
guggagacagcuuccuugguuucuucaaaauuuuauuaacaaaacccagggagaggaggcaaggaugaguggacuccgcagccccaccaggcacugaacaugucgacggggacagucccucugauaaaggcagaugggcggucaaccgguggaugggcacagggagaaccggagaaacagaugaguggaggaacggacacacgggcaccgggcggcucccccaucuggaaugcaggguguaagggguccgggccaggaggcucagcggucggcacuggagcgcaggucgguagugaggggaucgugcuggaucgucuggugcagcaucagggccagcaaucccgcgcgguuugucauggcugugcgcacauugcgcuccugcucaaacagcucguccagcuuguaccacugccaagggagcggcaggaguccuaagcaggaacaccugcagccccgccugccccggccacguccgacauggaaaccuaccacaugcagcaccaaaaccgcacagaaaccuaccacacgcacgcgcuccaaguccacuuccgcacgccgcagcuucucccagcaguaauggcgauugcacuggcgcuugggcaggcggcagaagucacccgugagcucaaagacaucacguacaagggggcacccgcauaccucgucagcuggcaccugcaaggaggccagguuggggggaugaauagcggugauaagggagaauaggaaugggggcucaaggagggagaaggaaaagaauggaggguucagggaacggugaggaggcauggaaaaggaggaauggagggugaagcagcagggaagcugagaggaaaaagugaaggaaaagugaggugaggaaggaagggaugaaugugggacagcgaggcagggaggaggggcaaaaugggaggagcugagggaaaaccuuacuuuggggucccgugagugcucggggcacagcaccuggagccgcuuacaguauguuuugcucugaggauuauacacaucacagaagagucguguggcccuggggauuuggaguagagagggcaguagagggagggaagggagguccaucuguccuggcugguugcccguauccugccccagcuccacacacaucccacuucugacccccgccuuaaccccccaccucucacugcguggcacccucacuuacccuucaaugcgugugggguacauggacccaaaggacgucuggcucucauacuggagggaugagcacaaauggagggaacuguggaugugcgcugcaugcccucccaagacaccacccagacaacaaaucugucccccacuggcccacugauguucccacaugguccgcccccucagucugacaccccaaccuuggcguagcagcgcuccauguggcgcaaggcaacacguggguugauggggugcccacaggaaacacagaagaucugcaggucugugucaucacugucacccucguugcucugcauggaauggaaggaacaauaaggcugggaaggacaaaguacaggcccugcucugcugcgccccugcuugcucaccuccucauccucgcgcacagccugcugcuuggcacguagaaugauggccucaagcucauggaaucggcguuccauuuccugaaggcgagugcgggcacucugcugcucucggcgaaugcguucgagcagcuucuugccgugcucuucagcaaugcaagggcucugcugccacugcuggaugcgcugggggaggaucucguagaugcggcugcagggaagguagcaagcaacagaaugagugaggugaucaguaagugagaauggcaaaauagacgcaaauggcaaaaggagaaguaaauaggugacuggcggaaugguggcuggauggacacacgggcagguggguggguagguggaugggugaguggguaguggcuguuuggugacugguggauagcugauugacugguagacauacagaaggcuguggucaggcccuaccaugcacuuccugacucccuugaaccucucaggaaugacucacuuggcugccagcuucaugccacagucaucugagcaauacuuggagcugggcugggcggggcgcacacagccgggccccaggcacuggggcagugacgcaggguccuuggcaucagcccucucuggguguuuccauuuauccuugugcuucugcuucugccgaugccgcuuguaucgcuccuccuucuguugagcaagacaagucaggucaggguggagucaaagucagccccagaccccagacccuugcuccauucuagcccuuucuggcucuugccccauucagccucugaccucugccucucccucaaccccacccucugccuuuccacauccacuuuacccucuccaucaccuucuucucagacuucuucucccgacgcuucacaugcuucacuuucacugcccucuuccgcagcgcgggguccaggaauggggacucuucugugucgcucauccagggcugcaagcagggcaugcacugacccaccugccccgcucgugacaaccccaccaccuacucaugucccauaucagccuuccauacccucugucuccucauuagggauacucucugcuucuguaaccuccacccuuccaccaguggaugcuccugucugcucaccaggccauggucaucaaaggccccugcacagaaguccugauacaggucaggauccagagguagguccucaucugagaguggcucagguguggcuguagccucaggaggcuccuugacuguugaugacgccacugcccccucaucuucacggaugcgcccuaacuucugugauggcuguggcugcuguugggugggcaguggccggcggggccuuggcagggacucugagggcgucacuggugagagcugcagggcagaaucucaggacuggcccugaccgcccugcccgcaugccccaccccacccuggggggcuggacucaccgaggaagggaaguacuuguacgauuccugugccggcaggaggaaggcccaggucagccccagguggauggagggcggccuugcccuagcccuacccaccuggccuggccuuaccuccccagacacaccuccccgcuaccccucauugccaggaaugcucagcccugccugaucuguaccaacaugcaugaccaccugaaaacaccuggccccacucugucuacccaggguugguggggguguucugccagcccagcauaccaggucaugccccauucaucuggacaugacaggccccuucccaccugucaggauacagucaggcccaaucccaccugguuuauccaugccuagacuuaacuaaccaugcauggacccaccagcucucccacaccugacccuacccagcucuguccaugcucacccgggcccgcagcuggcacuggcgcagccggcacuucugccggaucuuguuggggcccccgaacuucuucaugucccgacagaaaucacagugaccacaguccucagugcgccgacaugccucacacucaccacacaugcgggcugaccguuugaucugcugcugcugcugcuggugaugcugcaggagggggcccagaacagaaaucauggacccaggcagggcugaaacggaaccacuuuacacauccauucacuuuaugcagccacucaccuggcuggguguggccaccaagggcugcggagaggauuuguggggcgaagcagagccccgagcaagcauggccccaaccccugucccugacccugcccggcgcugcaggucuggaucagggacaggccucuugcgcccuccacccucaucccggggcucacugcugucccgcucauugccaucccgcucccgugacuucuugugccgauagcgaaucucuagcuuggggucuuucucuguggggcagagaguagggccaaagugagugagcacuggauggcuugaauggucccaaaaccucuuucuuccucuucgcucccuuacugacccacccaccuacucugcaccccuguccagggcagagcugccucuucccgugggaucuucuauuacucacaauggagccccauuccagcucaccacagacguguaucacuaauccccauaacccccccuuguggcuccuccuccucccuugaagccccaccugccuucccuguccauccauggcccucaccucugcacucccgacaguaccacucccggauggccuuggccaucuucucagugauccggaugcaguccccauggaaccacucauugcaguugucacacccgcugcagaggauggggcaggcgauggagaugugaggggcgcggcccaucggccucaccccacccugccagugucagccccgcccaucucucccgcgcucacaucaugaagcaguugauguccgguuugcggcagaugcaguagaugggcgcauucuccccauucucggacuugcuguccuccccggcaucuggaggcucugggucugaaccaucucccuccugcaggacacccccauuacggauccuuaagcagcccccaccguggcggcucauccccccauuacaacuccaccguggucagcagggauccccacucugccugcagauuucacaucggggcccccaaaaaaccucuccaucacaguccccacugacccccaucccuuccucugacauccuauuacucugcuccauacuucccaucacgcacccaccgacacccgcucccugcguccacacucgcuaaugggucauggcgacccuccaucguggcgccucacagaccccgcguaacucacugcggacuucccaucgcgguucuccacgcaccccucccuguuuaucucauagacccaccuggcacccgcacccacccccagucgcggcuguccacggauacccggacacggacuccucgucacggcucacuacagaccacucaaugugacuccuuacaacccgcuuaucccucugcccuaagaacccccgaucaugguuucccacggaacugccacacggaguccccacuaaacuucuauuaaggagccccccaccguggcucaccauagaacucccagaugguucaucauucugcccauagacucccgccguucaguccacagacuccgguuauggcucaccacagaccccugagucggccgacagaccccacuguugccaaccgaccgaccuccaccgccgaaccccucccuggacccgcuacuuaccauaucuccgcucccggcgcacucccucacgacccccgccagcgacccgcgaaccugcacagaccacucggcggcgucccaggcgguugcaaaggcgcccacaacuacuuccgcuucuagucacgccucccaggcagcguacuccuauugcgcaggccccaugcgucgucuccgcugcaaaccaguagguggccggccuagagcccccaagaccccucaggcgccgccaucuugcuuaucguauccguaugguggccgaauccauauguucgccgggaacauggccgcgcucuaauguggcuuucccgagggcgccgccaccuugucaguagaguccguacggcggcugcuuguacggccucgacguacaggcaacauggcugcaccuac

SEQ ID NO: 18598 - RNA, 4710 nt, Homo sapiens
uaaagacaaccaacauucuuuuccuuuuaauuacauuuauuuuaaugcugaauuuacucccgugccauaaguuuuuguuucuucaguuucuucugggauaucuggggaaagaaaaauguguuaaguuucuuagagaaaaccacaguacaucuuggaggacuucagcuuauucuggaggcaggaaaccuagucguuaaggacuaagggggaaaaauacuuaaaugguagaaaucaacagaacuuaaguucauuagauguaaaaagaaguguacagaaucacucagguucuugacuuaaaagaacuaaaugugaucaauuacugaaaacaagcuucuuagauuuggggagagggcccauuuugaaguggcuauguacaucuaaguggggccaucagcagauaaucauacgggccugagguacugaauauaaaacuaccaguuuuuuuuuuuuugagacagcgucucgcucugucacccaggcuggagugcaguggcgcgaucucggcucacuccuaguuccuccucccggguucaugccauucuccugccucagccuccugaguagcugggacuacagauacccgccaccacgcccagcuaauuuuuuuuugcauuuuuaguagagacgggguuucacuguguuagccaggauggucucgaucuccugaccuugugauccacccaccucagccucccaaagugcugggauuacagaaaacuuaccauuuauuauuagucaagaaacaaacuuacaaaagccaaaauaagacaggugaaaggguugcucagaauaguuuucuuucauaguuauuccaaagguguccuaagauagucaucacagcaaccacaaaucuuucuacuaucacaaacaaaaccgagcaacuacuuauuuaccuuuuucuucugggcaaccuccucuucugguuuaggaacaaucuguuccuuuuccguaaggaucaucucaauguggcagggagagcucauguauggguuaauccgaccaugagcucuguagguccggcggcgcaucuuaggugcuuuguucacuuggauaugcucaaugaccagagaaucuacaucuaaacccuggggaagaaaggaaggagaaugaaaccaggaacauccuuaauuaguaaaacaccacaaacuaucauugcuaaauaugaauucccaggcuugcuccagaguccugccucaaugaaaucauuuuuaaaaggcaauccuuuuauucugcaaauagcauuuuuuuaaccaguugucugccuucaccuuuacaugucuaaauugccaccaaacucagugugcuauacauuuugucuaugaguggccuucccaaagauccuuagacggguggagagcugagggguaaggaagaacccaauucgaagucuugaugauaaaauuucucagcauggcuuagaagguuuggagccauacagaccuaaacuaauuccaguucuggcccagaccuucaaaugcaaaaggcuaauggguaauauacaaaauggagaaauuuguguuuugucaacacaaguuugucauuguuuaaacuuuuugaaauuuuaaacaauuucuuucugaaaugcaacaugacucuccauuaugaagguaggccacaaaccacauuaaucacugcuaaggcaaucauuuugauaauuaaucauacuaccaaagguguaugucacaaaaagggguaaaagccccugguaaaguaccuccaguguaaaaagacagcagaaaacuagaaauacuaaguguuaggcuuaaagagaccacagagcacgcuucuggaucuucacagaauuuugccauaaagggacucaaaaaaaauaaaaggaaauaguuucauucuguggaaacugcagguagaaauuuaaaaaauccuaagaguuaauuacugaaaacaagaaaaucaaggacauaaaucugaacagccaacauuaauuaaacaaccacccaaguugcacaggauguuagugguuuggguaccuuaaguucagcauuacucucugcguuuuuaagcaugugcagcaaaaauucagcacucuuuuugggccaccgaccuuguguccagccccauugcuuggccugaaagaaaauggagaugaugagucauuuuccuugauuuaaauuaacauuacagccaagaugaauuuaucugauaucacgguuucuuaggauaugguuuauuucaccaucaauccaagguguccugucauuacagcaaccagaaauagguucaucagcacagaucuuagccauucuuauccuaucccaucacuuuuccauuaaaaucugucuuuucaaauggcaacuaagaauucucaccugcgcacaccugccaacuccaccauuguaacgucggaaugguacacacuguuucuguaaagugacaucuuucagauacuucguggcuuuucguauaugcauacccuugauggccugagcaguuucacgaguguucuaaguaugaagaauaaaguguugguuaacuagaucaaagcuuuaauuuuuaaaguaaacguuaaauuuucaauuuucagcuuuucaaaaugucgaguuauuucuauucuuugggggcaaggcaauuaaaaaaacuugugacuaaaagccagguaaacuucguugaagcuagagaaaacuccaaaacuccauuuauucacuauaaaacguuuaaauuccaucaucauguaauuacaauuaaaaugccccaucuugaucugcacacuagguuuucaaaugguuuucugguacuacuucucaauuucacaaacgcuacauccuuacacccugaucaucaaugccuaaauauaagguggcugcucagaauuuauuaauuuucacgguaaauccaaagguguccuaagaaagucaucacugcagcuaccuuuuuugaguggaacaugaggaacuguuggaucacaacuaugaaucgcauaccuuaaagugaacacgaagauuggaaccucuugauuugcaugcuagaaaauaaaacguuuugguuaauuuuugguaucuuaugccaagccccaaguaggaaauggguaucuaccuccuguccacuuacauuucgugggguucuccgggucaagugaauagcgaaccauuuucacagaucaccuagaggaaaguacaguguaauucugucaauacguacuuacaguaacucauucaguauaaauaucagaugauucgaacagcugcucagagaguaguuguuuucauuauuaauccaaagguguccuaagaaaugccaucaucgcagccauacuuucccccaccaagggcuugcuuucccuuuuaucuuccaguaacuacagcacugcuuccacagaaguagccacacgggccucaccaauccagucaacccuuuggaagaaaauacagccuguuucaauccaaugcuggaucuuccaggcguaaaaugacucgacgcauccgcagggcacaacucaaccguaacccucuacaccuccucccucccgcucuacagaaaccccuuugcugucagggcugcagguagugagugccgucucucucaacaccuucgggcuaugacccacuuuaagagcccuccuguacgcaacacucuuguaguaacguguuacgccuccacccgacuuuucuuucccccaaaacuuuuuccucguugcggccaccacucaccacuagacaccggaccuccggaguccgcacggaccccaggcggcccgcaccccacggcgggccggcgcccccaccaguggaggagcccgguaguccccauucccgcccaucacgucccucugcggaccucagaggccgacugaccccggcucccaaagucaggcccuccgccacguccucccgcauaagaagccaccgccuccagcgaggauuuaguagcccuaggaguucuccucccgggggccuggaggccggcgcccccgaagccaggauggcggcgauggcaggaggauugggcccucggagcaacgcaggagaaacacucaccucaggcugcuuagggaaagaggaagagcgguggauuuugggagaacucaugagaacuugacuucucgcgagauucguagccgaagaaacgagaucugaggaggcaggaaggcggaaagcgaagggaguguagaauauguuuuaagaacgugugaaaacgaauugccuacuuagggacugucucaaaguucucuuuuuuguauacagaaauaaaaauucaggguuuuaaaugucagucaauuaaaaacaggguuguaguucuaggacaggcuacguauuauuagauaugaaagaaacauuuuauuuauucgucaacauuaguuagguuugauuauguggcccuguacuccugaaagugguuuguaaauggccaauuaaaaagaugaaaggaugagacguaauuaugguaaucaggaaauucucaggaugggaaugucauccaaucaauuguauuauaaccugugugaaaaaugcgcuaacugaagggucugguucaauauccucguuuuccccgcugcuucuagaucuucaucuggaggagaaaaccuuuuggcauuuucuucccuuuuuuccuuccccaggucaucucucugguuauucccucauagucagugaugcacuuagcuuuuguuagggcuucuauuucauggcaccacccuucuaggcagcucaaacucuaggagaguagacuccaggcuaggcucacuugcuuccuuga

SEQ ID NO: 18599 - RNA, 1049 nt, Homo sapiens
cuaccauccccauauauaacuaauuugugcugugcaccaacaagaaccugcuuuaaauuuccaugccaauuuacaacccccauacuguaccaagcaagguuaguggcuauugaaaauaccaccaggacagggcuaucuaaagacacauucgguaguguguuaacuauacaaaaaaagacacuguacaguuuaaaaacaaaucuuacacagccuuacauuucaguuuuuuucuuuaaaaggagugaguuguguacagggggguuaaaugcuuuauagacaagaaaaaaaaacugcgcuagaaccaacuuauucaucaucaucaucuucuucuucaucuucaucuucuucaucuuccuccuccuccucauccucuucaucuuccucaucuuccuccucuuccuucuuuuucuugcuuuuuucagccuugacaacucccuuuuuugcugcaucaggcuuuccuuuagcucgauaugcagcaauauccuuuucguauuuuuccuucagcuucgcagccuucuuuucauaaggcugcuugucaucugcagcaguguuauuccacaucucucccaguuucuucgcaacaucaccaauggacaggccaggauguucuccuuugauuuuugggcgauacucagagcagaagaggaagaaggccgaaggaggccucuugggugcauugggauccuugaacuucuuuuuugucuccccuuugggagggauguagguuuucauuucucuuucauaaugggccuuguccaccuuugccauaucuugaaauuuuccuuugucuuuagcagaaauggucuuccaccucucugagcacuucuuagaaaacucuugagaaguugacugaagcaucugggugcuucuucuuaugcuccucccgacguuugcacaaaaaaugcauaugaugacauuuugccucucagcuucuuaggaucuccuuugcccauguuuaguuauuuuuccucagcgaggcacagagucgcccagugcccguccggcucucacuugcccuggcgcugucucuguggagcucaauguacugc

SEQ ID NO: 18600 - RNA, 2303 nt, Homo sapiens
aucccacuucugucucuuucgucuucccuugccuaucaugauaggccucccaaagugcugggauuacacuccuucuccauucucuccugugcuuucucagcugcugucuucacagguugcuucuuagaauguuuuuuuaauacacacacaagguuucaaugcccuuuuauacaagccauauuuuaauuuacaacaaaauuaugauguuauacaacugcagcuuauguggccuuacacaguaaauguucagaauggcagcuucuguccguccaguaggguucugcacugcuuggcauccuacuaucuuccaagucaauaaguguuaggaucuccuugccuggaaaugaucauguaagcaauguugcugauuuccucuugaauuuauauuaccaaagguacuuuuggugggguggaggaaggguccaaaugccccuuaagcccuaaguguugauuucuaaauauuuauuaagcaucuacuauuguacuaauauguuagaaaucuuuuuaauugcuagagggggagaggacuugagcucuaaaggcggcuaagauucauuccugccuuuuccuuuuaagaacauauaauuuagccggcaagauguacauuucaucuuuacuuuucuuuuuuucuuuucuuuuuuugagacagagucucacucuguugcccaggauggagugcaguggcgcgaucucagcucacugcaaccuccgucucccggguucaagcaauucuccugucucagcugggauuacuggcgcgcgccacccgccuggcuaauuuuuguauuuuuaguagagacggguuucaccauguuggccaggcuggucucaaacucuugaccucaggugauccaccugccucagccucccaaagugcugggauuacaagcgugagccaucgcaccugggcacauuucaccuuuucuaaagauuauuuuaaggccaggugcaguggcucacgccuguacucccaguacuuugagaggcugaggcagguagaucacuugaggucaggaguuccacaucagccuggccaacaugguuaaaccgcgucacuaccaaaaaauacaaaaauuagccagaugugguggcgcgcgccuguagucccagcuacuccggaggcugaggugggagaaucguuugaucuggggaggcagaggcugcagugagccgaaaucgagccacuggacucuagcccgggugaagagugagacucuaaaaaaaaaaaaaaaaagaaagaaagaaagaaaaaaagauucuuuaaagcccccaacgaguuucacugcuggccugaucucacaauucucaauggcuuuuuaaaaaaaucguauuucacugaauaugaagugagguuagaucaccaugccaacuaguggccucaucaauacugauguguguguauuuaaaucauuacguuucucggagccaucagcuuucacgcuguaaaugcguuuaugcccuagcaaugccaugcccguuucuaugcaguaacccgccagcuuggguauauguuucuucgggaccuggggucaaggaauaaacucucugacucuaagcaccuugaaagcuacgaggcccagaaacagggccugcaugcaaaugaaugcccuaggcaggucugcucgcuggguaaccuucccgcgccgggaggcaggguggcggguggcggaggucuuccgggcccgggaggaaaccugcccgcggcgcgcaggcgagcccccacccccgcuccccuucucccgccgggaugcugccccucacagcucgucagccggccaaaugcauuccagagcugugcacaagacacacuucuccaggcaguccuagaaaccggagcccggagcugagagggcgggagggagcgcgcggccgccgcugaggucauauucacgccgccuccccgcccucggcggcuguuccccucagcgcacacuucccagggccucgguccaguccgguauaaaugucuuuuaaaccgagacagcgcucuccuccccuugcccucgggcgcggccaagggauccaccgccagggccuuuaaaacaaaaccaaugaaugaagcgcuagggcgagcgcgcgcgagauggccaccgcgaaacccagccgggucgaaaucgggccaccgacccgcucgcucagcuccaaaacucgcggcgaagcccgcucggugcucccugcuuuuccaauuucuccauggcuccggccggggcucaauccauucugggagcuucucugccccccaccuaucucucuccccuccaucgguacccccucuacagacccgggaggggguggcgguggcg

SEQ ID NO: 18601 - RNA, 2303 nt, Homo sapiens
cgccaccgccacccccucccgggucuguagaggggguaccgauggaggggagagagauagguggggggcagagaagcucccagaauggauugagccccggccggagccauggagaaauuggaaaagcagggagcaccgagcgggcuucgccgcgaguuuuggagcugagcgagcgggucgguggcccgauuucgacccggcuggguuucgcgguggccaucucgcgcgcgcucgcccuagcgcuucauucauugguuuuguuuuaaaggcccuggcgguggaucccuuggccgcgcccgagggcaaggggaggagagcgcugucucgguuuaaaagacauuuauaccggacuggaccgaggcccugggaagugugcgcugaggggaacagccgccgagggcggggaggcggcgugaauaugaccucagcggcggccgcgcgcucccucccgcccucucagcuccgggcuccgguuucuaggacugccuggagaagugugucuugugcacagcucuggaaugcauuuggccggcugacgagcugugaggggcagcaucccggcgggagaaggggagcgggggugggggcucgccugcgcgccgcgggcagguuuccucccgggcccggaagaccuccgccacccgccacccugccucccggcgcgggaagguuacccagcgagcagaccugccuagggcauucauuugcaugcaggcccuguuucugggccucguagcuuucaaggugcuuagagucagagaguuuauuccuugaccccaggucccgaagaaacauauacccaagcuggcggguuacugcauagaaacgggcauggcauugcuagggcauaaacgcauuuacagcgugaaagcugauggcuccgagaaacguaaugauuuaaauacacacacaucaguauugaugaggccacuaguuggcauggugaucuaaccucacuucauauucagugaaauacgauuuuuuuaaaaagccauugagaauugugagaucaggccagcagugaaacucguugggggcuuuaaagaaucuuuuuuucuuucuuucuuucuuuuuuuuuuuuuuuuuagagucucacucuucacccgggcuagaguccaguggcucgauuucggcucacugcagccucugccuccccagaucaaacgauucucccaccucagccuccggaguagcugggacuacaggcgcgcgccaccacaucuggcuaauuuuuguauuuuuugguagugacgcgguuuaaccauguuggccaggcugauguggaacuccugaccucaagugaucuaccugccucagccucucaaaguacugggaguacaggcgugagccacugcaccuggccuuaaaauaaucuuuagaaaaggugaaaugugcccaggugcgauggcucacgcuuguaaucccagcacuuugggaggcugaggcagguggaucaccugaggucaagaguuugagaccagccuggccaacauggugaaacccgucucuacuaaaaauacaaaaauuagccaggcggguggcgcgcgccaguaaucccagcugagacaggagaauugcuugaacccgggagacggagguugcagugagcugagaucgcgccacugcacuccauccugggcaacagagugagacucugucucaaaaaaagaaaagaaaaaaagaaaaguaaagaugaaauguacaucuugccggcuaaauuauauguucuuaaaaggaaaaggcaggaaugaaucuuagccgccuuuagagcucaaguccucucccccucuagcaauuaaaaagauuucuaacauauuaguacaauaguagaugcuuaauaaauauuuagaaaucaacacuuagggcuuaaggggcauuuggacccuuccuccaccccaccaaaaguaccuuugguaauauaaauucaagaggaaaucagcaacauugcuuacaugaucauuuccaggcaaggagauccuaacacuuauugacuuggaagauaguaggaugccaagcagugcagaacccuacuggacggacagaagcugccauucugaacauuuacuguguaaggccacauaagcugcaguuguauaacaucauaauuuuguuguaaauuaaaauauggcuuguauaaaagggcauugaaaccuuguguguguauuaaaaaaacauucuaagaagcaaccugugaagacagcagcugagaaagcacaggagagaauggagaaggaguguaaucccagcacuuugggaggccuaucaugauaggcaagggaagacgaaagagacagaagugggau

SEQ ID NO: 18602 - RNA, 32168 nt, Homo sapiens
aucaaguguacauuuuaaaaaucguuuaauggaacauaaacuccuuuagaaaaacauucagcuaggugauaacacccauagaaaaaaacaccaaucuuguguuuaucuuuuuuaauuuggcauuuguuauuugcauuuauauuaaagcaaagugcaucuuuucuuuauuuuucuuguuuauacacauugcacaauacauaaauaaugaugcuuauaaaacgucuuuauauuuacaaguaauaauauauuuauauauaacauaaaauacauuuuuuucuuuaauaaaucucagguuuuuuuucaggaguccuuucucucucaaagcacuacaaugcuaaauuuccaaugagaaugcuucucuuguucauuuaaaccuuuguaguuagaaaaauagcuuauguuaaagucuaaacaugcucauugagcuaagaacagugucgaaguaucauacgaguguaugaguuguagaagaaaugaaagaagaguuaggugucagccuaggaugguaccuuggguuaugacggaccaaauccuucuuggagggaaggggacugcuaagcaugucccucccagggacauccccgcuugcuggccuaauagcagagcuuaacacacaggaugggagcaggcagugcugagcugguuuucuaaguccgggaaaaaccugaugucaccagggcaggcaggggagaggcugaggggagagggcacugggugagcaauacugugagggggcugccccggcagcccuugggaagcccaucucagggagauccaggagcagauggccaaaaaagaaagacgcuacaauggcaggggcuggcaggaagggaauaagacaaggaugaaaauaauugguucugguucggccacuagcaggcucgcugcucagaagccuguggacaggcccguguccuugaugagggagaggaggggcaggggcuuucccaggcuggggacagagccgugcuccuggcagcugcugggaccccagccgccagcuugcccagguacugccucugccccacugagcguguccaaggggcaggagagacaccgcuugggacugcaaaccucucugcuggggacauccauaagagacacaaaacaaagagcacguugucuccccaucugccgcuccugcacacgcgugcacacacagccgcacacucacacucacacacacuccugacaagugaaaugaugaccgccccccuucauacacuguguuugguggugcuuggauuucugcuuccccucuuccuaucaggguguccugccgaucauaccugccccuucuuccaaaaaaacccccaacaauucuuuucauaagcuauuucucaaagagcgaaacaaaacagaacacaaacgaggacgagaagaagaaaaccaaccaacaaacaaaaaaaaaacgaccaaagaguuugcaugaaaagcaagcacucaggaggaaaauauuagcagcaaaguaguuugaaguguggccugcucagcucacgcucuguccccuccgcacgcggcuaccggcuguugaagaugaccucuagccagcacgggcagcugcugaugaacuggcggguguagcacuggccccagcccuucacaaagcugaucugcacgguaaagcccguccacggcugcugcauaaacucguggucauugggccgcugcaggcuguacgccuucucguagucgaaagccuugauggagaaaccggggaacaccuuguguaccaacagcguccuggaguccggguuguccaguguggcggacuugaugaagaugggguaacugcugcgguuguacacccacacaccauccaccucccgcgucagcuggaugccgcagccgauuuugcuccgcaccuucugcaccagcugacucuuguuguccgaauugagcuguccgaggcaaaagccauuccccugagguagaucauagaagauauccagagagggcuccuggacacaguagagccuccccacucucgucuucuccucccaguaugccaccacgcaccagugugaccgauccccaggcuccagaagaaguugggaaucuagaaaacacauuggcagagaggguuaguggggacaggcauuggugacuccuagaaugaagacacccgcccccccacugcacccagucaccagcucaucucucaggacgagacagaaagaaggaggcggugaggcuaguccuggacuugcccaggcucuuacagcccuuugaccaggacccugccuuucuuuaagcauaggaagcgcugggugcugcuucucuccaggccccugcccaucaggaguccaguacaccagcaucugugcccaccuggccaacaaagccucuucucugcagagcacagaugcaaagggacccuuaauagcuuggguagucugcuuuuagggccucaaaaagccucagcaacguccuggaguuacagaucuuucaacuggauggaaccuugaaggccagcuccuccagccccuugucauccugaugagaaaaccaggacccagaaagccugcugcuggaguaccaggggaugacacagccagagcuagaacccaggugucuagacucugggaccaccuaugcgauggucucugggugccugucacccagcucucaaaucagugccguggucaugaggaaccuaucugguaaaaauaaaaaugaggguggcuugggacaaaaacaucuauauuccuaauaggaaaacagucucagugugucagcagcagcccuguacacaaagggugaauucaugucaaaaugccaaaucacaacaugcagaccgguauuaacccgggcuaccuuaacaaagcuuccuccagcccagacagaagauuaugugucucaaauagaugcgucccccuucuccccuucucugccggcacccccauccccaggggugcccccucucuccccuccuuccacagaagcaucuggagccugcagggcgcccugcuccgcccucaucccuccccugcaggccccgccccgcuucccuacacagucuucccacaggcagccugggggccggggugauucugguaagguaauuuuccucaacaggcacuuggaggacuuuaaaaggggggucacacggagggaaagggagccccggcggcgggcauucugacuccuccuuaaguaggagccagcgggcaggccucagacuugggaccauaaaucuccccagcccagccagacugcaggaacgcugugguuuguggcagcaggguggagaccggaagucuuguauuuguuaacaaaaauggggacagcagagggggaaaagcagaggggaagggccccacgucggucagggccuugcccucgcucccugcagccccagcuccuccucuuggggaccuggggggcacaaagcagggguugagugugagauguguuuugguguggccuuuguguuucuggaguaacuggguucagagucaaugaugauggguugcacccugcaggggguccauggcggaagauggggccgcauccugcugccccagcaggcuggguaacuggggcagcccaggacacuaacuggcuccaacuuuuacaggcguguuaggaccugggaacccacuggcuccacucaguuguuguuguuguuguuguuguuuuaaguagcagccaguguuggauggaggugcccgucaguaaggccauacaaaugugcacacugcggccugcuggggcagccacagacacacacacccagagcagcgguucccuacagacaccccaagcuggccuucccaaaugccugccccaaaagcuccacaaaaaggggacacugaggucucauuccuuucccucaacccccaacccccacuaaaaaucaacaccagaaaacuggccggucaccaccccccauguagcuuggaaguccagugcuugugcaugugcgugugcaagacuguguccaugaugucaguguguacgaguguguguuauguguguuucugugugcacauacguacuggaacauauggaaaacaagacagggacagggagaaggugacucaucaggcauucacuuguuucugcaaaguauccaucaacugcuaauaaacuugugagcgcuggcaaucuuugaacuuucuugcugagggaacucagcucugaaggcuacaccaaagaccugaacgcccagggaaggaaggacacauuggcaucaagugugaagcgggggagaaagcccucuuccgggaggcacagcacauccacccuuuugguguggaggaggguguucugaaacacaagaagcuuuugcuuauuuucccaauucgggacaacaaaccuggccuggaaaggaagacucgaggagcugcugggaaggaggcgggagggagggugggugggagacccucagcagagccucacaaugcuuuguuucaugcagccaggacccacugaaaccuggcaccggccaacaggaggaggaggaggaggagcaagggagugaguggaguauggaccugagaucgaggugcccccaugccaggccugucagccaccuaggcaagggguggaagccuugucugccaagggugggggccucugggggcagaggaagcuggguggggacuggagccugagaucuguagcaggacggggaagugucagguggguuucuguuucaucugugcagcccgccagcaaugugcugccagacacccccuggaaaaagcauuuuucugcugagguuaauggcccagcccagaaaaacugcaaugcauggaugucgugaaugcugcugugugugaacaagggcccugaaguccauuuggugcccuaacccaccgcagggagacuccugccugcuccucccucgcuguccccuccagcucccccaccagcagccucuguccucccguuaggacagcuccagucuccuccugccgggacuaucucuaagcacacacaaaaaacaagcuuuccagcaaaaccauucggcaacagcaaaggccccucgaacacacacccuuguguggacaucacaccuucuggggaccccgcacgacaucccccauugccacuacagagauuccccuuugcccugaauuccccgccauuugggcucauuucugggaaaugcucagcuucaucuucacagaaacacaguucccugaaucgggcccacagcccacacgagucuccccacaaaggucuguguggacgcuuugcucccagggacuucccgggccacgugucgaggggcugggaaguucagucaguacaaggacuaaggaagagccuuggccucucgcugauaguuaaccucugaaggcaaaacucacaguccuuuguuaauuucccucagcuuuauaaccuuuuccgguauuuuccacaaacuucucccccuccccagaaaacuguacaggggcuuguuuuaaaacaguauguguucauuuuaaagcauccaaaagaaaagcuguguuguaaaaagcucacuaaucagaugccugcucacaguuguaucuuuuuauuacaguguggggaauuuuuggagcaacaccagaaaaaugcugaaucugccuaaaauuccuuuaagguguugcccccccccaaccuuccccauuucccuuaaagcauaaaauccucccuuuaaagggaagggggagguggguguugagaaaggagaggacuucagccuguguuugcgcuccaacuggggaagaccacuuagcaaggagcucccugacucuuacaaagaguuauuuaauuacccugcucaugaaugaacagaccagacccuuccaggagaccagaggcucgugaaugaaccucacaccccaggucucaauggcacagggugaccaggccucaaggccacauuuuagguuaagcaaggaauuuuccccuucuuaaauguuuuucuuuuuuuuuuuugagauggagucucgcucugucgcccaggcuggagugcaguggcacaaucucggcucacugcaagcuccgccucccggguucacgccauucuccugccucagccucccgaguagcugggacuacaggcacccgccaccacgccuggcuaauuuuuuguauuuuuaguagagacaggguuucaccguguuagccaggauggucucgaucuccugaccucgugauccgccagccucagccucccaaagugcugggauuauaggcgugagccgccgcacccagaccccuucuuaaauuuuuaauuugaaggcgucaggagaugagaaagaagaaaaaugggaggaggggggaaaggccuugcucagugccucaacaauaccauucuccaccugaaggcagagggcagagaggcagagcagcuccaagaacagccaugggguuaugagaacacgggcacgcguggaagagaagcuaucugggccugacugggcccagacacacaaagaacguacuuguggggagggggucccccaagauuccauuuaggaacaagggcaagcuuggggaaaaaagccaguaaagacaugagcuccaucagcugaugacccacgguuaaaugugcccaauugcuaggguaccgggagcuggggucaaaggcgagugaggacgggucuccaccggcucucaucucugugaggcacuuggauaaugaagugauauuccucugccaaaguccaacagggccacgggccuaucagcccccuccuccaugguccagcagagcagaaggcugaggacggagaaguuggggaggaagggcgccugggcaggcacggccgccuccugcaggcucccugugccaaucaggggcaaaugaagggcagaaauguggacacagacagcuugcaccuggcaaccugggagcgcaaacaucaccacgccucgcuaacgccagguccaggguccucccuccucaggacccaggcgccaccaacgguugccucauccugucucucccuccacaacggacaucucaaagguuaacagcacccauccccugcucccaacccugucaggaaauuggcuguucugauaucaacaagcccucuucagggacaagccuaagauaaaaggggacuccagugccaauccaucccaucuauucucacgccaaaccaucauaauucacaaggacccuugcuggucucuuguuuucaauaggcgaaucccucccccaaauagagacgcguaaaacuugcugagauaucugggcuaacuuuaaggggcugucucuaauccaccaugcucacagccucauccaaaagaggaaauaggaccccagagcucccucagacuccucaggaaacacagacaaugcugggguuuagagugaguuccucauggaggaaacaaaccaaaauguuucagguaaacugcgaguuaaucagaaaacacuggggcccaacccaucuccaccaccccaugcucucuccccaaacagaucagacgaugaauccuggcugguggaaggcugaccugagaacacuggauuuuuuuuuuuucaugcuuugcagcaucuccagugaagugagauggcuggacuugggggugggcagggggugccacagggucuccuucaaaggccaggcugcucucugguucccgggcccagcaggcuucguuuccaccccuuagcgcauucuagccauggcagaacccccgccccugugccaaccccagaggugagccgaccagcuacaaagccagauaugcauuucacaccaaccucgcaugcagccucccgguaaguucagcucaucccuaaaacaggguucccccaaggccagccucauaagguugcuguaccaauuugaugcaaaagugauuggggccagcuuguggagagugcugcacacacguuggucucaucucugaggcuccuggguucuccagccgcucagaaaaugcccaccagucuuccugauugucuccacauccccacaccccaugguagaacaguucugggccaaugccuacacuuaauaagcauuuacuuugcauaggcuguguucucuaaguggcucaugacaacccucugaggcugcauacuaucaccagccuaucuuaaaaaaagggaguaguaggggugaggcacaagucacuggccgaagugcagagcugcaauucaagcccagaauauugccuggugugagcuguggacacaggccucuaaagccaccaagcccacuguuccucuccaaaguguccuucagaacacacuuuggaaaugcugcaccagcuuuuagagcugcgcauggggugcaacuccccugcagcaagaaguggggggugauacggcuuuuuugccagcaagcugcucugugaccuuggccaaguggcuugcccucucagggucucaguuugaccuguccauaaauaauguaaaggggacaagggaagauggccccaugggcccccuucugccuucauggucucuggcuggacucugauucucaguauuaaacaacacugguuccauuuauuuuuacuaccuuccagagaguaagaaaaccacuuugaggagcaggguacauuuuugcauuuaauuugcaacaauaaaacaaaauaaaaucaaaagggaaaggagguuugagucagguuuugcuguguccaucucuaaaccaacuuuuuuuuuucuuuaauuucagagucagaaaugacuuuuuacucugucuuacuauucaucacccucaagagacggugagcccccaagagaggaucucuuuuaucacugucauccguccacugucugcccaggcuugguucccugaaguuucuccucccaucaccgcccuccuugccaccucucccaagccuacauauuucgcagauccugcuggucuagaacacuaauuagugacuguguccuuacaaauuauguuaaauaaucaauuccuagaacuaaaauguacucccuggcuccccaaacuggucccacaccaccucccaaaaccccccaagcaucugagucugaagcccccaaccuggggaugaaugcuccuaagagcauuuaucucgccauggagaauguaauugaggguggcacggggcaggggaggaaagccacacaaaucaaaagcucuugucugucucgccagucaggcugacgcggcuuccugugccccagcauucagccaugcaaauuacagcguguacccagcugccugcagccacugcugucugaggaggcccacucugcccaggcuccucugagagaggccucagaggaaggguggggacucccgacccagccaacuccauucauaauauugacaguaaagggccucucuggcugcuguuuagugugcaugcagucgaaucauuucucgaguucaaauuuccagauacuuccccuccaugguacaccaaccagguucccacuguuaccccccaaguaacucagagcagcucucuucagaaaggggguucacauauuagcaggcacagaagcccucagcccugcauggcauugucugcucagcugccuucccucugggcaugacccuggcacccccaggaagacacaagggcugggacaagcauggaacagaaagucugucguguccaagagaaacuaccaagucaagucucuuaccucacccaccuacccaccugccacccugagaguguaggagauuccccaaauucccuaucuggauucccaacugggcagcuggcacugaaugcugauucauucucucucucucucucucaaucucuuucucucuuucucucucucucucucucucacucacacacacacacacacacacacacguuaaagcaucaugaaaaucuuaauacaaaccacugcaucauuaagccaauuuuccaaaaggacaaaaccccuagaaggacaggacaguuuuucccugguuuugcagguggugggggggcucugugugugcaagaaaccaagcuacuuuugcugugggccucguuuuaauaaagccccaggcuaccaggaccccuaguccuuggaaggcaucacaggacccaaaggcagacccuucucccacccuaucccccacagauccaacuccacuccaguuucuagaggguaggaaaacuguccgaagacauggaaaaauacagugagaaacaaaaguccuuuucauuccuccccucccccggcuccccuuguuccauaacaauuaugaaaacuguuggaugggauggcauuuugaacauuuacugcauuccggccaauaaauuccaaugcaggauccgauggaaaagcuccuucuucuccugcgagcucccucccuggccccccuccccgugcacucccagcccucauuccaucucucacuuuacaacccaauaccagggccuggccaggccagggccgcacuguacuuagagggaaaaacaacaguacgacagccuggagacagcgugcagacuggaaaaguuaaucauuacuucugucugccuccguaaucuaaucucucccgcuuggacacacucacuguucagccaucccagcccuuucaccccuaaagcacccaggaccucccagacccaagcccccacucccucuggcggguccucccacuccuaaccuccaguuaggaggucaagggaauaaaagaagaaugaaagggucccccacccagaagcugcugucacaaggcccuggaguccaacauacacggccagcugcucugugcugggugccccaccuuucagagccuccaggccucccauaaacaugggcucccauaaaugugagcuccaaucuggcuggugacugcagcagcccagcacugccccucccccaccgcgcagggacagacuguccccuccccgcuuucucacucccucugccccaggauucgcccucaagcccaccccgguggguagggcucccccaccgcaugcgaucggugugugccgacacaugaggcacaagucaaggaggcccuaccguuggcgaugccuuaaaaaauuaaacacagaaugacaguguaauuuagcaauuccaccucuggguauauacccagaagaacugaaagcggcgacuccagugguauuugcacauccauguucacagcagcauuauucacaauagccaaaagguagaagcaagccaaguguccaucaagcaauaaaucaaccagacauggaauauucauacaauaaaauauuauucagccuuaaaaaagaaggaaauucugacauacgcuagaguauggaugaacccugagggcauuauguuaagugaaauaagccgaucacaaaaggacaaacacugucugauuccacuauucuaugaaguaccuagaggaggaggcaaauucauagacagaaagaauggugggugccaagugcugggggaggggagaagggaaguuaguguuucaugggaacaaaguuucagcuagggaagaugaaaaaguucuggauguggacgguggggauaauagcacaauaugaauguacuuaaugccacagaacuauacacuuaaaaauuguuaauaugguauauuuuauguauauuuuaccacaauaaaagaaaaaggccucagcucucuuaaggcucuccuuugcacccccauaacuaguccucauaagcauagauuuccugaacuggggauuccacgggugggacugggcuucagcaaagauaucggcccccugcagauguauacaaauugugguauagcaugcauuuuucugaacagaguccucagcuuucacccauacuuggaagaguuugcgagccaagagacagaaagaacuacaaccuuuuuauuuuaaaauggaagcagucuuuggcuuccauagggauaucucaucaauagggggaucauucccacaccccucaaauccaagagacaaagaucacagaucaccgaagggacuuggcagccaagcccaagcccuuauuuugcagaugagaaaacugaggcccagaacacagaaauggcuccugcaaggccauguggccagccaggggcugagacacucggccucaacccaggagagcaggccagccucuagugacaggaaaguggaggaugcuggccccgacauuguaauucucucccagcccccuccugggacuagggcauccuggacacccuggggggaaggugggggggcuucugaguuuuugcaggccccacgauccugggcucuuccccagaaaacagcccccccagcaggguuuugauugugcccccacugagcaggagauggggcccaucuauuuguaagaacgguauggugcacucagaucacacugauaacuaacuuuuuaauuuucccucuugguuacugauucaugaggggguggggcagggcuggcucagaggcugcagugaggcugacaagguccccaggcccagcucuugaugauccucacuuagccugcaggggaaggagacacuuaacagcuucaugaggugacuggaaggugggacaggggacagggacaaucauuuaaccuccgagugagccaccccagaaaaugcagacagcuaaucugccaacggcacagucauaucuuggcgucuuauuguuuuuguuccuguugagugacagucgcagaucaaaacguaagaaagcaauacugaaaugagcacacagucgcuggccugguuaucugaguugucuucuggcugaaagaaagucccgacuuugcaagaugaaauuggaauugagaccagaucuucccuuucugcucugaucaaaccccccagcaaaagcagcucuccccgccuuuucuuccugguggggcuucacggaggagcgagaagaguaauucaauuagugaacuccacagagcuuggaagccaucgguuggccccgggggaacagacagagaaggaugaaugugaaaaggaaacacccugguaacugcaucuuagauuauuucauccaaacccaaccccagacaggccagggccucacacacagggcugacaccucagaaacgggcuuaacccucagauuuaaaauuaaaaagcaagaauuuccuucaucccccagauggucuucguugcgaaucaaguccucuggaguuacaaagggaaagucacuccugggcuuugaaaacaucccacuucuccucuggcugucaagacauuagauacugucuuuccagauguuuccccaccccuuggccgugguccacugaggagccuggcgcuaggcuggucacuuccacucugugcugugccccagguacuaccagggucuggaggguggauuauaaccacagcuccuguucuuccugcugucaucuuacaaucagcaagaagcgggguggggaggcgggcuggaaccaaaacccgggagaccuaccucuguuuauccacaagcuuugcuuuaucucaauucucaacagaccacacaaccaaagcagaaguagaaguggaugacucaagagcuaggcccaucccagggggcccacccugcaccucccccaccuauggccuggcuucauggagggaccaggcuccucuguccuacagaagcugccccugccugccuccagguagaggcaacuccuagucaauccccccucccgccggcuccauccccauggauucaacaucaccuucggacaagccauuccaacugccaauucuuaauucuaacccagcccaggaacugguccucugcacagcacacagccuggcacauaauaggugucaauacauauuugcuccauaaacaaaccacagggacacacuggcuucuuccaaagcagcgggcccaccuagcuucacacccggcagagggaggcacaugugaacccaccugagaggggagcacaccuuccaagcacggagucagccagaaggaccaagucccucuccuggacuccccacggaggacacaagagggaagcccuguucugcgcuaggucacacucagccgccgcggcauaugccacugagagguguuuccaaggccggcgccggcccaccaaccucugugggcacaccaccugcccacagcauucugcuuuggcguccugcucuguuuggacaaguugcccucaccaaguguucaacaaugcuuuuacacaccccagggcccuuguuguguuaugaaaacaaaacaaagcacgcuaaggaaaaagcugggagggugggggugagcgugaguggagagcgggccagccacacacacaggucucuuucuuucuggucucuguccuaaagacggcuccuuggcagcacgggccggggcacugucccaugcccugugucauuagaacaaugacaucaacaaagaggggauuuagaaacccagagacaaaaaauggaacuggaccuuaucugcaccacuguagggcugugauaagcccccucucugggagaugcuucuaggugaaccauaucacuccuuccuccaaagcacagcaccguuacuggacacagcuguaccagggcagcuccgagacccauuuccccuccacuccucacuagcacccuagaaauagucucaggaaaguuacagaacuccugcaggaugagggggacacgguggcuugaaaacacgaaggcagcccugaguucccggcggcuaagugccaggugccucuguuaggggaaggcaguaccggggguggguaaaaaggcuaaaggcgugaguaaauucuuacguaccccccaucaaaaaaaaaaauacaaucuuuuuuuugcaaguuaaaacugagcuaaugacacuggguggggcucaguguugaggacuccccagccaaaccaaaauuagcuuccagccaagagcugcuuggccuuaccauuuggggaaggaagcugaaaaagucaugaaagauucuuuaguaaaaugggaaauaaggcggcaguuaacauuucaacugaaggugacccuucugguaaaauauuuuuuuaaauaauaaaaauaacauaaaguucucaaacagccucuuucuuaaagaaaauggccuacauguucucgugggaguggaagggaagaaaaaaaaaacacaaaacagaaaacaggcuagccguuucucagccacuaccuuucacgaaccacuuuucucuggaguuauucucaaaaaaaaagaugaugcaauuuccugucuugucccaauauuuccuguuaacuuacaaggugaaaguuaucacccuguuuuaaauaacuguccucaacaccgcugaaagucccuuuucccagccagugcccaccccuaucaaaaaauguccccaucuuagaguauaaauacgaucauuuucuacaccuuuuaagaguuggcuucguaagaagccugguucucucucuagcagauacugaauccacggggcaccuuccacgggaguggaagcccacaucucccaggugaacccacagagagaaacagagaggcuggggggcagccgagucccccaagugagccaacagguuuagguagaguggccgggaucaggugaguguugcuuucuugguguguuaaccacuaaauugagaacugugccucagcaguuaauaauaucuucccgcugaaaauagcccggagaggaagccucugugugacaguaggcaggcagccaggcuuggggcuagccauucaauaccgagcgagaggugguagggccaguggugaccucccuguggcugugcuuacaguauccuuucacgaggcucccgcaaagggagggugcccgggccagucaccuacggccacugcagcccuagaacuugggcaaggacaucacagggacuggggucuccaggggcccaggaagggucuggaucaccagcuuuuggagccaacccuggcaccauccugguucgcagucacugggaugggcaggccagggggaccccgcagagugagaacaagcauauucacuucccccagcagaaaagucaggccgggaaucaaaccagagggaacuuuccugucucucauuucuggaacccacgaagaaaaaaggaaggucgaaggaucagcacagaugugucugcuugcucagguaacacacagcagaaggccaggcguggugguacacgccuauaaucccagcacuuugggaggcuaagucgggaggaucacuugagguuaggaguucgagaccagucuggccaacauggugaaacgcccuuucuacuagaaaaaaauuagccaggcaugguguggcacgccuguaaucccagcugcuagggauacugacgcaugagaauggcuugaacccaggagguggagguuguagugagccgagaucacgccacugcccuccagccagggugacagagugagacuccaucucaaaacacacacacacacacacacacacacacacacacacacaccacacacacacacacgagaucccaggcaggcuaccagccuugcucccugguccaucaauguacuucccaugugaccucagggcugccaccaaaacaagugucuaccaucaucagguccuaggcaacuaacagaagucucuccaauuuuacucuccacaaucacuguuccuuauagauuauccaaguaucuacauguauuuaaaaccuaccgcuggccauuuuuuggucaaacuugugguaaaauacacauaacuuaaaaugugccaccaauggcauugaauacauucggugaacugugcaaccaucaccacucuacaguuccagaacauuuucaucgucccaaaaggaaacccggucccaugggucccuuuuacaaucccauucaugacagcaaagcaaaacaguggaccauguauaguuaauaauaguuuucucucaaaugucucuacaaagaagcaagaaaguuaucugggaagcugaaucccgagggauuuuagugugcgagcaaguccaggaaccagcacuuuacaccuuuuuuuucuucugccaggugaagacaacugcuuugagagugcugcuccgaguucaaggccuggaccgaaggaaguaaagaccagccuggccaucauaauucugcaaggaauuaugacacaguaacaacaauaauaaaggagcaaagaggccgggcgcaguggcucaugccuggaaucccagcacuuugggaggccaaggcgggcggaucaccugaggucaggaguucaagaccagccugaccaacauggcaaaacccucucucuacaaaaaaguacacaaauuagccgggcgugguggugcacgccugcaauccaacuacucagaggcugaggcaggagagucccuugaauccaggaggcagagguugcagugacucgagauccugccauugcacuccagccugggcgacagagcaaaacuccaucucgaauuaaaaaaaaaaaaaauuaaaacauuaaaaaauuuuaaaaagaagcaaaggaagccaaacuugaucaugaauucuucggcauuuccucccuuuucacugcuccaccggcucugagcuugccacggaggucccauagguguacaagucuacgcagcuacagucaggcuuugcuaaguaaaggcauguguguguguguguguguguguguguguguguguguguguguaggaagugaggggcaaucagcaugcuacagugucaccaaaagugacaccacccaaagccuggccuucaccuggcccucucccuuugcuggcccaguucagccuggggacaggaugcgugaggcggcagcagaccaucuugucuggccggcagagcagcccaaauuugcuccagagauuuuaaaugcugucacccuguauuuaaccccugccggacugccucauucuuuccaggacaaaagggguuuuaucaguaagcccuucuccagggggaagugcaugaccuggggcacugcagaagaggcgggguccaggacuggucuucaccagggugugggugugcaccaggugagcccgccccagcccugacucauccuguuggcagguguuuaaggagaggcagaagguguccccugaguucuaggccgucauuucucacaguggccugcaggguacuaaggggaugggaaggaaggagcuugcucauggucacaagcaccuguccaccugagucccccaaaguccacgcucaugagcauuuggaugaaaggcccacaugccugugagcucaaccugugcccccugcccucacuccacaauggcauuagagaccucagugaaaccaugagcuguuuuguagccaggcagggggaggugacuuaauuuaaaagcagagcaacaggcgcccaggcccagguucccaguucaugaucacaauuccaagccagacaaugaauaauuguucacgugcagcugauuaacuuuccuuaaaacaggauggagcaauguuuccuaagcuacuugguuugagcccaagucaacuguggacugagccaggggugcauuuucagauuauauagguauuuuugaaggcucuccucugagacuaugacagaugccagcaaggaucaaagagaaggagacagaaacauccuuggaugcugaauggauacugacucaaggacgcucccaucccccagacuuggggacuaguagccacauaugaaucucaagcaaagaguuggccacccuuggguuggaggcauggugccgggucucuccaacaagcaugacuucgcacagccaagagauggaguuucccaggacacgugagcacuucugucuccacugccuccuaccucccuccuugagauccaugggagcacuucuuuugaaguuuaaauaacuacaagugguugcuggcuuccaaucccuacccuaacugggcagguccauauggcugaggcccagccagcuccagacauucauauauaaaggaggaggcuagaagaugagucugcagcugaauaaccuacaacucacaagggagaugcugcucccucaacccacucaaaccaggacagcagacaggcaaaaugaaagcccccagacagaaacuccagauggaggcugcaaagaugauagcuuccaacacaugcucugcauucccagugauccccggaaagcucugggagcaaauccuuuccaucuccacgacggagcugagccuagaggcuucccagcuacaucagaccucucccaggugaucuuccugagccaugacacauccauguccaagcagcagcaaggaccuguucuggaguugcaugccuuucaaaagacacccaucccagagagucaggcacagacugccaaaucacaaagcagaaucaauccacaaacuccaccccacaaguccacaaccucuuggagaggccgcccugacaucaacccaccccagcgacagggacccacccuaucccagagccugccugugggcauccgcacgcucucauguguuugcgcacgggauugucuaucuguacgucugcggcaaaacccacccacccacacacccacccccacaacacacacacacgcauacacacacaagcuugcacccagcaauccaucugucucagagagccagcugucaaaaaugaaaguacaaucuccuggaagcaagucacugccuucuaaaaaugucccauuuucccagaccgaggaaacuugcaagggugggguguguuucacugcaagucccuaacgaccaggccugucgucuacccacccccccacacccccccaaaacaaagcugcaaugcuggaauuccaaccugcagccagcagccccgcccccgggcuccuacccgcccacuccccuuccucccgggcaguuugcaagggcgcaggaaagggaagggccagccuuggagucaccccugcauuucaggagaggaccggccuuugagcacaccccacccccaccuccgaggcaccacauuuucacauucggcuguuuuuucuuucccuucuucccuugccaagagaaucaagcccuggcuccugcugccgaccuuccucccacccuaaacugagccccauucauuaagcccgcucucagccagggcaggacaggaaggaaaacagcacacagggccugugaaagaggcucagagagguuauuucaaggaggaggagggagaaacuccucaguuuucacugcuccccaccuugcugccaggcucccaccccccaaccucagugucugcuaugccccuucccccauccagcccugccacauccagucacuggccucauccacagcaaggcagacacacccaggccaccccccauggaacgaucaacuucuugaaaaggaggagguuugggcuuucuccauuuacaaaacucucugcccuggacaggggccaauaaaguucccuuuuggaaggcauucucgcuacaaagaggacagcccuagguuuucuccgugcccaucaccuccccuccagacgcccccaagccggugacaucaacccccaaaacaguguacccuccccaccauggcccauuaugaauacacugcaccaacucugaacggaaagaagaaggagcucaaacuuugaagccuuuggaauuaguaaaucaagagcugaaauucaaaacaaaugcucuugccauguggaaggcccccucuucucucugcagucuucugaagccacacugcccuucagagagucacugcuucuuccuggcagcuccuuauuaauaucugugucuacaauuaccuggaggggugaggggaaggaguuaaugauuguuuuacccccaguuucuuucuaggacuggaagagcuuuggggaaaaaaagcccacccaucggccaggcgcaguggcucacaccuguaaucucagcacuuggggaggaaaggguggguggaucauccgaggucaggaguucaagaccagccuggccaacauggcgaaaccccaucucuacuaaaaauacaaaaaauuagcugggcacagugguggaugccuguaaucccagcuacuugggaggcugaggcaggagaauugcuugaaccugggagguggagguugcagugagccgaaaucgggccacugcacuccagccuggugacagagcgagacuccgucugugugagccgaaaucgcgccacugcacuccagccugggcgacagagcgagacuuugucaaaaaagaaaaaaaaaaaaaagcccacccaucuccugagggcuucacaggucacauggcacgggcgggugaggaggcacucaggcugguaucucagccuggugucgucauuuccuccggcaggggagacagacaagauguuaucaagaagacaaaccuuccgaaaggacccuuucaaaagcugccacuucccuugcuuauuucaugugguuuggaggggccggggcuccucccugcacauucaggguuuaaaaaauaaaaccaucuaacaacauccugagcguguuauucugcugagacccuuuccucucauuggccuucuuucuuucaagaacucucucagccuuagaaagcagaaaagaugcaguucacacacugcugccuuuucucccuccucaacuccucuguccacucccaccguacugccugaagcccccucccuucucuaggucccucuuuuuccugcucaauucucauuagaagcuuugaguaaacaauacccucagucucagauaacagaguauauauugcauugaaaugaaaacaaacaagggucucccuaaagacguucucagcaagcucaguuccugaagaggagagccggggagggagccguccgggaaugaacuuugccugagccagccauggaagacacaccaccaaguagucagagcagguaccccacaaaaaagggugccccucacacaagaggauacaccacaacagggcacagcuucuauucgagcugcuaccacgugauccuacaggcaaggaaaugccaaaugcccaaaacucugcuggaauuucuguuuuuaaggucguuuucccucuugcuucagccaguucuuagaaaaucuagugaugacaugguggggauggaaaaacagguagaaauaggauuucuucagaacaacaugaaaugcgucccauguacauaaccagugaguuucucuaaguacugcccucuuuucgcauccucaggaacaacaaugcucuggcuaccccgugccugucagccagccccgugaccccccagcacuggcauuccaggccuucacgcauaccugugagcccugaggaaaaccugccccgcuagggaacaauuacagcuccuacuguuggcagugcucccacccuggugcucccagccccagacaugugcugcaaaauccugcagcaggcugggcugggaaucagaacuugggagggaagccucagaucuacucugaaaucccaucguaugcuugggaucugucuucaacaaguucccuaaagguggguccauucccuuuacaucccccaugcgcaaagagcaaaagcaaaaaaagagcucaaaugcaugaguuaaugacaccaaagucaccaagcugaagccccccaagccaggagcugcuuaaaaauaaccgggcaacacuucacacaccaaagcaauccccagcucgcucuugucuccccguccacggaacggauccaguguccagagcguaaaggacugcaggaugaggagcugaagggcaccacaaugucaccaccgaugcauccaacuuaaggcauauaaaaaugagaaugaaguccagaccagcugggguggcagaaggccacccccauuccuccagucuuuagcaauuucaaaaaagguuggaauugccaggaaaauaagagaaagcaucuuaccugaaagccccccaggggccagauaauucguucccccuguuucagcggaggaaggcacagcaucuggacagucugcuguggauuugaaaaggggagagaaagaaauaaauacacaaauaaaaacaccaagauccaucuuuaagcacgcucuaaacagcaugaaagacaaaccacacauuccaaaaggcugacucgcggccuugaugcugauuauuaauggucugcucaggcuucacugcccaucguaagacagaccacagcaccuugucacccgucugggcuccgggcagccaguuaaucauuacucgagucaggcucaaugagacuggcuggaauuucucuugcauuaccagucccccauuacggauaccaggugguucccaaggucaaaggagguuuggguuggacuuucucaacccugguugcucugucaucccucaucaagggcagaaggcucucuccuuggagcccauguccucucugccuucauccuuuuaaagacagguuucccaguucuugaaaacauucucaagauugauguugggcugccgggacuucuuuccccuuuuuuaauugaggacuaacuuaaguagagcaaaguauacaaaaucccaaguagacgcaaugaauguuacucauguauacaucuguguaaccaccaccagaucaagacagagaacauucucagcaaggcuccgagccggaggggaaauguucuaccucucccaggcuaguccaaaccccucaucucuggaaaccuucccaggcaaccccagaccugcuaaggcucucugcccucaguuccuauaaaacauuuggcacccaacacucggaguuuccucacugauuuuuaccuuuagauugcaucugcccuuaacuagacuucucuucaacuucugucacccucagguacucugcacagugaccucaccguuaaugaggauaaugacaauuccagcugagaaacagucuccacaaccgcccuccaagcaauuaaagcaaaaccuaauguccaugaaccacaacucauuagucccaugaaacacaaauacacaagacccuguaagcuugucaugcaccacuggcagcgccaaacucccugaaguccuagcggagagcccggcuaaggaaaggugcugcccagguccgcagcaaacacaacagguuggaucgugcagacaccaggccuccuaccccaggccaccaggacaaugucccuguggguuuccaguuggaaccacuuggccaugcuggcaaauaggaaagccaaaaaaaaagagcagacgggcaaguagcccaugggaauccuuuaguggccuacacauagccccaaaccaucucuggguuucugcugucugcccucuuaaugcuaaguuucucucucuaacucagggucacucccucucccacauucucaaggcuggaaggacaacuuuucaagaacucuccuaagcgggcgaggggcagaaguggaggcaggcgugggggugagguggcugcgguggguagggggaaagaagacuguguguguaaucucauuuuaucaggguaaagucuaauuccuaacaggaauauacaguuuuacaggauacacuuaaucaaacagaaaacaauagaggcaggcaggaaauggaguuacuuguuaaaugguguauacccugcacuuucuaaaccauuuugauggccuucaucauuuucuagagauaggcuucucaacccucuccuccacccacuccucccagauggaagacacccccacauuaaacauaaugacuuauccacagccacuccccgccaccuuuggcuggcagaaucccaggggcaagguguguuucaaaggaaaagccgggcaucucagagcagagcugagaccacauucagggugucagcccaucucagaucaaagguaagccagcuccacacaggcaaccacaagcauuuuugugaaauggugcucugcccuucugcaguggcuuugaucucaagagggauuuacaaacguuaauuaagccucccuaccaccccugugaagaagcaaaguauaccuguuccauaggcagccagguaaacugaggcgucacugacuagcucaaagggccacccagugagcugggcuauucccaagaguccagcccuaucccauggcucucacuccccaggcaggcuauggagucccuacccucuuuccuggagguggccaggccauccagacuggccucaagguuaaaggagccauaccuccaucucucacccacagaaaagcuccgcauagacagaucucugaagucagggucucaccuuaggccugugucgccuguuccccagagcccaggcuggcuggcagacagaagcucuaggccacuccugacucacgcaacacuaaguguuaucaagcacuugguaagcacuagguucugcgagagaaaaagacucauuccuuucuccgagcagcuccaacagagucuuugaaaacccaacccuggggagcagccaaggagcgaacuauugagaaugaguacaagguaaaggagcugggagucccacgauagucucagcaacugcguucugagcuuccuaaguacuguuaaagacagaggagccccuacucaccacuguaccccaagggucccagcucugccccagguaguucaaccaacccagaacucaaaugaacccugguuauaaaagaacacagcacugccaggugcaguggcucacgccuguaaucccagcacuuugggaagcagaggugggcagaucacacgaggucaggagaucgagaccauccuggcuaacucggugaaaccccgucucuacuaaaaauacaaaaaauuagcugggcauggugacgggcaccuguagucccagcugcucgggaggcugaggcaggacaauggugugaacccaggagguggagcuugcagugagccgagaucgggccacugcacuccagccugggcacagaaugagacugucucggaaaaaaaaagaacacagcacugcaucggaauccucaaauuucuagguaggcacaucaucaugccuguaaaaugaaugacugaaccaaugaaugaauaaaugaaugaaugaccuaaucucuuucaucaugcugauuuuaaaagaggccuagaaaaguuaagagggaccucgguuaagagagaaacgcagugccagaucucaggucaagacaccagacuuccgaucuggauuugcaggcuggaucugcccauggauacuggccaccugggucccucaagagcucacccagcaaccccccaaggccagccauuccucaaaccuuucagaccaucagauacaaugaaacacgggaagcagagcccacacagcuauccccgagauccagcuuuaaacagcaaauucugacuucuugugggauguggaggugggggugucuuucugacuucugacagccacaagucacaacuggccuccccuagguucagucaugugaacacucuuucaaagaaggcucuccugguuggaccacacaguaccuaggugucuaaaguccaggccucccagaugcugaguggaguggcuuaaauuauagcaaaauggaguuccuagcuuugagcccucugugucuccaaaggcugcaggguaccaggccccagccccauucccaccaccuuuuccuaagauggagacuucacaggauguauuccuuuaguugugcaacugguuaagauuuuaacaguuguccacuguaaaacuuugugccuguuucaucuaguaacccaagaccaaaaauucaaccuaagggacauagaaacugaagaauguaaaugguccauguagauucccgggccaaacauucucccauacgcaaaauggggaugaagaccugggucagcgcccaucuguggucugaccucaaugcccccggccacagcagcuggcaaaaccagccccagaccugugaggggggcggggggggugugcuccagcuccagaccuggcuguccuccaauguggcaggacaauucccuucgugggggcuuugucuauuacugaugcuaaauucuuacacagcagcgccuuuucucauuucuuuuuuuguucuauuuucaacaaaacguuuugggugaguaaccagcugucuuaguuuccgauuggcagguuaaucacuuccuauuggcugaucuggagaacuuuucucccccuuggaaauggcacauuccugucuuuguggcuucucuguuuacacacauuuugcuaccuaaugucaacacuugcuaaugaauaaauauaucacuccacucaccgaaaaugaggcccuggccuggcagaaugacugcuuaaauccugagaacagauuuaucccagugucucugcaggaaacccaagggaacauggccuuucuuuucuaugguuuuuggagguuucugggaacauuuaccccugcuggucuuuaucccuggggcuaaggucacuguucucucucuuuuaaggaaaaccuccaaauuugaagaauauggaaggacaaaaaaaacaggucagagguggccccuuggaaaaugaacuucauaaaagaauucuugauucuuuaagccaaaacccagucaaguuacagucuuuaggaaaacagagcuugguaauuccaguuaacguuuguuacaaauacagagagcuggguaucuccuuauuaauaaccauuuaucugguguuuuguaaaucgaaagcaaaauaucacaugcuuugcgggccacuuauuagaccggcaccaggcaagcaggaacgccuucccaacuugagggagcugguagagucccaggaggacuggcugcagaguaugggcuucgguuacacguucauuaaaguauuuaauuuaugacaacgccccagcaaaacuuuuaauuaguggggggaaaggcccaacagccaaaacgcaggaggcggaaggacuugcagaauuccaggagcuaaauggugcccaacccuucacuuuuccuucucccagaaccuuggcaaaauaaaaaugucccaaguauuaauguuuuuuucaggcaccaguauacaggcacaaaaaccaagguuacauacaaccuguacuuuuagcaaacagaucuaucuccuacuguaagagggagcuccaggaauuuggguuuguccuuguugucacccccaaguucauuuugcugacccuguccccagcacugugauguccagaggauggaccccugugcugcugccggccagaaguugaaugcagacaaccacaacagggcuggugccagucucaaaugggcuucugccauggcuucaugccagccagugacaaagcagcagacaggcagagcuaugcuucaaacuuugauagucccuauggcgaauacugagaaaaccccgggagaggacugacuugcaggugacuggagcaggaggaaccuaccccccccccccuuuuacuggcuguugccuauacuucugaaaaguucuagugucuacuccagaccaaagucuucuuugcaccuuuuuaaaccgucuucccaucuaucgaaucacccuuuccauuauucccacugaugcuccuggcacucacuaagucuccgaguuauccccaucaaccaguccuauuugguucccaagacacuucucucuggacuaaagcuuccacguguuaaagcugagcccaccggcuacacagcacaaauacaugaaaaaggaacaaaauguaaagcauaucaagggaacgucuuugcaaaaacagcaaaaaacccagccacaacagaaaaauucaccaaacuuccaacagaggaaaccuagaaccaacgugaagcccagcaccuccccaagccuuugccuacacacaaaaagccacguucuagaggcucuauuucuaacuuaagauaagcaggauauuuuaaaaaucaucuacucaccaguugguuugagaaaauccaucggguaucuggaguaaggaggggggggagacucugaaauuaaaaaagcaagagaaaauaaaggcccagccaugagaagagagauagaaacuuaugauaacagaggcauucuuuuagcccaacuguuugucuuagcuguggggguuggaggcagggccgcgaggcggugauugccuugauauuuagcugucagauaaacaaaagaggccgccuggcgccagccucggcgcuccgcuccuccacgucugcggccgcagccgccgcgcucggcuggcccggcuggaaaccaccggcucggccggagccgcgcacuucacaguucacagggcggggggcgaccaugcccccuccccguccucggacuccagacccagcucccagcaaccucggcuccccgccccggcccgccccccaggcgugcaauucaccucugcccccgccgguccgcucggcacucgcgcgggggacacggggcugcccauuccuagcgcacucgggagaugcaucccaagcgugcuggggaacgugggggaucugcgggcgcccggggugaacccucacaucacacucuguguacagagacguagaguaaaggaaggaauggagaaagcugagaggauaaaaggaaaggaguuucagggucucagccgagaagcccaggccccagcgcaguaagaggcgacaacgucacugaggcgccggggccccacuaaucuacagacuuaucugugcggaaggaaggaaaaaguaggggacacccaacuucuccugccuguuuguuccucugcacccuggggcuggcagaguugaaaggagacagauacccaguucggccuuccauccaacucucuuugccccaaaacuccaaaggugcgcggccacgacaguaucugggccacugguguucgacgugauucuccguauuuacuaaaggaguaaauacggagaccuuccagccuuuauagcacgccucucccagccuuccuuggcgggccuggaccaaauccaacucggccacacaccucaacgucuuuccgggugcggggaggcgugacccccccaccucccucugcacccccuuguugauccggaaaugaaggcgucuaauuuuuaaccgcagacugcaggagcagugcccguagaccccuucggggcaacacaggagaaaaccuggaagggaacccccagggaaugcccuuugaguuuccccuugucccuucucuacuuucagcccccagucucuucccaggaggguaugcacacucucccaggaggguaugcacacucucccaggaggguaugcacacucccccuggagggauggcugcacaaacgcacugcccuaggggcuuuucuuccagcacuggcgcuccggaaaauguuggggguagggggacaacuucucaccuaguucgcagagucggcuaaggugauggggguugcagcacaccagcucgggguugaucuucccguaagauucacagcaacacagccucuugacuuccgaggaaugccugagauccggccaccugaacacuuugcacagcaggagggggagcgaguaggacgagggcggcugcgcaggcugcgcgccggcgggcgcccccgggcccagccugcaguccaggcggccgggcagcaggaggcacgcggugcgcgucccgccgcgggacuccacggccuggagcagcagcuccagcugccgcuccuucaguuucuugagcaccgagugcgugagcgccuucagauccgccucggcgcccccggccgcgccggcgcccgcggcuggcggguggggaugguggugaccuuuggcaccucgcaccgccuugcccaggcagcauccagcccugcccgggccgccgccaccggccccaugcgcucggcuguccgucgccccuucuccccgcagcucgccuccuccuccaccucccccugcgcccuccuccucguccucgccgccgggcgcacggcuccuccagagacgccggacgagcgcagaucguuugguccugaacaugcggggcgaggaggcgaggagaaaagucguuugccugcuaaggagcgaacaugaccuccgcacaccaugaagaagucgggcgccgaguuggggcagcaggcgcaggcgacagcagcagcagcaggggcccgggcaggagcggcggcggcccgaggggcgcuccguggcaugcgccagucucccggaggccggggcgcgcgcgggggcccgggggcgcccgccggggaucgggggccugcgcuccggcugccccaccccgcgcggcccgcgcccugcgcggcucuccggccccggcgcgccccggaggaacccggccgccgcuucccuggggacggccgagccugcccccgucggcgccuccccaaaaagaggcccccccgcaguggcucccgaaugucgggcucgccagccucggcuuccuacauggaagguccgcgggggcaaaaaacgaaaggcguucggcugggcuguuggaagaaggaaaaagccucuuucccccuugcuaagcaacuuaauuuggggguggggagaagcaggcaauuaaaaaaaaaaaagcaagcgauuuauuuuuuuccucuauauccuuaguaaccggaucuccucgaauuccgcgcacacgaagacucaggggagggggccgaguggacuucaccccgcaugagacgucuggcaaaauaagaaggcucucgcaaaaccuaacaaccaaauaugcaaagccccaaaugaaaaccaccaccuccucgaaccucagaggucugggggcguccggcuggaacugggguuuaaaaaaagaaaauguuuacaaaguauaacaagauguuugauggguggaaaaauguauccacgaguuacauccccccguuuccuugcaaagccccgcuggucuuccucuccuuuucuucugccaaaaaaaaaaaaaaaaaucguguauuuuuuuaauccacagaaagcuuuggcuagaccgcuucaauccugcgcaucugggugguuuaggggagucucuggucuuucccccugcgcuccugggggcccagguccucggcggggacuuccucgaggcuggcgcgggcgcaggggcagaagaugcugcggcggcggcugagcccggcggggcugacagcgcgggggaggguggcgcggcggcggcggagggccccagacgggucgcgcguucucgccccccccgggcacaagcugcuugcuagugcaggggccgccgaugucccuuccccuggccgcggcuggccgccgaggcuccccgcaugggcugcucgccucgacccagcugcggcggcaggaggccccgguguccucucggcgccuccuccuccgagacucuccucgucgcgcccgggagccuccuuguccccgguccgcccucuccuggcgcuccgguccuucugccgccgccaggggcucgccgcgccgcacucaggggcucaggggccgggcgcucggcggcucggcgccgacggacuggcucugucucgggcagcucucucccgcgcggcgagcggaccgagcacggcgcccggcuggcucggcuggcgcggcucggggacaggaucuuccgugcgccgagcagcaagcgagug

SEQ ID NO: 18603 - RNA, 212 nt, Homo sapiens
caugccucggaaaauugaggaaaucaaggauuuucugcucacaguccgaugaaaggaugccaaauccgucaagaucaagaaaaauaaggacaaugugaaguuuaaaguuugacacagcaaauaccuuuacacccuggucaucacugacaaagagaaggcagauaaacuguagucccugcccccugguuuggcagugaaggaacuaaaaugaa

SEQ ID NO: 18604 - RNA, 3373 nt, Homo sapiens
uguuuuuguuuuuuuaauuugguguuacauaaaagauuauccuauccccccgggagauaaauuuauacuacuuaauauaaccccacaacaggcgcacaccacacacugcacagugcuauuuauacauuuuuauuuauuucagaguuugccuaugcuacauuagcgcucuaauacauaagaucuaugcuguaaacaaaaacaucuucaaaguugaaauuugcugaaauauacuuuuaacaaaauaacauuuuuaaggcuccauugaaaaauacuagauaagauauaaucucauauaaucaguaugaauaauuuuaaaaaugagaaauauuuaggucagccacacuuccuuugugccuugcaagaauucaguucuguggaugaaucaguacugguuagcagacuguuuucugcaaaccauuuuaaacaugcuuuaguaugcaacaaaaagggaccucaaaugcuaaaauacacuauuuuacguggcauugaauagccuugggacugguguaguuuuaucaacacuuuuuuauuaggaagaaacccaagaaaauuuacuguaauugcuaccaccugccacuguauaaauaaucuaaaagggacuucccaacauugaacaacaacauugagggcugacucgagauccuucuacauugucaccucagccuggcuuugccugucacugcuuagcuugaaguagugacacuguucuguaucaggagauuuuuauaauggcccuagcauccauaauuccacauguucaucaaauggcugaagaguaugagagaaguauuaaggucuauguuugggcugucuccccacuuggcauauucuguuuuucccucuucaaaauagauugaaagccucuuagugcaggaagcaggcaucaguaucaaacugaugucauccaauguaauuauuuuaagcuccagguuugucuaaguuugggugaagaauguucaggaacauguuugcaacauacaguuauccagcuuacccuuugacagauucacccuucucaucaaaauaguaagcccaaccuaaaaauuauaaguuuacaaauaaaggaauagaaaaacccaaaaagcuaauuuacacauaaaaauuaucuuuugcugcaauaaauagguauggaaauauuuguagaauugguuuaacugauuuuguaaaacaaaugucaugcuauuuugccauagugagacaugcaguaauucuuaaaaucacauuaauagaaggcaagaacauugaaucagacuuagcagauaacagauucagugauaaaugaacaauagacuaagcauacuuaggaagcuacaugagaacagaauguauuacugugcucccguccaaacugcaugacuuuauugguuauagaauaaauggaauuugagauggggauuugccaguuuuuacagucugucuucaauaguuuuguuggcugccucugcaccuuucuaaauguuaugugaaaauaaaauuauuuaaguucuaaaguaguuuaggaaagagaugugaugacaggaaaaagaaguuaacuucugaacaguuugguccaggaagaagaugggcagaauacaguaagcccaggguugaagaauacauucaauuuggagagauggagaagaccuuugaagaaggucaaaaugagaucuuggaacagaacucucaccugugugucuggauauacaugaaaacuggacgguguuauugagcuacugcuuauauggugagcagaaaauugauaaccacaagccugguagguucugcuaugaagcccacauauaaucacaaggccuagauagcuuggaguuaaaagccaaggauagcuguauaguuuggguuccauaguuugcagugagauugugcuucugagcagucauuugggggcagugguucugagauuacaagccauaacccagccaagaacgggcuaccuguggaaugaggaugaggaaguugcuacauauaaacccuaguguguguguguguauuaagugaaacuuaguuaacuuuuuugcucacagccaaagaugauucaucuagagaagccauuggaauuuuagcagaguuuuguauauauguggauuuuucuaauaaguagcaaaucagaggccuuaaccacugcccaacagcgauucuccauugagaguacguaucuugaacuuaagaaauucauuugcucugauuuuaaaucuuguaaaguuuuucuucaugagaggucuugccucuaaacuauauuguggcaguauuugaucaaacuacauaaguaccauguaaauaagauuuuaauacaaaugaugacucacuucuaaaugguuugccauuuagaaaugugcugcugugagaaaaacgaauuuuuuuuuuuuuuuuuuggagacagagucuugcucuguugcccaggcuggggugcaguggggcgaucucggcucacugcagccucgccuccuggguucaagugauucuccugccuuagccuccugaguagcugggauuacaggcacacaccaccacgcccaacuacuuuuuguauuuuuaguggagacaggguuucaccauguuugccaggcuggucuugaacuccugaccucagaugauuugccugccucggccucccaaagugcuggaauuacaggcgugagccaucaugccuggcugaaaagugaaaauuuaagccagcuuaccaccuggaauaaaaauguuuuauaggaaugucuagguugcucuuuuauauugaaaaaaaacuuauuagugucuguuuuacccaagaaccacaagcuacuucauuucaacuuuuaaaucaugaauaauaacguguuaucaccacauuuaaaaauguacaucgucaaucacaaacacauauucuaaggaauugaauuuuauagagauaauugaaugcuuucaucuguaaaagaauuaguggccugcaaaccacuguggauucuugcuaugcuuugaaguugucagugggggaauuugcugcugcaaguuacuuagacuuguaggcaaagggaaauucaaauuuuuaauucuaaaaugaaaaccacugacaaaauuuuauacucugaaaguuugguuguuagcuuagucauuauuuuccuguucuuuaucauuucggaauucagaugcuuaaauuuaacauacaaauuauuuguugguaaaacauaaaacauaaaaagcuacauuugguaaacuaaauuuuaggauucaaagucucuaacaauuucuaugugacaugucauacggugcaguuuuuauuugccaaagugucuacuucauacugccuaugcacugcuucccguuuuuaaucucucuaccccaaccccccuauaauuaaauaaaccccuagaaaacugccuucuuuuagaauaccuaauug

SEQ ID NO: 18605 - RNA, 1951 nt, Homo sapiens
acuuuugccucacuuauuccuaguccagcucccaacugccugacuuaauggaccagaacggagauuuggauauuaagaugcagagggggaggggaagggaugguagagauagacagcucuccccuacuagguugggucauuuccccuaauaacuauagagagacuguguuucaacucucuuuucauugcuguuuccagaagaguggagagugugguuucaggcaagguauuaaugauacaauuccgugguauacagcuccugugacauuugaaguuucuuuuaaagggguuuuucuuaaucaaaguuuuacauuugguagcauaaguaguucuuuaugcuucacaggacauugucuucagaguaaucucucugcuaaaaugguacaugugggucacagauugguuuaugccacugacuugguuaaguuuccacccccuccaauuugugaaaaacagagcagugaccuagcuguugcaucaucaugacugccauguaaccuguaauugcugcucuccaguaauugucuuuucauuuugaugguaggggccagacugaaugaauaaugcauucuuuuuuauucaauuuauuucauucaguuuauucuuggcaaucaaacaucccauaaacuuugcuuuuauuaucaauuaugaauaugaauugucugguuuacuaauguagucauuuguucaucuuuacuuuuagcagauuagcaccauaacuaacuuaaaacuaaguuuguuaccugcuuuuuauacugucacaaagguuuuugaaaaagcuggggacacuauuuugucuuuuaguuuuaaacuuuuuuaaggcaaagcaagcuccccaaucccuguucuccaauauguguaugaugugacuuccauguagauauaaaaaugauugugcccuaaccaaacuuccucagauugugcacuguuuguuuaaaauaaucacguauuuuagucugaugcuguuguauuuuuucauuuuauuuaaaacacuacuuacuucuuauucucuuaacaaauuuuaaaagguagugaucuuaaaaaaaaaucacuggauaacuaggaaauauuuuuguuguuguuuuguuucuuaaagaguacagaggccauugaagccuuuugcuccucuuaccgugaaaaugaaauguuagccauuguauggcuaggaaccaaugcacuuggcaguuaauggaucugcuguugcuggagugugagcguggacuugaugcagugaugacaaaucauugcuuagaauuaauguuuucaaaugugcaacucuaguuuuuaaaacaaaauuugguucuuuacauucauuauuucguuuuuguuucccuuuaguauuuaauggucuuuggagaaaaaauaauaaaacagaguguuauauauauauuuuuuggugcaagauaagauuuucuguuuuuugaaauaagucuguagcauaaagguuaaacuauuuuaagacaaaauaaaauagaguguauuuaaacaaugauaucuucugagguuuuuuuuuuuuuuucuuugucccuaucugcuucaguuaauuaggugguaccuggagcaauuuccaaguuaccuuuuaaaugugaaaguggauucuauuuuguuaacaagucuuaucuuuauaagaugucugaguuuucaaagcaagagcuguauccuugcaagguuacuugcaaaacuacucccaagaaguuuugcaaguaaccuuggauaauuguuggauguugauaaaaauagcuuugcauuagcuuuccuguaaccccaccugagauuucaaagagggccaaagacuuauuguucugggcaccuuuacuccuggcaacaaaacuucacugcugguuauuacuuugcagagaucagagagucaagguaagaugcugcaacggcaugcacuuugcaugugguuaaacauugaagcagguauaggguguuugaaaaauagacugaa

SEQ ID NO: 18606 - RNA, 1811 nt, Homo sapiens
auuauuauuauuuuucuucucaaaacacugcuuugcuuugggggagcgcggguccuuggccagaucuugagucuugagauaugucuucagcaucuccugcuccuccuugggaaacgcuccacccgccagugggccugcgcccuccuccccuucuucgggguucggguccaccucguuucccccacccuccccagggcugacugcaaaucggagggcgacugcagaggcggaauucggggcagagcggggucuccccagcgggccacgucccaccagcagguggcggucgaucugcaaggccugcaaggugcccggacagaaacuugagcagauauuggugccgcugcccgagaagagcucagccgagucuccccgagcccagcuaucggcauccgcgaaaaagcggggagagaagggcacgggcucuccgcuggagcgacucugggauucagacaccgcaagcugcuuucggaagggcuucaggagggggugaguacugagcagcgcacagaaaagggagcgcuguccuuugcugaaggcauuguccuuggcuugcauugaguggcuuucccaccccccgggaaagacauuucgggaaggugacggucucaacagaaggagggagcgcgggaaagaagcccggggagccggcgccuucacgccccgcggucugcagcgggaggagcgcggguuccaucgcgccagauggcgcugucuggcuuuucucgggccucgggcgccagucuccagaggucuccggcgcagcugccucucuagccggccgacgcgggcucuguguuuccgggcggaagugaggcgcccagcggaacggccucuggugacauuuucuugggggcggcgcggacgacugaagggacuuggugguagaggcugcggaggcggcgagguucacuuuggucccggcaggggcucugaccgcgacccacugcucgcugccggggcuuguuccgaggaggagaaggcggcgguggccgucgcguccugagucaccgcagcggggaagagucccggccggggguucggugcgugccccgacggggcgcgcgcgaagcgagcgagaaggcacggagucgccgcggagcgcaggugaggcgggaaggggcgcagggccgcggccuggcuacuggucgaguuggggggcccggguugcgucccagggaggggucggggcgaaucggagggcugcgggccgcggugagggcucugcggcguccggacgcugggguccuagcgggccuggcuggugggcgccgggaacucgcagccuggauugccggcugacgcuggggcaucgcaccucuccgaccuccuugcucguccgccguuggugacccuagcguccucccggcccggcggaguuggcuccggcacuccaagcccccagacgcuggggccggguugaggcgaguccuuuuccgggggugcugaggggaggcuggaggugccgcaguccccgggcugcggggggaagcgacuucacggcccuggaguugucuucacgcaacuuuccggcuccuaggcccgcgggggaagcaguggcggcaacuccgccagcuccgagaguagggggucuggcgccgacaccugccccugcagcggagagcuccggcgccgcggccgcaguggccuugguggagggagaaaaggcuuucuuauaggcuuggcgccgccugccucucggcgcuuccacuaccuucggucggcaggcgccuccagucaaugcgagagaugugucagucuccaaaauagaccgcuucuggggaguuugucaacuuuauuucaaaaccggc

SEQ ID NO: 18607 - RNA, 6385 nt, Homo sapiens
gcgaucagcuuucaagagcaggaaaaacaaauguccucuuuccccugcucuguaagggacgugcaaccaugcugggcauccauccccaccucuguuaauuuacuggggggcaaaggguccacucugcaaucuuccucccaugauaccuaaaacucuugggcuugugaccucuaggacugcccuggggagcuccugggaagcugagucagggagggcaucagguuuccugcuagcucuuggcacacuucugaaguaggugagcuugugcuucugugcugucccacccagccggucugccaggucucucugcuucccacacccgcugccgccugccccaggggcccggaccaccaacacaccccagagguggggcacccacugucugccuucccucccccaauacucccucacacacagcugacacgcucaucugacuggcuaaagggauugucccuuauuaaauuccuugggggaugaucucauuaagccuuguuaugggucacuucuauuucagggagaauaaauuugcugcaaucuaugggcagcuaguuaauugaaaccugaggaaggggcugggggaggggagggcacgggugaggggguggagcgagccugaaagugugggaagugccuggccuggugagagcugagagcuggcugggaggaggcugaaggugcacaugaggguagccgauaaggaggaggccacaggcaguggagggagaggggagacaaaagcaggugucagcugcagccugaugcagggagauagccuccuaacugccucccaggccucugugcucagcccugccccaacauaugaguccaggccagcacaaagugauaagcaccuaggccaggauguagcaacagagauggaaaagaaggagauaugagagaacuuggaaacaaauuugauacagggaugaaggagaggagaggaaaaaacccaagaugaccuuuaaagaugcuuggagaauggggagaggcgccagccggagcacaagcccaacacaggccucugagcaaugccaaguuuacugcucugcuguuuaaagaauccuucuucacccauuuccgaaaaaauguuuccuaucuccgguuuucuggcucuucagccauucaucuauucaugcaagcauucauucgguucgucagaauggagaccuuacguagcacucuaucagccccucugcugaauaccggcaaugcaaauauagacaaauagauuuuauaggcuaagcgucgugaguccacccagagcaguuagccacucccaggagcucuuuuccuuccauucccucuuuuccaacaguuguguugauuuucaggauagcugcugcagagaagagaauucaaagauggaggaagguuuuguguuggggaucuaaagccaaaggaacuugugacuuuuggucaugcugagagacaggugaccacuaauuguguagcccuuggcuggucucugucuuuuugagacugaguuucgcucuuguugcccaggcuggagugcaguggcacgaucucggcuuacugcaaccucugccucccaguuucaagcaauucuccugccucagccucccaaguagcugggacuaccggcauccaucaccauguuggccaggcuggucucgaguuccugaccucaggugauccaccuugccuggucucuuaaugcucuuagccugaauuuuaucaucuguaaaaggagaaauaggcuuagaugauuuuagaaaacucuucuacuuuguaucuauguucuuguuuuauggaugugaaaguacucugaaaaguuugauuucuacgcagaugugagguaguucuuuauuucagaaagcaauaacaaugcgagugcccacaggguggauauggguugugaaauggaaacuccauccccuacuucuugcuucccuguggaggggucucuauuggagccacauuccuggagucucucuggccugacucucccggcaagaagaaugguucccauccgguaauauuuucuccacccaauauuuuaccugaaaugucaccaggaaauauuaauccccauggaucucaugucagcugcccuccuuuauauuucaagaccauggugggagguagagcaugaaaccagaucaccuucuggugugaagauuucaagggagaaguugaggugggaagccucaccagguauucucuuuaggacuugccugagaguagauucugggcugcucagacagggcagcgcuccugugacugguugaauagucugucuacauuugcugugacaggaaugggauaggaaguucauggaggcugcucauuugcaccgugucccccaauccagcuuugaucugccauaaaguugacauuuaaguguucgccuguuuccugcaucuuauuuuuuaguugcuuccaaacuugaggagagaaagagaaaggguuauuuauuacacaggccccaacccuagcaagagaaaaaaaaaaaaucacaguccacguuauaagucuuccuugggauuuuguucuuuuuuucuuuuuucgagacagggucucacuccgucauccacacuggagugcagcuauaugaucugggcucacugcagccuccaccucccagauucaagcgauucucccacuucagccucccgaguaucugggauuacaggugcccgccaccaugcccagcuaauuuuuaguauuuuuaguacggaugggguuuugcaauguuggccagguuggucucgaacuccugaccucaagugauccaccugccuuggccucccaaagugcugggauuacaggagugugccaccacacccggcuaauuuuuguauuuuuaguggagacaggguuucaccauguuggccaggcuugucucaaaggagauuuuuuucuuuuuucuaaauuccucccuuacccuugccuucuccacauccaaaugaguaucagccucugggcacucauucccaaaaugaccuaguccuuucauuccacugugacaucuuuccagaaugcuuuuccucuucucuaugaggcaaaauucuugucauucuuagagucauggcucagaguucucccccucagugagucaauccuucucaaggagcucaggcugaguuugcagcuuccuugucucaguuucuaggacucuauucuauuaugcuaucacuaguccuaaugggaggcgaccucaugcccgucuuacccaauagagcagacuagguugagugcuguaccuggaaguuccucuggccacaucuaugucuucuuagaacuauugugucugggguuuccuggguggggaaggcaaaugaaaccucagcaaugacugguaugaauucuccugccaggugggggccuuaaaguagaaaucaaauugauuucuaggaaaugaagaaagugauguuucuugcauacuugaguuggagggcuagaguauuauucacugcaaauaaauucugaccuuguuuuuucaugaaauguugcucuccuucucacucuuccacccuagaaauuuugucaaggcuugaaucaguccagaauuuacucuauuguucccuuaccuguugcuuggaaugugaccguuuggggaguguguuuuguuuuguuuuguucugagacagagucuugcucuguugcccaggcugcagugcaguugugcgaucuuggcucacugcaacucugcuuccuggguucaagcgauuuccugcuaauuuuguuuuuuuuuauuuuuaguagaaaaagcauuucaccauauuggcuaggcuggucuuggacuccugaccucaaguaaacuggcuggccuuggccucccaaagugcuaggauuacaggcaugagccaccacaccuggccuggggaguguuuuaccauuccugagacuagauggugacagguucuuacaacagccugagcaaagccugacacagagggggaaccccuucaguggauggguccuuccugccacagacuaaauguaaauaaaguccuucugcugugucuucagugaggauggagaacagagggcugcucaaggucaaguuguauacuuggaggcuggagaagaagccccacacagagaaagcccaggugagcugagcaggacaggaaggauccuccgagaccugcagaucaugccaccaaccagcaccaggccuacauccaaggagcgcaggguauccaggaagaacaucaggccguacucucucucaggcuagaccagucacuucuauuccaaagaagacuucucagggcuggaagcauccccuccccucuguagucccucucuugugcuugcugcccuccuugaccuugguucccuugguuuccagugagccaaguggagguguacucucccaccucgucaugugcagccugccugggaacacagugucuccaaggcugacugaggagaacagaacuugaggagaaaaacagcagcacagagaaggaaaaacagaguggggccuggggagaaaggagagcucucagcugggguuucccacagaagcagagucucagacaagagcuugcacacaggucauuaauuuugggaauuaccccagaacaggagugaggaacuggagagagugacccaaggaaggagggagagccauuccaaugugugcugccuuaucaagcucaucuccagggaggccgccugggcgugguccaccuguuugccccuaaagagaaccaaagaacgagcuucaaaauuguucgucugagggaaauaauagaggauguuuauccaccaguucuggcccccucgggucaagguugccccauaggauguuaacuccuucugucuucuagguuuguccacaugcaauccagagugucccaggagggaaaccccggggcaggugauaccuacaggcaacugcaacaaugacuggaggguaaauguggaccaaggugugagcuggggcaccauacaaaagagaagggugaggaagaagcugcagcacaaaauggagauuagagggaaaaacgagguuaguggagccaucaucaucugcuugcccgaugcacacagcaagucaauaugccgagacaccggguugaagcagagaaagagguuuaacuguagugucacugaaugaggagaugggagaaaaccucaucuccaucucuccaaggaauuugggguuaggguucuuaaggguuuuggagugggcagaagugcggagaucauugauugguggaagacugcaggcugaaguccugggacagggagaggaauaagcuguauucucacggggaucccguuccucuguggggaucuucagacugggugcuggaauuggggggucugaaaaaaccuuuuaggucgggugcaguggcucacgccuguaaucccagcacuuugggaggccgaggcgggcggaucacuugaggucaggaguucgaaaccagcuuggccaucaugaugaaaaccuguuucuacuaaaaauacaaaaaauuagcucggugugguggugcuugccuguaacgccagcuacucaggaggcugaggcaggagaaucgcuugaacccaggaggcggagguugcagugagcugagaucagguggcgccacugcacucuagccaggaaccauggggaugcaaaucaauuauuagucuuaugacccuaaugucagagauccuaccuguaggcaaaaaggcaaugcaaauggucaggaacuagugacuuuuagcaacaagaaagugggcagagugcagccugauuaguguuuaauuacaacuauauuucuguccagaacccagcauacaauucuugucagccuucugggggcagucucaggaggacaacugaggagaagacaaagcaaccauaaacaguccuuguuucagggagagacgugagcagggcagaggcagcccuucagcagccggggccucugccgaacuccuagaacuggcuagggugagaauaagcccugaaauguacagaguucuugcugcuacaagacucuggcaggcccacuggcaggaaugaguggcccuggcaguaacuguacauucccacccccuuguagccuggggcaaucucuuuugggccucccaugaugauaagcugucuccugagcauuccugacucuuccaguucaacaauaccaauuuagaguuucuagcugagaacacaccucucccaaagggcaggcugaaggaacaggauuauaaaagggucaugaccugcuagaauggaaacaaguuuccuacaguucuuguggcaguggccccccaaguuaggguuaagguugcuccccgccaucaauauagcccccaggauuggauggauuugaggagauggauucuaggagcuucugaaauuaaguggaaaucuuuggaaaaguaagaaaaggguuccaggggaaccuuuucaguacccuuu

SEQ ID NO: 18608 - RNA, 14922 nt, Homo sapiens
uuucucuuaaacacaaaguacucuagaaacuuacaaagagcagccgggugcgguggcucacaccuguaaucccagcacugugguagguaggccaaggcagguggaucaccugaggucaggaguucgugaccggccuggccaacauggugaaaccccgucucuacuaaaaauacuaaaaaacuagccaggcgugguggugggcaccuguaaucccagcuacgugggaggcugaggcaagagaauugcuugaacccggagacggagguugcagugggccgacagggugccacugcacuccagccucagugacagagugagaaucagucucaaaaaaaaaaacaaaaaaaaaacuuacaaagagcucagccuugaauuaucuagcccaguugacuguaccaauauucaaguaaaauagaucaagaagcauuugcuuaccaauuucucaauuugaucuugguuuuaaagaauaacacaaaugacagaaaacaacuaugcauuauggaaccuuuauuuuucaugugauuucuguacauaaggaguaugagaguaacccuuuuacaaauggaacuaauuuacuagaacaaugacaaaacugaacugguauuugaugugaauccacaggaguuuaagcuucaaauccagccaagaaauuuguuacaaucucuuucagcuuugcaucugauuguucugagaucuuuccaucagcccuauuuggaaauaaaagcaggucguaaguucugaccuggaaaaaguuuuaaugacuagccuaacuacagauuugaaaauaauuuuaacuucauaucuuaaacauaacuuuaaaaaaagaugccaacaauugcauucauaccugauagugcccaacaaggcuuggugcuggcugacgacaugagacaagaaagcauucucaaacuuuguaaucuugcugggcuccaguuuaucaagauauccccuuacacccgcauagauaacagccacuuguucuucaauagccaugggagcugaaaagauacaagaagaaugccaagugaguugcucaaagaaaugaaugccauguuaccaaggucaggaaaacuuacuuuuucuccaauuccuaacaugucccuguaaauuaucuauucuucacaauaucaaugaccuagaacuccacuuaauaauccuuccucccaccccugacagaaaacaguuauuucuuauauuuucaaggcuugaggcauaaucuuucaguauaguccauaagcacuguuuauaaucugacaguguuaauacuguuuugaguauaaauauuuugcugaaaugacuugacaaaauaaaaacguauuaacuuucuuuuaaaucugccaaauuacauauucauauagccaagugggggaggggacucuaacaggccuuaauuccugaaaggaagacauuaaauauacuuaaguuuuccugguugugaagccccuaucauuuacacucaaaugauaauaagaaauguaguuugggccgggcaugguaacucacaccuguaaucccagcacuuuaggacucugaggcggguggaccacuuaaggucagggguucaagaucagccuggccaaaaugguagagguuuuaccauuucuacuaaaaauauacuccagccugggugacagaaggagacucuguauuaaaaaaaaaaaaaaaaaagaaagaaagaaaaagaaagauaguuugaggccgggcaugguggcucacgccuauaaugccagcacuuugagaggugggaagauggcauaaggccaggaguucaagaccagccugggcaacauagugagacccugucucuacaaaauacaaaaaaauuagccaggcaugguagugcaugcccguagucuuagcuacucaggaagcuaaggcugcaggacugcuugagcccaggaguucaagccugcagugagcuaugauggcaccacugcacuccagccugggugacacugcaagacacugucucucuuuaaaaaacagaauacagggccgggcaugggggcucacaccuguaaucccagcacuuugggaggcugaggcaggguggauuaccugaggucaggaguucgagaccagccuggccaacauggugaaacccugucucuacuaaaaauacaaaaauuagucgggcgugguggcucacaccuguaauccgagcuacuaaggaggcugaggcaggagaaucgcgugaauccaggagguggagguugcaaugagccaagguugcgccauugcacuucagccuaggccguaagaaugaaacuucgucucaaaaaaaaaaaaaaaucaaaaaucaaaaaacaaauguaguuuaaguaaaagugccuuugaugaaagauaacagauaacaacacguaguacaggccgugauaugugaugcagcucuguaggccugggaagacccugauacacaauaggaaccugaccaaaugaagaaaagaacaacuuacaauacuguccuugcuucagcaacucaguuagacgcacgccacgacucaaaaguuguugaguggcagcaucgaggucagaaccgaacugggcaaaagcagcaaccucacgauacugagccaauuccagcuucaugguaccugcuaccugcaauacagaaauuacuguacuguaacucagugacacagagcacuauacaaauauaguuaauauauuaauaccuuaagaugcuaaucuaaugauagcccccuuacugccaaagugaugcaaaauuaccugcuucauagcccugguuugggcagcggauccgacacgagauacagacagaccaacguuaauugcagggcggauaccuuuguagaacaauucuguuuccaagaagaucuauaauguaaggaaauacgcacgcuagcaagcuuaaaguaagaaaucaacuaucuucaaauuuaagucauuaugccaaaaagcugaaacucaaaaccuaacaaugcaaagcaucaguaccccaaaucuuucacgaccugaccuguauauuuuauugcugcaauuaggagaugugcaugagaugagaaaaaaacauaauaggcaacauauuuauacugaaauacauacaaaugaagugauauaauuucuauuugauucaaaauuaucuagaagggagaacaguagugguuaaaaaugaaacuagaacgaaacaugcuacucuaugcaauaacugggugacagauacaugggguuucacuaugccauucuccuaacuuuucuauguauuugaaauuuuccauaauaaaaaguaaaaugcauuuagcaaaucagucaauauaccauuagucucaaccaaugccuuagaauuauccaaaucuuuuuuaacauuucuuuuaaucauuaaaauaauaccuguccgucagugauggaaaugacauuuguuggaauguaagcagacacaucaccagccuguguuucuaugacuggcaaagcagucaaggagccaccaccaaaagcaucguucauuuuggcugcucucuccagcaaccgggaguguagguagaacacaucaccaggauaggccucacgaccagggggucggcggagcaacagagacaucugacgguaagcaacagccuaugguacagaauagguuugugaaguuaaccuauuaaauagaaguugcauaugugaacuuuuacuucaguacaaauaaauggauucuaaaaauuuauuuccuuugaccuguuuggauaagucgucauagaugaucaaagcauguuugccauugucucuaaaauacucucccauggaacagccagaguaaggagccagguacugaaguggggcagcauccgaggccguagccgacaccacaaugguguacuucauggcaucugagaaaauauauuuuacaauuuuaucaauauugugguuuuaaauuggaggcuacuauaaaaauuaccuaagugcuaaaaauauuuaccauuaagaguuaaucaggccaggcgcaguggcucaugccuguaaucccagcacuuugggaggcccuaggcgggugaucaccugaggucaggaguucgagaccagccugaccaauaugaggaaacuccgucucuacuaaaaauacaaaaauuagccggacgugguggcaugcaccuguaaucccagcuacucgggaggcugagacaggagaaucgcuugaacccaggaggcagagguugcagugagcugagaucgugccaucgcacuccagccugggcaacaagagugaaacuccgucucaaacaacaaaaaaagaguuaaucagaaucaaacagcuuccacuuuaaagaaaccaacaaaaccuuuaaauguacuacuguuuuacauugucuuaccuacugauuuguauuaaaaaguucagcccauuaggaaguaauuaaaauaugccuucauuaaguagaagcuauucuacaaucagcagcaaugggacuuaagauaauagcaaugggacuaaauuucuuuuaauaccugcaucuguaagucucuucaccaacugggcaacaguggaucucuuuugaccaauagcaacauaaauacaguacagcuucuucuuuucaucagauccaucauugaaacguuucugguuaaugauugugucaauagcaauugagguuuuccuuuaaaaagagaaaguaaauauaaaucuuccuaaacuuaaaaggacuucccugugggggaaagaaagagagaucagacuguuacugugucuaugcagaaagaagaagacauaagaaacuccauuuuguucuguacuaagaaaaauucuucugccuugagaugcuguuagucuguaaccauagccccaacccugugcucgcagaaacaugugcuguguugacuuaagguuuaacggauuuagggcugugcaggaugugcuuugguaaaaauguguuugcaggcaguauacuucguaaaagucaucgccauucuccagucucgaguacccagggacacaaugcacuguggaaggcugcagggcccucugcccaauaaagccuggguauugugcaagguuucuccccacugagacagccugagauauggccucgugggaagggaaagaccugaccaucccccagcccgauacucguaaagggucugugcugaggaggauuagugaaagaggaaagccucuuugcaguugagauaagaugaaggcaucugucuccugcuugucccggggaauggaaugucuugguguaaaacccaaucguacauucuauuuacugagauaggagaaaaccacccuauggcuggaggugagauaugcuggcagcaauacugcucuuuacugcacugagauguuuguguaaagucaaacauaaaucuggccuacaugcacaucaaggcacagcaccuuuccuuaaacuuauuuaugacacagagaccuuugcucacguuuuccugcugacccucuccccaccauuaacccuacaguccugccacaucccccacaccgagauaguagagauagugaucaauaaauacugagggaacucagagaccaguggcggcauggguccuccauaugcugagcgccguuccccugggcccacuguucuuucucuauacuuuguaucugugucuuauuuauuuucucagucucucaacccaccugacgagaaauacucacagguguggaggggcuggcccccuucaucuggugcccaacauggggcucaaacccacgacccugggauuaagagucccaugcucuaccgacugagcuagcucgucccaccugaugagaaauacccacagguguggaggggcuggcccccuucacuucccagcugaaauuuuacuauuaauccucguauuagauucuaauguccccauuaccauuuaccauuccaagacuaaaauauaauccuuccauugagcaaauuuuaguuagaacuuuuaauaugcuuuugagucuuuacccagucugucggucaccaauaaucaguucacgcugaccacgaccaauuggcaccaagcuauccacagccuuaaugccagucugcauugguucccgcacugaaauucgaggaaugauaccgggggcuuucagaccaacucgccuacgcgucuuggaaccaauuggacccuguuaaaaaauaaaaagaaaaacccuaagcauaaucaguuuugauguuuguuagaagcugcaacuauaucuaacgaacauuaaaccuaccuuuccaucaauagcauuaccaagggcaucaacuacacgacccaacagcuccucaccaacuggaacguccacaauggcuccuguccucuucacuauaucuccuuccuuaauuaguuuaucauuuccaaacacgacaacaccaacauugucagguuccaaguucaaggacauacccugcacaaaagacacaauugaacaucaaugaagcugaaugggcacuccuccccauacaccaauacuacauaagaaaauagucgggggguggggggggaagcaguauuguccuuuucaccugguuuauucuugaguacuuuuccaacuaacaaacaacccucucugauuaagacuuuuaaaauugcuauuuugaauaaucuuaggacagcacauugauaagccuaauaugcucacuaucauauccucaaauaacuauuacagaagcaaagaaauuggacagguuaauaagcuuuuuuccacuguauuuucuuuggcaaugauucuugggcugggugaucaguaugaaauaaagugaugaaggccaaauggaaaucuuaagacaaauuugauuaucaucuuauuuaugugugagaagcuccauaaacaguuucaaaaauuaaucaaaaccuguacucuucgaguuaguagaaagugaaauuaaaagcuaccuaacuguaaccaaucaaauacaaauuuucauaacauaacagcaccaaaucaucucucaucauuaaaacuauauuuuagaucuuuaaaucaugucugaagcaaaaaggcuauuccaggaauagucuggucaauaaugaaaacucuggagaaguacuuggaguaucauggaauaucauuacacauccaaaaacuuuaaccuacaucucugauguucaauacagcauccacuaaccacauguggcuauuuaaauuugucaaauuuaaaagauuaaaaauucaguuccugucacacuagccacauuuuacaugauuaauagugauaguauaguagguaccauauuaaacagcacagauguauucucaucacugcagaauacuacauauuuccaauacuacuggacaguacuguucuagacacuuggauuucaaaagcuaaaaggggaacucagaauuaaucuguuucgaccucaccuuucaaagauaaauacuguacacugaagaugcuaaauuggccaaugucuuacagcuaaugauaacuuugggcucuguaauuauucuuccacaucaaguggcucuuuuuccguaguagacauuaccaagaguaucaagacuaucuuuucccauaucugcaugccuacuagacaguuccacucucucuaguuuauccagaugucauccucugcuuucccuaacuccuacaacuuauuucucauacccugacagaugaggcucaacccaauacaaaguagacuuacauuagagagcuucugauagcuacaccaaaacucgccuuugaacaauaugucuacucacuagaaauacaaagucacggacuuccaauuuccaccagaaaaauuuuguugaaguuaucaaaugcuuugcuuuuguauaaaauaaucuuaacagcaagacagaacagacuuaaacuucuuggauuuggggugaaaguuuauucaauuuuauauuuuggagccaguggcuacaaguuauguauaaaucagucccuagaguaaaaaaacuuggcuaauucaaacccuuaaguuuauucucuuuacaaucuaugauaauaacaagaaaaaaaucugaggcaaauuaagacaaaguuuuuuaaaaaucugauacaaucuuugaaucgcuaaaugaauaacugagaagacuuagauccuaaaacaccaaaaucuuauuuuauaauuuaccuuuaagccugaagaaaacucuaccauuucuucugcuugaacauuccucagcccauguacgcgggcaauaccaucaccaauacuuaagacacgcccaguuucuucaagaucaacagagguaucagcuccaagaauacgcucuucaagaauagaggacaucucagcagucccuauggaagacaauucaauucaauuaaaaaaauaaucugggccaggcacaguggcucacagcuguaaucccagcacuuuuggaggcugaggcaggcagaucaccuaagggcaggaguuugagaccagccugaccaacauggagaacccugucucuacuaaaaauacaaaauuagcugggcaugguggcacaugccuguaaucccagcuacucgggaggcggaggcugaggcagaagaaucgcuugaacccaggaggcggagguugcggugagcugaaaucacaccauugcacucaagccuggguaacaagggcaaaaacuccaucucaaaauaauaauaauaauaauaauaauaauaauaauaauaauaauaauaauaaaaaucugguccucggaucuuuucaaagcccauuucucaacaacaaaaaacuaguuuugugaucauaauaauccaaauauauucuacagacccagcacaguggcucacgcuagccacagugguaaugcuagcacuuuaggaggcugaggcaggcagaucacuugagguaaggaguucgagaccagccuggccaacauugugaaaccccgucuccacuaaaaauaaaaaaaaaauuagcugggcacgggcaugccuguagucccagcuacucaggaggcugagacagaagaacugcuugaaccugggagguggaagucacaguaagccaagauugugucacugcacuccagcauaggugacaaagugagacuaucacacacacaaaaauuauauauauauauauauauucuacacuguaacacgagauucuauuuuuaaaagcuaugaaaauaaaaccaagugauuaaggaaaaaaaaguccacacaaaacaaauguaaaccagacaagaagcuaaucaaauuaaguaaaacccuuaaaauaaauguucuccuuuaauuucuaagaaaucuguaacuauguuaaaaccugaauuuuuggcuaaauucaauaaaaacauauuuuaaaaaccaacuguuggccaggcacgguagaucaugccuguaaaaccagcacuuugggaugccaaaggggguggaucacuugaggccaggaguucgagaccagccugggcaacauggugaaacccccaucucuacuaaaaacacaaaaguuugccgggcaugguggugcaugccuguaaucccagcuacuuggguggcugaggcacgagaaucacuugaaccugggagaaggagguugcagugagcugagauagccccacugcacuccagccuggagacagagcaagacucuaucucaaaaaaauaaaaaauaaaaaauaaaaaucaacuguuaacaaagugugucuuucucuuucaaggcacacaggguaguauaggugguauucuucaucuuagcauacagggguugggugcaguggcucacgccaguaauaccagcacuuugggaggcgggcggaccacuugaggccaagaguuuggaccagccuggccaacacagcaaaaucccaucucuacuaaggaaaaaaaaaaaaaaaauuagccagcugugguggugcaugcuuguaauaccagcuacucgggaggcugaggcaggagagaaucacucaaacccaggagguggaggguccagugagccaagacuacgcuacugcaccccagcuugggcaacagagcgaaacucugucucaaaaaacaaaacaaaacaaaauaaaaaaacaucccagcacuuugggaggccaagguagacggauccccuggggucagggcuuugagaucagccaggccaacauggcgaaacucuaucucuacuaaaaauacaaaaauuagccaggugugguggugcgugccuguaauccuagccacuagggaagcugacucaggagaaucacuugaaccugggagguggagguugcagugagcugagauggcgcaacugcacuccagcuugggcaacagagucucaaaaaaaaggaggccacgcacagugccucaugucuguaaucccaccacuuugggaggccaaggcagguggaucaccugaggucaggaguucgagaccagccuggcuaacauggugaaaccuugucucuacaaaaaauacaaaaauuagcugggugugguggugggcaccuguaaucccaccuacucgggaggcugaggcaggagaaucacuugaacccgugaggcagaggcugcagugagcccagaucaugccacugcacuccagccugggcaacaagagcaaaacuccaucucaaaaaaaaaagaaaaaagaaaaacauauaugcugaacguggggguguguguacacauacacacacacacacacacacacauauacacacacacucucacacacauauauauuuaaccuuuauuuuaaaaguccaaauacucaucuccaaagaaauuccccaacuuauagugucuuccuaugcuugccuccccacuucucuacugcaucuguaaugugcaaguucacagauugccaaauaucuaguagcuacugccuuugaaaaaauaaaaccuaucaguggaccggugcaguggcucacgccuuuaaucccagcacuuugggaggccgaggcaggcauaucacaaggucaggagaucgagaccauccuggccaacauggugaaaccuugucucuacuaaaauacaaaaaauuagccgggcaugguggugcaugccuguaaucccagcuagucaggagacugaggcaguagaauugcuugaacucaggagacagagguugcagugagccgagaucuugccacugcacuccagccuggcgacagagcaagauucugucucaaaaaaaaagaaaacgaauaagaaaaccuaucaauaagaacuuacauuuuuucuaaugccuuuuagaaaaggaaaaaggaagucuuccagaggucacaaagauuccauuaccuaguguauguucuuucuguuucuacccaagggccauuaccagaacaaagaagccauacuaauaucaaaagaaaaauauguaacaguaguucauuugacuauaacaagagaaccaugacagggcuaaaugguaacaauaugguuuaagaaccugagagucuauacaaacuagagaaaaaacuaacaaaugaaaaacaacucaccacaguuauacgauguauguaauuuauaucuucaucuaguaagugcggcguagacugagaaauaauaacuuaccagucuuuugaagaugaguguuagaggcauggaaguuccuugcagcaaugaaagaugaacccaaagcauuucuggagaccuagugcaaaaguauucuuaaaaauuugauuuuuaacaaagccuuuauaaaacuuacaagcuuaaacaaaugccagcuuagugugaucaaaguacuggugaaaaugcuaauuacauauaaagcauuuuguuuaaaaugucaaaugggaaaguagcuuuugauauaugugaaaaccuuuuauacagcuccuaguacacaguaaacacucgcauauuuuuaaaaugcagucuguacuuuauuauuauuguuuuuuugagacggcucacugcauccuccaccuccuagucucaagcgauucucagccucccgaguagcugggacuacaggggugcgccaccuccaccagguuaauuuuuuauauuuuuaguagagacgggguuucaccaugcuggccaggcuggucucgaacuccugaccucaagugauccacccgccuuggccucccaaagugcuagaacuauaggcgugagcaccgcacccggcuuauuuuuuuuucuuuuuugggacagggucucacucuugucacccaggucggagugcaguggcucaaucacggcucacuacagccucgacuuccugggcucaggugauccucccaccucagccuccccaguaggugggaucacaggagugcgccaccuggccaggcuaauuuuuguacuuauuuuuuuuauagagacaggauuucaucauauugcccagacugggcaguaaauaaauauauauuuacugggcaguaaauauauauauacacacacauuuuuuuuuuccuucugagacggagucucauucugucacccaagcuggagugcaggggcacgaucuuggcucauugcaaccuucaccucccagguucaagcgauucucaugccucggccuccugaguagcugggacuacaggcgaccaccaccaugcccggcuaauuuuuuuauuuuuaguagagacaggguuucgccauguuggccagguugaucucgaacuccugacuucaggugaugcacccaccuuggccucccaaagugcuggaauuacagacgucagccacugcacccggccuggcagucaguauuuuaaaaagcaacuauuggcagggcacgguggcucaugccuguaaucccagcacuuugggaggccaaggcgggcggauuaccuaaggucgggaguuggagaccagccugaccaacauggagaaaccccgucucuacuagaaauacaaaauuagcugggcgugguggcacaugccuguaaucccagcuacucgggaagcugaggcaggagaaucgcuugaaccugggaggcagagguuguggugagccaagaucgcgccacugcacuccagccugggcgacaaaagcaaaacuccgucucaaaaaaaaaaaaaaaaagcaacuguuaacaaaauguaagugucuuucccuuuaaagguacccaauuuuuauuauuuugacuuuagauguauuuuaauggaguugcaggaauucuaagauaaacagcuuccuacaaggggcaaaacucaaaguaguuccaauuuuacuuaaaaacaacaacaacaacaacgacaacaagcggccgggcacgacggcucaugcuuguaaucccagcacuucagaaggccgaggcgagcggaucaccugacgucaggaguucaagaccagccuagccaacauggugaaaccccgucucuacgaaaaacuacaaaaaguagcagggcaugacggcgggugccuguaaucccagcuacucgggaggcugaggugggagaaucacuugauccugggaggcggugguugcagugggcggagaucacgccauugcaauccagccugggcgacugagcgagacaccaucucaaaaaaaaaaaaaaaaaaaaaaaacaagcaaacaaaaacugaauaaaugcuagaguuagauuagaaaccaagaguuguggcauguggacuuauuuuacucucucaacaaauccugcagccaccuggaacuuccuucaguuucuccuucaaguuguaauacugcgacuggucacugucaauucugaagccucuaccuuccauaggagcuagaugaaaaccguuaaaaaugcuuuuuuguuaacagaaacccaagaugcuaccagcgguuguuaaggcagcaaaacagccaacauguuuauuucaccuuucaaauugagauuacuuuuagaacaaaaaaaaagugucagugucaaugcguuuacacugaaaucauguuaauuucaagggaaacaaauaacgaaggguauuaauccuuacagccauuuuccaaccuuguucucuuuuacuugaauucuccaucacuaaaaauuacucaaaaccagguggaaaacucaaggacaaauucuuuaaacacguccaagugccacaaagcacacacucugccggagagacaauuuagaaaccagcuucacuguugucacagugcuggccacaugaaaugguucuuugcaccugcaggacguuuucacggucguuucguauucagcacuaagagaaagccuacguaaguauuccaaaaaccaccuucauuuauuccuuuccucuaaacugagcuccaggcagaggugaaaugcugggccugcugaccuucacacaaugucagacuccacugacuagcuucaacaagagcugacagcaguuuucugaccuucagcgggacgcgacccuaagaaucgaaagagaggaaccucaccgauucagaacaggccucggagagcuagcgcccaagcccugaccuucacccaagaucccccuucuagggccgcugucagccgaagacaggaaucuugaggcccugucucuggacaccaucgaguuaacugucugcccuguaccauucugccucugcgcaggugacgagcaaaagggcaccugugucgccugcucuguccagccggagaagccacgggugcaagauggcggcauucgccacagccccucgcccuccugcagagagcgcccgagccggcgcaccaccacccugcagccccacccggccgccugcaucaugccggccuucggugcucaccaguccggcccgccgaggaagggcgcggaccacggccgcagcaacgcgcacggacagcaucuuugcaguuacuccgcaggcgguacuucugcagccgcagccuccggacugacugggacaaaauggccgagccgcaaagaaggucaagacagccggcccaccugacccggaaguacugccccucgcguucaccaccucuccccccgcccccgccgccacucugcauuuuuuggcagguuacuuauuuuuuuauguaacauuuuuaaguuuaaaccucaaaaugaaugauuagauauauuccggcuuugguccuggcauucguuauacauuuauuuuggucuuuugagucgaccuugugguugccccgggugaccacguggguagcugaaucugcuaagcagcaguuc

SEQ ID NO: 18609 - RNA, 15287 nt, Homo sapiens
gccugacagugaaaaugguguaaucugcguuaacaguucacagcuugaaggcaugacaauuaaagaacacacauggacuuguggcacauggaaaugugcgcacagaaaaaggaaaucuauaauucuuuuaaaguaggaaggcauucuuccuugccaaaauggguacauucuguucgguuaucaaguuugaaaaucuacaagaauuaaagagacugugucacuggggucccaucauagcccuugguguuauagcaauauguucuaccauggccaugauugacucuguguugugguauuggcccuuacauacaacuggaggaagugugaauuucaucauguugauaaauuggacugucaugauucuuuauaauuacuucaaugccauguuugucgguccgggcuuugucccucugggguggaaaccgguaagaaagauucuguaagacaaugaacuuuaaugauaaucguauauuugguuuuugccuuaucuacuaaccaauaauaccaaacacagccuacuguuuguccucacagagacuaaguauauuacucuaaucacugaucauuuaggcucggagacuuuauuucauaucuguuugaacacauugauccaaaauagcauuuuccaaagcaauuuuauugaauauuugcucugcauuaaaaaaaagauggaggugggguggaggugggauagguucauggucaaaaguuuaggaaacaucacaugucauacacagugagguuuggcuguaguaccuuuuuucauguaauacauuaacaucccuuagaacugagaaaaacgcuuuagaaacugcugguuuaaaucauaaaguuuuaaaaucauugcacugaaaauauaacauugggaaguauaguccaaauccauuuauagcuuaaaaacuacugggaaauuuaugcuuaugaauguccauguuuccugcuaagggaccacaccugauggcuugucagaaaggcagaaucuugggcuccacuucagacauacugaagcagaaucuuuauuuuaauaaagugcccaggugaugcuuagguauauuaaaguucgggaagcacugguguauaucaugugcuauguacuauucaaaaugcguacagaggaggguaagauguaauuugaacucugaaagagcuuauaaccuaagcaagaaacaaacgcacuugugcaaaucacuaaacuauaaaguagaacgugaugggugcuguuaaaguuagaagaauugagcauuguuaguuggggaccugagggaggagugggaauuuccaaaggagauggggaagagggcauuucagguugaaagaauggugggaccacguauucagaaacaguagacagcccugugugacuggggaaaagaucauguagggcagagacagcugaaacaaaggcagauugugacagucuuaaauacaugagaaauuguagaccauagaaaguuguagggguuuucaggcagagucugacacagucagagguguauuauaggaauauuauuuugacaauacacgguuugugcugaagaaaaacuacaguaaaggaaacuaguuaggaagugauuaaaauggcccaagaaagggguggugacggguaaugucaaggagggagcagauuucaguaggacuaucaacucacgauuaacuccucacucuaaaauaccugcuaaguugucagcuaccuuuuucugaacuccugaauccacuaagauuugggguaaguagaaccaacuagugacacugaauuuagguggagcacaaggaagaaaaauuuaaaaggacuucuggguaauugggaaagugaugcugcucuuaccagaaaacuuauuuaaaaauauuuuagcucaaauaagaggacuggaaaugcaaguuaagauucucuccuuccccuaucgcccauaaaagaaaaucauaccguaggaaucauacuuauauucaaguauccgaugaugcauuuuuguuucuguuuugcugccaaggaaauuucucaggauaccauguaucuccaguauuguaaagucugccaagcauacaaggcaccacguucacaucacugcagaaaguguaacagguaccugucuuucuugcuguucagcgaggacugaucaacuaauuacugauguuuucauuguugcuuauacuacauuagugcuacuucuauucacugcaagguuaccauauuauaaacaauauugucagaauacuuguguccauaaucgccauuuuauacuuaaauuaucuagauaauaaauagauuuaauucuuccuuguuacaagugaaaagauuuuccagaaaaauacagauuuacuuugccucuuguccuacaagaacaagggaaaaagguauaaaccuuaaguuuguuuccauauaucaagauuaauuguguuagucagcugccaucuggacuaacuuuagaauuguucugagucuaaauuauaagggagaucugcuuuucccauuacuuauugacaaacauuuacacuuuauacacaucuaauaauccaggugccuauuaucacaaauguuuuaauaucaaaaacuuagaagaaaacugacuauuaaaaauaugaaauaaccugugaccuuuuuuaaugaacagcuauaaucacugauuaguaagaaauuuagagaaccguugaaagcaaauaaaguuuuguuucaggccaaaacauugucuucuaucaacaguacacggcaagacuuuguuuauuauaccauaucuuauauucuggaguuagcuugcuuagcucagagauccauuaacuaaaggauacuaugagaacaggaaggaaguuacaugugucuauuugagcccauuaaccccacuggaggucuauaagggauuuguugagucucuauuguaggucacuugggucacugcacuuacaaacuagaagaaaaccaggaaccaugcucauuucuuuauaaugagcauuauaaagagacccucuuucagugggucuccugacuucuuuaaacaaauacuuguagcugacaucuuuuccucagaagcuguuagaaagccugcccuuuccugugcuguuuagaauuuaaaaggagucacuuaauuguuuaaaagcucauaaagauuuuucuuucuguuccaugaaguauaauucucucguagcucauggacaugcuggauuccuauuugcuugaucuuuugaagaccaaaguuauuuaaaguagacaggauuuucugccucauguuuuauguaaauuuuucuuguuagaugugugaugaagauggaccaucacuguccuuggaucaacaacuguugugguuaccaaaaucaugcuucguucacacuguuucuccuuuuagcaccacuggguuguauccaugcugcuuucauuuuugugaugacuauguacacacagcuuuaucaucggguaagugaaaaugaaaauguuuuguuauaaaaucauccaugcaagauuaaaugguaguuaucaacauuuaagagguuccuuuuggaaauaugcuuucugugauuuaguuggggaaauagaacuuuguuuuacugguauauggguuccuuuuuagaaagcauuaaaacuuaaauuuuaagaugaggaaagaguauuuguucugaaaacuuacaugcuguaguugaaggugauaaauauuuuaguacuguauauguaauuuguuagacuucaaacuuaauaguuauggaaagaauagaagaaaaaaagacaacacuagugcuuccuacuuucaucccauucauguggcaaguuguaguucuuuguucauuucugauucuagugcccuggaagguggcucauggagcagaugcauaccauaaaauauaaacagauuaaaccagcaagagaucaaguugauuuaugggcaaguagucaugagauaaaguucaagggacacaaaccucccuaaacaggccuugaaaguaaacgagagacacaccugaugggacugccaaacuggagagucuguccuuuggggaggggacagcccauauuugaucugcuagcuugugguguuuggaaauucuagcccagaaaaaucugaaaaucuggauuuuuaugugaaaucucuugauuuuuaaauguuggcaccuaauucugaauguugaaacauuaugcaggccaggcagcacacaucuguggccauauuuggccugcauuuuaucaguucuucaucaccauuuguaaaacaugagggaagaaacaacugaauccuaggcagcacuugucacuguggaagaauacugcgauguagaauagcaagagaagagaaaagacauaguucugguuuagauuagugucuaguguuguuuauguauguuaauguugguaaggucuccuugacacuuucugaggaaacaacaacaacaaaaaguaacauuugagaaaacuaagaaugauauccugcacaucgguccgagcucauuacuauauuaauuaaaaauagcuggcccagcucaguggcucacgccuguaauccuagcacuuugggaggcugaggcggugugggucacaaggucaggaguucaagaccagccuggccaaucuggugacaccugucucuacuaaaaauauaaaaaauaagccgggugugauggcacaugccuguagucccagcuacucgggaggcugaggcaggagaauugcuugaaccugggagguggagguugcagugagucgagaucgugccacugcacuccagccugggcgacagagugagacuccgucucaaauaaauaaauaauaaauaaauaaaauaaaauaaaaauagcuguguuugcguuggccacagggccacguuguuaucucuuugaucaaguuguuuuacgugucacaguagagucugaccaguuaccauaaccaaacauuuugugcgugugcuauuguugcugcgauagcucuccuuuggguggaacacagugaagaucgacaugagugcagcccggagagauccucuuccaauuguuccauuuggauuagcugcauuugcuaccaccuuguuugccuugggauuagcuuuaggaacaaccauagcuguugggauguuguuuuuuauccagguaagcaucucaauuaccucaagucaaaagugucaaguuguugggacugauugcacaagaaagagacaaagccuguauuuaaguguccaguaugaaauggaaauuauuuuugcuuauuucauuuagguaacuaaucuccuuuguauucgucagauaauuuugauuuaauuuugccagaauuucuagguauugauuuaguuuuuaaaaugcuaacuucaaguuagguaaguucuggagcacuucagaauugagagagcucuucucaccuguacagucucucuugcucuucacauccaccccaauagaggagucuuacuguuuucccuucccaacacgugauuaauucauugauucucaaaaagguuaagugacuuacccaaugucacccauucauguacuugguaaacauuuucccuucccgacagaugauuaauucauugauucucaaaaagguuaagugacuuacccaaugucacccauucauguacuugguaaacacuaauguuauuuuauaauaguauauauuuaauaauaguaaucauaauauagcuaacauuuauugagcacuuauuauguguaaggcacuguuuuaggcacuuuacauguauuagcucauuuaaucuccauaacagcccuaugauaaagaugcuauuuaaagccuacucugaugaaucacuuugcuaauuucuaaggcugcauaaaugauaaugaagagguagcugcccuuaggaacugacaguuaauauuaaacaguuaacuaauacagggccauauguacaucauagauuuaugugcacagugcuaugagaacacagaggaggaggaccuggcucugaagggaccaaaaaccauucuuuuucauucuuuuuuuuuuuuuuuuuuuuuuuuuuuuuuuuuuuuuuuuuagacggagucucacucugucacccaggcuagagaacaauggcgugaacucagcucacugcaaccuccgccuuccggguuuaagcaguucucugccucagccugccaaguagcugggauuacagguaccugccaccacacccgguuaauuuuuguguuuuuaguggagacgggguuucaccaucuuggccaggcuggucuugaacuccugaccuugugauccacccaccucagccucccaaagugcugggauuacaggugugagccacugugcccggcccaaaaaccauucuuaugacuuauugcauucacguaauucauucauucauucauugaaggccuacugugggccagguauuaugcuaggcccuuggaauaugaugaggacuccugggccaaggcuguuuauuuuuuuauuguuguuuguuuguuuguuuguuugugacagagccuggcucuguuggcccaggcuggagugcaauggcacgaucucggcuuauugcagccuccaccaaggcuguuucuaacauacuacacugucucucugaaggcacagccagacuuuaagggaacucuugguuuuaaaauaaucugguuuuguuuauacuuuauuaucgucuacuagccugggaccaaauucuuugaaaaauuuuccccaaugccucuaauuuagaaucauauuagaaauaaacuaagauccuauaauauaaaagccuauauauguggaaucagucauaucuaggaaaaucaaauaauagaauaaagacugaauacauucauuauuuuuaaggcaagugaaauauugagguugacugaaaugagucacuguuacuucucauaaauagauuaaucguaaauuuaaaguuaguuaaaaauagugauaaaagauuuuaauagcaaauuauaaguaagcacugauuaaauggauuauaucaauguuuuauuaaaccuugcucugaaaauaguacuuaugacauaaaguuugauuaacauacuagauucagauuugauuauggauggguguaaucauuguuacggagagguaccguggugcaguaguuaagaacaaggacuuuggagucagacggaugacaugguaauugugguacuuaaccucuguuauccuugguaucuuugucuauggaauggaguaauaaaagcuaucucagagaauuaugaauaugauaaucuuaaaggaaccaaggucgcauuauuaaauuuuacuaucauuuaauuuccagaugaaaauaauucucagaaacaaaacuucuauugagucauggauugaagagaagguaaauuuuaauaauuguuucuucaauauuaaaaaaguauauuaauaaaggacugguaaaguccugaauauuaauaaagucuguuauuagaccggauuaacgaaaagugccuaaaagugaaaacauggcugccaaauggcuaccguaagucauuugcaugccacauaaaaggugaauauaggaaacauuuuuguucauucuguaacucccacagaaaggugcuucucauacacccugaguggucgcagaggccuaagccacacgucaaaccaucuguuuguugucucuuagacuagaggagaaagcagcccauuuggaaaggagcuuccacccuaccaaacugccaucagguuuuucucaguguuuuagacauucaaugaagcuccuaacauuuugcuugucacagaccucacaauguccaauacuucauacuguccauugugauucuagcaugaaacacaaaucugacuacccugcucuguguuuaaaacuucucagagccucaccauuccuguggcagggguugaaacccaaauaccugcagggucugggcagauaacguccaugaaggggagcaagccuguauaccaaagaauugccuggcagaccaagcugauuguugccacaggggaauauucacaauuuccaaauuacaaaauagggagaagaauagcaucguuuuauaucuuuacaaaucucuuuaguaucuuugacuuaagagaagaugguuggauucucacuucugcauucagucuguugagauauguugcuucgauugaaguaugugaagaucuagccucacacagauaaguagguagaaaaggauagaauauuuuaauaggccuuuuacaugauaauaguggauguucuuccguauuacauugaaaacuugacaagugauauuucuuaucaauaagauuuuuauaccuuuuuauuuuaaaacucaucagucuaucuugcucuuugaauuaaucuuuuaccaguaugugguuuuauguaacaucaggcaucggucauuuggcaaauacuaguuuacuguguuauguagauuuugcaaacguuaaacaccuuucauuauacaauaucccaaaauugcauucacguauaucaauauaucauuuuuaugagaaaaaauccuuaaguauuggaaagcugucaggcucacagugguagauacaagguuuuuuuuuuuguaauucuaguauacauuugaaagccuuaauuuuuuacuauuaacccauacugucagucauuucccuugaagugacugccugacuguucguuuuugagaaaauguucaccaaguccugaagucugaauaaccuuaguuugcuauauuacucauucuuucaaauaagaauaguguuacauuaaaaaagcuggcucuacagcuuuuguuagcuuacagcuuaacaacuauuuuccuugagaugaucauucuacuugggcacgcuuuauguauacuucucauuuugucacacagacuguuaaaaauaaaggacaucuccuugagaguugagauuuaauauuuaaaaacaauuuuuacugcuucaucaaggacauucuuacauggaauugcucauaaugacuaccaacacaguuuggugccacugccuugguuuuugcuaagaugccaacaguuuuauucaccauugcaaaugucaaugcaacaaaaagacaaauaacauuucaguauuauuaugaaaauagcuuggccuugcugaccagcaagaaaaaguccugaauacucaaagugaucuauaaagcaugcuuugagaaccacugauguacagguugaagucugagcuucuuagcuucuacauaaguaagaccuuuuaugacuucuuuuuuuguuuucuggcgacggagucucgcucuguugcccaggcuggagugcaguggcacaaucuuggcucgcugcaaccuccacuuccuggguucaagugauucuccugccuuagccucccaaguagcugggauuacaagguguaugccaccaugcccagcuaaguuuuguauuuuuaguagagacaggcuuucaccauguuggccaggcuggucucaaacuccucaccucaaguaauccacccgccuuggccucccaaagugcugggauuacaggcgugagccacugcaccuggcggacuucuuuuuaucuacuucuccagccuaauuuccuacccuucucuacccugucucacacuugauacuaaauuacucauaguuuguacaucuuaugcuucuguauccuugcacauguuguucccucugccuagaaugcucuucccucucuuuuugccugauuucuugcuucucaagacuuaguuaagguauuguuucucccaaggacccuuccuggauacucccuagacuuggcuaaguacuuuuuguuuccuuuguucccuuuucccauagcaucuaccacaccccuucaucaccuuuuaacacacaauauugauagaauccuaacuucauugaguguuucuguuaggcaaagacaugucuuagucauuuuauaaauucucuuauauuuaccaguuuuucuuuguaaauagccuagaacucuuuucuuugaaauucaguccauuuugaagacucugaagcuguguuuauaaaaaagaaaaugaaauuauucuuuacuuucuggggaggauggauuuauauaacuuaauagauucauaugcauuauagcuuaauaauuauuuuaguaaauaguuaacuuuaauaucacucaacaaauaauugcaacauuuuccauaaaacauuguccccugauaaucaaauauuucaaaguaucauuucuaauaagcauaauaaauauauugacauuagauuaacauuuuuuuguuuguuuuuguggaugaccaaggcugcuuauaaaccgccaugcuacauuuagaaauuaccucagaugagauugaguaugcugaaugguauggccauagacuagaaauuauuucagaacgggcacuuuauugcugaguaaaaaauucaaacaaaugaccauauuaaauuuauaggaaauguauagaaauuaccagacacuauauacaacaaauuugaagggauuuguauacuuauuguuaaaauaaauaauguaucuuuguaccacuaggugucaguggaacuuaagaaauccaaagccaauuuauuuccucaaguuaaagcuaacaguuuaaaugccuggaauauaugcaagcugaauaguuauguacaugcauaacauguacauauaaaugcauauauaaaugaguuauguguacaugugugauaguauaaaaaaagaaagaagaucuccuguauauaucugcuagcuuuaaaaaauguuuuucauaaaacagcucuccuguuacaccuuuccuggucauucccaugggcaucacugccacccaggauauaacuguuacccucugauacaacuguuacauucuggugcaccccacaaaacaguucuaucuugaauaaaacgguuccauccugaauaaaccuuuaccuuucuccugaaucuguuuaucugcaucccuucuauauaccugaauuguuuuguauugcugaacaacuaggagcauugaggacuuuuuauguaugagauaaaguuagcuaacuuuuaauaagccuuuaugagugcuuauuccuaaagaaacccugucagauauuuccuagguaaucacauacaaggcugguguucuauaucaaguucuuccuauauugugaugaaguugucuauugcuuccauguacacuaauauuacagcaaggaggaaguauuuuuaugaauguuagaaacuugagaaauaaguguucucaauaacauauuacugcaggccacuuagacagaggcaccugccaucuuauaucuuuguuacccacaggcuaaagaucgaauucaguauuaucaacuagaugaagucuuuguuuuuccauaugauaugggaaguagauggaggaacuuuaaacagguauuuacguggucaggggucccugaaggagauggacuugaguggccaguaagagaaggcugucaccaauacagcuuaacagugaguauuuuuguucaaauagcccuuccuuuuugccucgccuucuuucccuuaacucccccucaacucaagugacauuuuguaguaaaauaaguaauaugaauguuuucacuaugucaaaaugaaucuaauaauucuaaagcacuccuuguaucauguaucucccuuuauuucaauaucuccuuaauucucuauaccugugagauaaaguccugaucccuuaacauaguuuuaugaaaucuggccaaaaauuaccuuccaacuuacaguagcauaugaauuccuuauacauuccugucacccaacuuugcccacaauuuuuuccaucuuauaugaccuccacucuaucuaaaauuauuaagacucguuccagucuuaccucuuccauaaagucuaaccuacccccauagacucaucugaaugugacauuuaaucacauacuacucuaugguagcucaugaagucucauauuuuuauuuaauucugcuaucuuauaucuguaacuucauaagauucuaggacagagaucaugaguuaucuuuauuucuccuauuauaucuaauauagugcuauuuaauaguagcuaugucaaauuaaguuaugaugacuuuuauucauucaacuucauuauuaaauguucuucauuauucauuuguaguuugucugccaugucucuacagaaucagugaaucucaguguuuucaccugagaagcuucaugagggcggagaauauacucccugaucccugggccacaguaagcacucuaggaauauacacagaugaggacauuagagagugaauagcgagaagaaaaccucacucucagccucugguucuuagcauagggccuuuuuuuccaugcuaaaacaaccuguggccuuuaaauuaucagcaacuugaaaugcuggaaaauugggguuuugccauaucacucugacaguugaugaggaaaggcgauuuuucaacauugagacaagagacuucauuuuuuucuuuuuauuucuuccaaacagauagaacaguugaaacaaaaagcagauaagagagucagaaguguaaguacuucuuuugcagugguaauuuuuuuuucuuuuguuaggcucuguacuuccauacaguuuuuuuaauugacugacuagaaaccaauuguuggccuuuauuaaauaguauuccuuaauacauuuguugaaauuugaugcaguuaacuuuuguuuuuauuuaaauaauugggacuagagguugggaggaauuuaguccauuuauauugccaacauaggaaaauaauuauccucaauacagcuccuuaaugugaaaccuauccuuacaacuauguuguuggauaugauggccaccagccacauguggcuguuuuauuuaaauuuguuaaaauuaaaucaauuuaaaaauucaguuucuuguuugcauucacuacauuguaagugcucacucaguagcuacaugugucaagugcugcugcauuggauacuacacauacagaacauuuccaucauggcagaauguucuuagcccugcucuaacucuaauucuuagcuaugggcuugaaaagaggaguaagaaaagccuugagaacuagaaacauuaguugccucccagggaacuagguggauggggaacugggagguuccccuagaaggggaacuagaaggcuugucacuggauauuuuggaucuugcuuuaaaauuugaaauucagacuuaaaacucagauaucaugggugaauauuuaaagguuucuucugaucacugacgacagguucgcuauaaaguaauagaagauuauaguggugccugcugcccucugaauaaaggaaucaaaaccuucuucacaagucccugcaccgaagagccucgaauacagcugcaaaaaggggaauucauuuuagccacaagagguuuacgguaaguaauaggaaguacugcauuucuucuucaaggacaaaauuaauaucuagccuaaaaaauuaauuuucaucuuuuaaauauuucagauacugguuauauggagacaaaauucuugaugauuccuuuauagaagguauggaaauggaagggcauguuuaaaggacaagacuauuagcaauaauuccaaauuuuacaagaauaacuuuuauaaaccaaucaugccuaaugcauuaggggaacugcauagaaggguauaucacuaagcaacaaaaggaacuuccuuauauauuucucuauagcucuuguauuuuucaggucuuuuuaaugauagcuaacauuugagcucauaacuaugcgaaaaguacuuguauaagugcuacccuuaagguguagaaguccccaaaauacuucggagguaggcacuauuauuuauauuugauugagggaacugaagcacagagaggcaacuugcccauagcuaugcacugaaaacagauggagcuagggcuuaaccccaagcagucugacuccagauucuaugcaccaaaccccuguacuauuugcugcccccacuuugagcauuucucuuaaguuguuauaaaaaccaguagauugaaacuuuguguuuuuuuuuuucuuaaguuuuauaauuguuucuuuuuaaaguaaagauuagcucgggauguucuuuaaaaaauaguugggguuaaucauaaauuaaccucuuaugacggccgugauauagaaauguauauguuaggccagguguggugacucaugccuguaaucccaggacuuugggagaccaaggcagauggaucaccugaggucaggaguucaagaucagccuggccaacauggugaaacccuaucucuacuaaaaauacaaaaauuagccgggcaugguggugugugccuguaaucccagcugcuccagaggcugaggcaggagaauugcuugaacccgggaggcagagguugcaguaaucugagaucgugccacugcacuacagccuaggugacagagcaagacuccaucucaaaaaaaaaaaagaaagaaauauauauguuagaaaaagucuaaaaaggaaauuuacaaagacuacaagaagauaguucccuggaaaagacagugugauggugugccaaaaacaccuuuccugaucauacacauauaaguaaacacccauaccgaguucccccugacucuaguuaggagcugucuuuaaccacauuagucccuauucgggaucaucaaauuugggaaauaccuguuccuagcuuguuaugaacauuuaaaaaucuuauuuuuuuccccuucaaacugugcuuauaauagauagcaaaguggggaauaaaagucuaacuacaagcuuauuaauuugaaguaauaggacuuacugcuuucaguaaugucacugucauccaucagacuauuucaccucaauuucauuuucucccucagguguuucaagaauaagggguugguucccuagaaaauguguggaaaagugucccugugaugcugaaacagaucaagccccagagggggagaagaaaaauagauagcugcuguuaaaacaaaauuauccuuuaagucugcuuaauuacuugaaaauuguacauauuacuaaagaauuaugcaaugagccuacucugguuaagauguucuuuuccucaaaggugcccuagugccaugauuuaaauauuuuuauuaccauuuugaaauggagaagccauucugcauaugccuuugaauuccugccccucuuuaccaccucuuccucccccucaaaggaaaaacauuucauccaaguaaguuaacggcauuuucuguaggauuuucuuaugcacugcacacucuggaccucaccugcagauacaguuccccccuugccaggagcaucugcaugugguacuucucuuuucccucaguugauauuucuuauaugauauucuagauacuauagaacucaauuugucagauucaguauaaccucagauuuuguuaccugucuuuuaaaaaugcagauuuugucaaaucaaauaaagaucaauggauguu

SEQ ID NO: 18610 - RNA, 2068 nt, Homo sapiens
uugauuacuaaucguguauugaaagcaguaagagguuccacgacaccaaauagaccaguucugagguuuccccaagauaaauuuaacagcuccagcuucaguguuuaucaaaauacaaaagaaaaaaguagagguugucuuuuucgauggcaaaucggacccuugcaggcugagggagagaaagcuacaucacacacagagguggggugcucccgaggggcugugggucuagguggaccgccugcccggcuugcacgcgcuccugcuggugaggccccagacauccugccaaagugucugagcgagcacgaguguuggggacgacggacccacucuggccacacggcgaccgagggacagauggggcccugcgucccauaggcugccugaagguggguagggcggccugcggcauagugggguggcugugggcucccagccuggccccugggaaccgugggagcacagggacaagcacauggcuauggaaugcagggugacccaaggacaagcgaguugcggggaucucuacugugaccaugcagaauugaucgcagucugcugcgccaccaccaccucauguucccgaggggaacagcugggcuggcgacuggcauccaggccguaacugcaaaucuaugcuaggcggggucucccuucuguguguucaaguguucucgacuuggauucuuaacuauuuuaaaaaaugcacugaguuuggguuaaaaaccaaccaccaaaauggauuucaacacagcucuaaagccaagggcguggccggcucucccaacacagcgacuccuggaggccaggugcccaugggccuacauccccucucagcacugaacagugaguugauuuuucuuuuuacaauaaaaaaagcugaguaauauugcauaggaguaccagaaacugccucauuggaaacaaaaacuauuuacauuaaauaaaaagccuggccgcaggcugcgucugccacauuuacagcacggugcgaugcacacggugaccaaaccacggaggcagcuucuggcacucacaccacgagccgcacguuugccacaugagaguaaagcagagggcaagaggagugagagggaggggggucgcguucacuucugguuccggagcugauuggacagccaguccaguccuucauagagcccgucgccgcugguggcgcagguggccugaauguaccaguuccuguggcguagugagugcagccccagcuugucugugaucucggccgcauucauggcguuggggagguccugggggaaggaaggguuggugggaagggcuguccacaggacagagaaaggggccccaccagccuccaguaaccccuaccaccaggcggaacccacacuggcuccucacauuccccaggcuggcccgggcgccuaccugcuuguuggcgaacaccaggaggacagcaucccggagcucguccucggccagcauccucaugagcuccucacgggccucguucacacgcucucugucauugcuguccaccacgaagaucaggccugccgggcagccagugucaaauggucaugggaacacagccccccugccgcaucuaugggcaucgaugccccaucuaugggcuggcccccccucucuagaagcaggagugcccaugggaccaggccccagccacuuaccuuguguguucuggaaguaguggcgccacaggggccggaucuuguccuggccacccacgucccacacagugaagcugauguucuuguacuccacgguuuccacguugaagccugggugcgggaugcagggugaggccuuguaccuuggcccagcccagcccagcccacucccugcuggcccccaccucaccuauggugggaaugguggucacgaucucacccagcuuaagcuuguagaggaucguggucuucccugcagcauccaggcccaccaugaggaugcgcauuucuuuuuugccaaaaaggcccuugaagagguuggcgaagauguuccccaugcuuguggacagguggaaggacacuggccagggacaccuggagagacaaggugcucc

SEQ ID NO: 18611 - RNA, 1106 nt, Homo sapiens
ccacuccccacaggcucauccaccugcagacauggggcgcagaaagucaaaacgaaagccgccucccaagaagaagaugacaggcacccucgagacccaguucaccugccccuucugcaaccacgagaaauccugugaugugaaaaugugaguggggaacagggcaagggauccagccuccccacugccucuuccccgcuguucuccauccugccccuugccucccuuggugaaggcgucaucacccacaggcccaggacgcauugcucaccagucccuucucuuggucuguuucagggaccgugcccgcaacaccggagucaucucuuguaccgugugccuagaggaauuccagacgcccauaacguguauccuuggaaaccugggcuuuuuccagaggguggggagggggcuggaguccggacccugcucaucuggcccacugugugcccuggugcagggccaaagccguccagaggaacaggugccaccuagugauuucuguggggugagaagaugcagggcaggguuccaaugccaaugaucgcccuugaccuaaguggcccagaucugucagaacccguggauguguacagugauuggauagacgccugcgaggcggccaaucaguagcgacacagaggacccgcccccugagcagccccgcguacuguggauccagcuguucgguucugguccagagacauuccagggguccaggguguggguccugggcugucacagccguguguguguguguguguguguguguguguguguguguguguguguguguagugggugugcgugugggugugggugugagugaguguggguguguguggcugcacgugucacugggguggccgugagugugugcucacagguacgcgguggugucggguuccugggccugaggggccugaacugaucucacuuggcuccgaaagccuuugcuguguucccugcagccccuggccccccagccuuggggcucuggcuccccccggcggaauugggggacuguuuccugacauccuggacaagggaagcccacuagaggcuggaacaggaccucuccagccuccucaccagcaccgugccca

SEQ ID NO: 18612 - RNA, 3533 nt, Homo sapiens
ucccucuuacaaagaugcauguggccgggcacgcuggcucaugccugucaucccagcacuuugagaggccaaggcaggaggaucgcuugaggccaggaguucaagaccagccuggccaacacagagacccugucucuguuguauguauuuauuuuugagauagggucucacuuugucaccgaggcuagagugcaguggugcgauccuggcucacugcugccucaaccuccuggccucaagcaauccuuccaccucaggaguagcugggacuacaggugcacacuaccaugcccagauaauuuuucuaucuuuuguagagacgaggucucaccauguugcucaggcuggucucgaacuccugggcucaagagauuuaccugccucaggcucccaaagugcugggauuauaggcgugagccacaguguuuagggcccaccuggauaauccaggacaaucucucuaucucaagauccuuaaugacauuagaaaaaaaaauuguuuucccauacgagguaauauuuacagguugccuggauuaggacuugauggcuuuauaagggccauuuuccagcugugcauggcuuggucggcuucucuuguuugcaggaagcuaugugacaagcgcagcaccugcaaugagcugugauuggcugauguagacugggggugggggcucggacccccggcaggugguguucgaaaagguacaaacucacucugcagucaucaacucaccuuucggggugccucugaggcgugaggccuguggggugacguccgagcaugccagauuucguccacugagccgggcuccuggaggccccgugcacagaugcagcucuaggccccaggcugcgggcacaauuugccccaugccuccacagccucuggauuuaagauaaccgaggauagcgucugggaccccagugcucccgugagggucaaggagguccggagcuuacuccaaccuccagggcagagaggacagaugaucccaaaggcugcugggcucaggcuagggcgcggcugagcaggggcagcugcuuuuucucucccaggcuuccugcugugccuuuuacucaccucuacguuccuggugcuggggcuccgcagcgcuggcucuaaagaaguuccaacgccagccugggggcgcaaggcaggagcgcccuguuuccucgauuguuggggauuugcuccuaguuagguggugacuguccuuaugaucccccauaaaaccagucgggcagggggcagggggcagggggccgggaucguggagaagaggccgcggcuggcggggaagcaacccucagcguggaccccucaaccucgcggcucgccccuuacccgugcaccccucgccucacacccccgcgccccucacccacgcgucccucacccuacacacacccgcccaucacucgcgcacccuucaccccucacccacgcuccccucacccuucaccggcgcgccccucaccccucaccccucacccaggcgccccucacccuucacucgcgcaucacucaccccucaccccucacccacgcuccccucaccccucaccccucacccgcgcuccccucaccccucacccgcgcgccccucaccccucacccgcgcuccccucacacuucacccgcgcuccccucacucuucacccgcgcgccccucauccacgcgccccucgcccucaguccucacccgcgcgggccaagagggucccgggcgagggcagcuccccgcgggcggguguggggcucggaguuggcuuggcacgcgaggccggcagcagggcccgggcuucacgcacgccuggcccccgagucugucuugaggcucaggagcugccuuuucugcaaauaggcgcccaacgguucagcccggagaacuacacggggauggggagaggccgccccgcguuucugcagcgacagcgaccguggccgcaaccacgauaaugacaauggccacggugacggccgcgcguccagccggccccccggcgacggccccggcgcaucugcucguggggcacuugcaucggagcggagacccgcggggggcgcuccguuucccgagaccccggccgccucugggcgcugcaaacuccgagccggguccccgggucuccugggucaggacagagcuggacgagacucguccccggguggcccgcauucaggacacgcgugagaggggcguccggaccccgcgcccccggcccuccaggacgacgcccuccgcuuggauggccgcgcgccgggacagcuggagacggguuaacgugggcgccaggccugagggaccggccccgcccggcugguauuucccgaccgggcgggaggagccacgcgcccccaccgccccgacagccccggcucccggccccgccugcgcccgcccugcccagcgcgcucuaggacaccgcggcgccuccgcgcagcuccggcgugggcggggcccggcauugugacgucacggggcgggguuucccggcgccugagcggacugacgccgagacgcgcgcgggucagcggcgcggggacgcggggcgcugggcgcggggcugggggcgcagguaaggagcgcgggggcggcgcgggguccucggggggcggccuagggcggccgaggacgcagggccggggcaguuggucgcggccuucaguccccuggcuugguccugugggguccccggcccggcaccuccucccgcgagccgugcgcccccauccugggccugcgcccccuucccccgagccgugcgcccccaugcuaggcccugugacccucccccgaacagugcgccccgauccugggcccugcgcccccucccccaccccaucccggggcgcgcguggacccccgccggcuaagcgcacccgggcggugaccccaggggcuucgcccguccucgaccccggcgcugggaccccuccccagcccccuccgggagcgucucgggacccccagacacccccccgucccaggcaggggccgcuccucgcgcgccccgggccccggucgcccccgcucugccucggguccugcggcuggcgcgggucgggucggguccgugcgcgccgccccagccucccugggcggaacucgagcagcuccccgcuccccgcaggccccgaggccgcaggagcgcgcggagcggcgaugagcaggcggccgguggcccgcggggcgcggagcccgugacagccucggccaggcgggcgcugcgauggaggccgagggccuggacuggcuccuggugccacugcaccagcugguguccuggggcgcggccgcggccauggucuucggagggguggugcccuacgucccgcaguaucgggacauucgcaggacgcagaacgccgacggcuucuccaccuacgugugccuggugcugcugguggccaacauuuugcggauacucuucugguaaguugggggcuugcuuuccugggcugcacccggagaagaggguuucuccuuugggguuucugguugaggccgggggagcagcagggucca

SEQ ID NO: 18613 - RNA, 3232 nt, Homo sapiens
ugcucccagacccuuuggaggaggugacagaggggguccccgcagccccugcuguguggggagaccccgggagccaggcgcgcgggcgggggcuccaccggucacuccgaaaucgcagaaugccccagggucuccgggacuuguggguuuaggggaacguucgggacgcggagcgggcccaguucaccugccggacgcccccuccguccauccgaacccgggagccccgcaggagggacccuucucguccccagugaccacaguccggacccgggcugcgcucggcgggcaaggcugggagcuccccgggccggaggacggggcgcaugggcuccggguuugcagaauucgcggcugcgggagcugggucuucucucccccaauucgggccgcgccccggcuggucggaggaggcagaguaggggugcggccguguguccgagcgggaguggggcguucaucuccggggagaagggggaccgggaaaggcgcagcgcgccgagcauucgcccacaccccgcccgcucuccgcgcgagccgggugcgcccccaaccgaaccggggcgggcgccgggagagucggguuuucccgagacccgcgccccuuccucgccuucggcucacccgggcucccgcaggaccagcgcgaauagacggggcgauccgcggccgagaccuccauccacgcgcgcggcgcggccagaccggcgagcgccuccggcccgacgccccccucgacucccggacucugggcgcugagcgggagggggaggcaccagccccgcccggccccgagccgcccccgcccccuuggcccgaacagggggauuccaagguccccuucgacccucccgcgcccgcgcgcaccgcgcacccggagaagaagcugcgcgcggaaccaucagacaggagcccgcgccccccgccccaccgcccacugcggccccggcuccuucgccgcggaccccccacccccggccccacggcgcgcucaacuuuaccugcgguccagacuccgcgagcuccgggcuccgcuuacccggccggcggccuccucggggcggagcgcggcgucucuggagccggcaucccggacuccggcgccgccccgcgcaccgcccccgucccagccuucaguggcgcggcgcccccucgcgacauccgcggguccccaggagcgagccgacccucggcuggguuuggagccggggccaaguccacucggagggagcacggagcccacccagcugcccuugggggcaggaggcccaggccccacucugcacaccgcccccaccagcgcacgcccuggcaggggcacacacgcucacacucacacaggugcacacucacaucggcaaucugugcaacucauacgcucacugccacacucauaaucacacacacaggugcacacacaucggcaauccgugcaacucacacgcucacugccacacauaaucacacacaggugcacacucacauacucucauaaccccagucauucauacucacguacaugcauacacacgcucauaaccacauucauccaggcacacauggauacacucauacacacacgcaugcacacucacacacaaacacucucaaugucauuccagaggcacgggcugccuccugccugcugugaccacuccaaagcagccuuugggguacaggggaagagacgaggaacccggcccaagacucuggaaggacaggacuguggguuuucagucaacagccaaggcacuucucguugagcggauccccaggagacgccagcugugaggacuccggacgcuucugugggauggauccuggagccgcagcggagccucuagugaguggauguuucucauuugcauccacaaaaaggaaauguuccucuccagcuccagccggagcaccaggucuuggaagggaggcucuucuccauggaaacaucuaccggauucagagcaggaggugccugcacugcugccucugaaagggcagaggcugcuuuuugggggggcagcuggugguuagcggaggccuuugaggcugaacagaucugccccuggggacauugcccuggggauccaguggacguuugcagcugcaggaggcagaagcagccaggaccccuuuaucucagaagccccuguuaaauacacucauuagaaaaguaaacgagauaacucagauugcgcugucugugcuggaacgcagggguugcccuacagcuggugguuuggacgugggggucugaaggguuucucaggcugugcauucucugaccucggucuguucuucuugguccaguucagcccuggcugccucuuucagacccugcaccuugacccagucucugguggcugugaccgugcagagugcagucagcccaucaccucccuuuugcagacucuauaucuacugauccaaccaaaaugcucaccagccuuuccaggcaccacaucacguuucagacagcccuggcuugcuagucaaagcucuaggucugugcaguuguuggguuuuuucccccaugauuuucaguuacuugauucuuuaaaagucuagguuuuguauauuacaauuugucccuaguacauuuuauuucgguaguuuuuauuagguuaaacuuuuucaugagccuugucagauguuucagaaucuuaauucuguuaugcagcuuauuagcuuccuucucaucugaagccauuggacaacugcucagucgagcugggccauccaagucaucagcauaauucauguuuccaaaaaaaggggucacaccggcaagcccaggcccccgagcacugccuggacgccagcugcgacuccacgcccacccugcugauucauuucccauuuuguuugggaggaugucaguggagacuuucagaaaucaaaauacaaugaaucaggcaucugaacuaguaaaccugccaauaucacacaaaaaagacaacaaauaauguggucuguuuaauaaguuuuuuuuaguauuggcuaacguucaccaaucugggggggugguggugcugcaugaaccccgucagccuggaguggggaaggucuguguacccuggaccgagguccuaacgcguggugccucaguuuccuugucuauaauagcagaacgcacuucgcuguuuuacuaauuaaaugagacaacgcuaggacaugucuggcucacggcaaacagacaaacaaugaucaucauuguuuuaggugcuugcaaaac

SEQ ID NO: 18614 - RNA, 2249 nt, Homo sapiens
uauuuuaggggaaugacuuaaauagcuauaaggaaggauauauuuauaggggcuauaaaugcaucauuuguauuugaaauuucuagcauccacuacaguguacgaaguguauuuuagauggacugguaaaaaccagcaguugcaacugucuguuuugcauuccuuaugcucugcaucuggccacacgugacuugaacagcugaagcuucucuuuccaaagcuagagccaucaucguauuuaugucuagccugagauguuuuccgaugguauacauucgaauuguaaagcaguguaauuuguggcucucaacaugccuuaaaagucauuuccaaaaaagaucuggcauuuaaucuuuaauucaaaugguacugaaaauuacaaagcaggaguaauuagaaaugcaacuauuuuuagaaagcaaacauguaaauauauguuaagugaugacuaaaacacaagcaggagaguaggaaaaauuauuuaaaagacaacuauaguagguuuagauacaucuuaccauauacuguauuuuaacucuguguuaauucugguagauuuacuucguauuccuguuucuguaccuuccccccgaaccuuggucaggaaguaaguaaagucuauagaaucucagaauuuacugggccgagaagagauguauaucguauguaauugugaaauccagacaguuccucaacugaguggugaaaaugggaugaaaucuuaguguguuuuguuaucuucaaggcagagggaaucugguguuuuuuuuuuuuuuuccuucaaaaccagguagacaacgucucucaccgcccuggggaguugcuggugcuggcucagccuccaggauacagcuguccuguuauuuucuugcuuuuuuaggagauggugugcguagaggaagaugugguguuaguuuucaggacacaguuaaagacaggcuuaaaaaaucaagguucucuauuaaaacuauaauuucuuguuaauggcuaagaauuaaaaauuuuucagcgcuauuaacacuugaagaacucucuaaucccccacucuucccaugugaaaguaaaggacauuuguuuaggaauuuuuuuguuucagaaaagggcaacaugugucugucuuugccauaugguacuauuuaaccuauauugcaugagcugacaagacacuguguuugggcauugauuuauuuuagcauucgagaauguucuuugaaauuuaguacaguaaaugaugcauugaaaguuguacagaauggucguuuguggcuuuagcagauucuuucucaguugauacuuaaggguguagugaacaaguuucacuuuuuuuccaccgauacaauuuuugugagaaauaguuugccauucaaugcugagugacuguuaauucaggaaaacacagacuugaauauaaguaguuaagacuucugggggucacaaauaaggcuaagaguugggcaggucagaaagagaagauucacuguuuaguuccugauuauucuggugauuuuaaccuagagcaaaaaaguauguuuauuauuauuauuauuuuugucaaaaagacucagcuuuuguccccaucuuuuuuuuuuuuuuuuaaagaaaugaguuaaugaacaaauggacaauccuauuuaauaguuccccugagcuucuguggugcggcccuggaauuaucuacaggcagaacugagauguuuucacuuaggcuguguuuuguuuacacaugcugguuuggguuuuuggguagaccuguguugaauucacaggguggcucuuaugccauguugcaggaauuuauuaguauggaaccccacagaagauuccaccuccauuuuuaacauucuguauggcugucgagucgacaccaaagcaaaugugucuccagacaccucucucucguugucucagucuuguuggcuuuaaucauccuguuuucucuguuuuacgaaagaaguaaacaaauuucuauucauccacacguguguccccaaagcaaggcauauguggacugaaaggugggcuggggcuuugcuucgagaacgugagcgaagagcgugugagugcacguugccuuuggugaugcaucauuuauauugacauuaucagugacacagacagaacauuuuuaugccaguuugagaaaauaccaucauucacauugauaaucauauuccccccagauuuagauuaaucauuucaaagcuuuucaugucuuuagcaugaccauuagcauaaugaugauaauuugu

SEQ ID NO: 18615 - RNA, 10479 nt, Homo sapiens
cgcgcagcuccggggacgcccggggcugccgccggcucggggccgcagacgaccgcgggacgcgcgagucccccguccccccuugcccgccgucccccccgccacccuugcccgagaggagucaaauccggcuuuuagagcucggggaggguggggauauccggugccucucccgcgccaggaggaagggggagggcggagaggauccuuggccagucugcgccgagcagauucaaaccaaaacaaaaagauuaaaggagcagcggccggggcggcagcgguccccaggccgggacacccgggguggugcgcccggguucgcgggggcugcgccggcgccggggaggcggggggagcgggagcgggcgacgcggggaaggggggagccagggggagggcgccggccggaggaggggcggacccgcccgcccuagccgagcagagcacagccgagccgagcggcccgggcgggggccgaccccggccagcgucggcgcagagagcgggcggaggcgcaggccaugcugcggcuggugcccaccggggcccgggccaucguggacaugucguacgcccgccacuuccuggacuuccagggcuccgccauuccccaagccaugcagaagcugguggugacccggcugagccccaacuuccgcgaggccgucacccugagccgggacugcccggugccgcuccccggggacggagaccuccucguccggaaccggugagcccggcgccccccaaccccacgcccccguucucgccccgggcucgcgccgcgccgcgccgcucccgcaguccccagcccgcccgcgugcccacacuccggcgcgcgcucgggcgcacagccugaguuugcgagaucccgggaaguugaacccgccgccaucuggcgaaggcgaaugugaugugacuguugcuggugugaauauccgaugccaccgaacguccucauaacugaggguuauuuuaauuugggauuccccuccccuccuccagcccucccuccucccccucccgcucccgaaauaaaaccgacgggacccagaaggggaggcuccccgccgggccgcccgcgcgcacccacaguuccugcguugacauaaucuuuaggguggagcgggagcagccuggacgcaaacugcgacguuuagguaaacgugcuucggaggaaggaggcugggacccggcuggcuuucccuguucccuccagguuggcagccgccucgcaguggcggagccugucguuggaugugugggugugcaccucgccgguguugucugcgugcugucagugcagugugacuguugucuguccccugaguguuaacgaccgccgcguggcgcgugucccgggcagcugggccagggucggggugggggcauggcugccuuugccggcacguuuugcagacauucaggugacaccggguuguugcgagaccuucuggcuuuuccauuccccgcgcuccccaccgucguguuuccgccucacucaucuuuaguaacuggcgaagcaacagggaggaaacggaccucacucuuuaucggagccaugcccgcuuaggucuuugcuccgugggucccuggcugcccgacuugacuggcaaggcgcuccucuaugcccucugcagaggccugcaaagucccaucgaaauguuuacggugcugcaugugucaaguugaauaauaauaucgaaagggaggaguaaguucugacuguaacuauguuguaaauuguguacuagaaaguaccguaaagucccuugcacggacugaaggacaaaauguaccuuccuaaguagcuugaugcagcauuuaauuuguccauuuucgagauuccuauuagccuuccuaacaagacuguaguauggaagaaugcugaucacgauauaaaacuuuuggaaaccuuuugggaagaaugauugaaccauggguaggauuguguggaggcggggguggggggcuggucuggaauggcuuaaaggggaguguguagggauccuugaaaauguuugcauuggcuguggacacagcagaggauugauucauuaugggaugaaaugccagugcuguugagaguaagagcgugcacccagcccagcuaaaaagaagggcuugaguauguguucacguggagcacacagaacgcaugagugauuugcuagaaguugagaugacaccagacugaaaagauuuccaaacaaacuuuaacgggcaagaaguuccacacaggguuuuucccuuuuucuccuucugauaaaguguacucuugauugcaaacacuaguauaaacacacacaaaaguuugugaauaaaauuccuuuuggaaauggugugauauggggaggaggcgacugagcgaggaagggcagggggaaggugaggcguuagagaacuauaagccacagccuggugggaccaccugccuuugguggagagguggagagggcucccgccgggcugcgcugggucuccugggccucucuaccugcgaguguuaauaaacucugugggguuuuuuuuccuccugugauuccucucccuucaggcuuacugcugcccugggaccccucccuuuccccuuccccaaagggcaaguucuccccuggggagagaggcacagccagggugccuaggcacugccugcccugggucaccaggguugguccuggggcgggagacagguggaucccugaauuuuguggucagaacgcgggagugcagacucccauguuuggagcuccccaaugugcuccacuuuaaaauccaugccucuuuuuucccugcacacacgccaagaauccuuuuaauauaaauaguaucuccauaugaacaaccuaaccccuaguuucuuccuugaauccuuaagggaaaagaauggggacaguuuucuuuugaguugggaggggacagaaucuuugccucccgcuuucccuacucuguuggaaaaucugcucccaccaccacguuguaggaagauccuguguucuugcaaacagugucaguggaugugacauuuuaccgaauuuuuuaagaauagaggcuuaauaauucacugcagguuaguucauuuuaauccuagaccaaaucuccccuaagcaauguuaauugcuuuaaauuuuaugcaagugccucucauuuuuaucaucuuaaaauccgcucuagaaugaauugaguaagccuaaauucccuuguugggaaagauguuuggugguuuuaauugugcucugauuuuuuuucuuucagugaacaauuugcacauuucauugcaucuuagcacaaaauacaaauucuucauucacagggagggaugugcuuguaagcuagacauugauuuaggauaauaaaguuuacuauuuagaaaagauguaagaaggggcauauaaaaucccuauagaauguauaauugaugguccuuuauccaguucuuaccuuacuguuuuauguauccgagaacaacuucccaucucccccucuaugcucaguccuuagaaaagaaaaagagagagagagacauccccagguuaaaucaguuuaugcacuauuuucagcuuuuuucguaagaaggugacagauuauuucguuuccaaauauuucuaacgauuuucugcucaaguguaagauaauggagcaaagaguuuguaggaauggcuaagggacggugggggauggggaaggcguuuuugauaaacgguuuguugcuuacggaaggggaacaguguuuucugcugacucuccaggccgagauucccacccccucccccccgcuuuuuuucuugucuuucuuucuugucuuuccuucuuuguuucuuucuuucuuuuucuuuucuuucuuucuuuuuucuuuuuuuucuuaaggcaggucugguuuggacgacuuuguuuugucucccaguauugaaggcuuuuacucuggacuugaauccucgccuuugguuuuuguucagaggaaagcguuccucuccccugcgcaggaucgcucuguuucucaguaaacaugacgaggggguuuagcacuuuuuaaguacauauaagcuggugacucuagaaggguacagauuuggagaaugccugcgccgguccuauucuuuuuuccugggguuucuggauuuuagucuuuuaaguggauccucccgucggauuacuagaauccugcgcucacugcaugcacacaguuucaauuaaaggggggguggggguacaaggagggucuccaaaugcgcgaauccuucccagugugucuuucuugucuuucuguggcucccuggcccuuccgccccugcuccccaucccgagccccgcauucgcuuugcgccugcugcgcuugaacuuguuucugguggagcggaaggcgcgagcugcggacccucacgcagagguaaggacucaggcgggucccgggcuguggaggguccucaccagccgcgggggcgaagccgcgucaaagcagggaucccgguggagguggggguccgcgaaccggaggcagggagaccaaggagacagcgcggcgcgaggagccacccgagccgccgcgggcuccugccgucagccagccuaagccuccuucaccgacgacgcagacaauuuagaagacggcggggcgggagagcgggggugagaaaugggggugccugcgaggccaaggucacggucaagccgccggcgggcccugucugucggccacugcgcuccggcgcgccgagugcacgggacucggagagaacuuguccacccaggcggagcugcgcggccggcgcugggacgaagggcgcggacugggcgcgccugccggggcccccgcccgacccggagaggccgaggucacggucgcaggccugaggaaucucaacuccaccgcggcgccgggccugcgcggucccggcccgcccgggaguuggggucaaugaauccccucuccgugguggcgguggggaugccguaggacugcacggcuggagcugagggcugcagcgggcacuucugagggagagggaguuagauggacggagccuggacgggcacgcgggccccgcgcgucugcugccaccgcuccagcgcuugcccuugcgaauaaccacgauguuuggugugguuuuucaagcaaaggccccuggcaaacucaagcagccgcuggcuggcugcagccgccccagcucccagcagagccccacuccccccucccaaacuuggccucugcuaacccgguccagcgcgugugcgcgcuccccaggcugcuccggugugcguccugcuccaucucuccaccucuucccaggaagcggcaaaccacagccuggggcggggagaggggggguugcauuuuccccuugcagagccccccagggcgcgcccaucccgagguggggaggacugccgucgcagaggggcuggccgcccggguguccccccaaggcggggucucccugcagaggagcggcuacugccuuugggacuguggagacaccagggggacaaacugggagggaugaagggcgugggaaggguuaaucgugggcaaaggauugcacagaacacaacuggcagugggucggcuccuguccccccacuuccagagcaaacccuaccgucacuuccacccccacgggcaccuuuccuggaguuugcuuuacagccuaaggcagaggcacugagacgggcuccagcuggcucugcccugggcugcugcugugaaguccagaagcaagcucccagggaagugggcccuuuuuaaaacgccaggccuugagaauuauguaaauuuaaaggaaagauggcagguucuuucccuucucuaaaaauagaauguaggaaaaaaaaaauagaacguaggcaucuugauauuaaauuccaaauaagaaaccagcaaaacucaucuucccccuucucaugauuguguaucuuccacggguauggaauugugugggguguuauugaggcuguguggugugcuggcgucugaaugcagcuugacauaacagaaagcaguugcucccugcguucuuauuucuacaauauacagagacuuuucuguccuguagauacaugggggaugaucauaagugagcuuuuauaagcgcagaguauuaccuauaucaccgugaaaguguaucgcauacaggacaguuuuggcuuauuaaguuaaauuaaaagugaauuccuuuuaaaugaccugcuuaacggcuuuccuccuccaccaguuacuauuaccuuuucauucuauuacagguggaaaugacauuuuuagggucuuccauuaugugucuaagccaccuucugacauucuuaguagauggcuuuuuuccuccuauguaucaggauauuuuuguuaggagguauacugagaugaaaaaagcugggaaaaauacuggccucgcaauuaaauugacuccggauaccaagaugaaaauaaucaucugguauuaaucaaguuaugucucugcuucuuguugaggaaaaauauaguaacgauuugcuuuccuuuucauuugaaaaggacugugaaauguugaauguuucauaaaaaucgcucuacccaauuuuuguucaauuaaucaaaaugcguauuuucacacuggauguaguuacaucagaaagaaaauuugcgacagccacucuaacagugcuucaaacaaccccugcaggaacauguagcaaccagugaccuugcacauuccaucaaucuuuaauaauaucauugucauuacucuuauuaucuuaaguguuaaauuguugccagaaucaauacaagucuacuucuuugaauauauuuuaucccaguguuguuuuuaacaucuuuguuaagaggccaauuaauuuccaacucacagcuccagugaaguuuauauauaaugaggauuuccugacucuuuuucuuuuuuccuucuuuucuuuuuuuuuuuuuugcuuauuucuacuuuugaaagaagacaaauaaauggcaugugaaaaugugaaacaaacaacuugccauuuaaaaugauaugaaauuauuucuaaacugaugaaaggaaaaaauaugccaaaaacugagacaaagcacauugaacuaauacuuguuuaauuucuuuuuuuaucugagcagcaggacuaauuuucucaaauucgaucagauuguauagcuuagcaaccccuccagggucgccagaacuagaggaauuucucuaagcagaaucuaaaugccuaacaaaaaacccaucguaacauauuuguuuguuuguuuucuuuuagauuuguugguguuaacgcaucugacaucaacuauucagcaggccgcuaugaccccucaguuaagccucccuuugacauagguuucgaaggcauuggggaggugguggcccuaggccucucugcuagugccagauacacaguuggccaagcuguggcuuacauggcaccugguucuuuugcugaguacacaguugugccugccagcauugcaacuccagugcccucagugaaacccgaguaucuuacccugcugguaaguggcaccaccgcauacaucagccugaaagagcucggaggacugucggaagggaaaaaaguuuuggugacagcagcagcugggggaacgggccaguuugccaugcagcuuucaaagaaggcaaagugccauguaauuggaaccugcucuucugaugaaaagucugcuuuucugaaaucucuuggcugugaucguccuaucaacuauaaaacugaacccguagguaccguccuuaagcaggaguacccugaaggugucgauguggucuaugaaucuguugggggagccauguuugacuuggcuguagacgcccuggcuacgaaagggcgcuugauaguaauaggguuuaucucuggcuaccaaacuccuacuggccuuucgccugugaaagcaggaacauugccagccaaacugcucaagaaaucugccagcguacagggcuucuuccugaaccauuaccuuucuaaguaucaagcagccaugagccacuugcucgagaugugugugagcggagaccugguuugugagguggaccuuggagaucugucuccagagggcagguuuacuggccuggaguccauauuccgugcugucaauuauauguacaugggaaaaaacacuggaaaaauuguaguugaauuaccucacucugucaacaguaagcuguaaaaacagaacaaugacauaaaucaagggagaaagaaaaugggcacuuuaugucucagaauuacucaaaucaauuuauuuuuaguugguaauggauauaauauuucuuaaaacaaaaguaagguguuaaugaauaggucucuccuucuccuccuccuccuccucuucccuugggggaaaaaaaaaaaugugcuaauaaaacuucccuccauggcuaagagggaaaacgcuuacauucaauucuuuagucauggauggucucguuccagauguuauuguuccagggaacuaaauucauuccugaugccagaucugaucgagucaguaugucuucagcuugaucagauuuuaaaaucaguuuugaaagugguucccgacuucuuugcuuugggagaauuuggucuuaugcucauaagcaguucaugagugacaaguguagcaaaagccagccauauauuuucagaaucuauauccucaggaaaugguccuuuuuuuuucuauaaaucaccaaccaacuaucuaaauggacauuugggggaauucccucccaaauuugauuuuguuauuagaaaaaugauuccgugaacacagauguguuuugaagaaguagcacguaauggcuuuuaucuaccaucaaccugauaaggcacaugugaaauggaaauguucucuuuccucugaagcagcaaauuaauguugaaaacuuacauagacagaaaguagguuuuggaaagggaaaccacagagauuagggggacuuaaaauuaauauaggcacaggaaagagaaaagugugcgcuccauucucaguggggguucaccacaaaacacgggccccaggagggaagcgcugucuaggcacacggcaaggccuuaguaacagcaugcuacacugcucgagguacgguaugucccaucgcccugugcaccguagagaccucagucaucucaaggaagaauacauuugcuucuccuuagaggcguucgaacuagaagcuaugcguuaccucugauucuggaaacagaauagcagccacucauucugcauucccauuuuucucuccacguguucugguggaaugagaugcuccuuggcacuauagccugaugucccacauugacccacugaccacacaggaaaagcagcgaaaccugcacccucucuucugagucacgccuguggcucaucggcuucccucuuaaccuuuagugcccugaagacugcugccgcugucaccguugcgcugaaaccccaugggcccguucugauugaaggugaagcccaccagauuauuuuucaaagucuuagguuucgguguaucuaaccugcucaguaaauauggacgcaauuaaagaugcucuaggaaauuuggggacuguauuuaauuuuucuuuccuuccaucugaggagcaaggaaauccuacugcugaauagcuguuaguaucuauuuuacaagauuuacucauuuucagguaccuaauguagcugcuagcaugcaugcacaacaauacaauuuauaugguaaauggaaccaaauaauggcuucacugaauguuauggcugcacugaagggaaaugucacgguaaauagcugccaaauuauggaucaugccgaagugucacaacugcacuaaagacaaauagcacuagaggcuauugccacugugacgcuuuugaguuaugaagaaggguagcggccugaugcgaggcucuuuguguccucauuauagcaaaggguuacuggugcaggggacuaggaaaaacccguccaguguggugcuuaguuauucauccaucccuuucagaccuaacagccacagccacacggaaagagacuuugccucacuuuuacauucacaaacaaacaaaggaggggggagcagguuuuaugaauguaacugugcacaggaaaugacugguaauggaaaaaauguuguaauaaaauaaucuaaucaaagaauauuauuaaauuuaacauagucuauguccaaaaggcuuaguugcuucuuaugcagauagaugugugaaaucuaagcaguaauguacuuucucccuuuguaaagacuuggggaguaaggacauuaccaacuaaauugcuucuucgaaacugaagugagucccgguuuguuucauuuuaaugggaggguaauaaagaugaaagaccaacauuuuaacugauggaucccuuaagcuacagaauagaaauuuauuguguuuugagggaauauacuaaaugcagcuauguaaaaauaaaauucaaacgcccaggauuaaaauaaaauauaaucugaaaaccucauguucucucuuuccccaaa

SEQ ID NO: 18616 - RNA, 972 nt, Homo sapiens
ggcuagagugucuuguauagauugcuucacuggugcuuucucuucaguucccucaucaucaaaaucaucaucaucuucaucaucaucauuaucaucaucaucaucaucaucuucaucagcagcaaguuuuacuuuuuucuguggaaccuugcuaccaccuccaguagcagaccgcuuuccagauauacuuaagaguuucacauccuccuccucuucaucuucugacucugcaucuucuaccacagcuacuaagugcuguccacuaauaugcacuggcccugaaccacacuucaacuguaagaccacugguuauguuauuucaaaucccccaagggaaaccguuggcuguacagacauuuucaaaguugccaguguuacuuuaauugggcugccuucguaauucauggccucugcuucaacaaugugcaauucauccuuugcaccagccccuaaacugaccguucuuuuuuuuuuuuuagacagaguuucgcuuugucgcccaggcuggagugcaauggcacgaucucggcucaccacaaccuccaccucccgaauucaagugauucugcugccucagccucccaaguagcugggacuacaggcaugugccaccaugcccagcuaauuuuuguauuuuuaguagagacgggguuucaccaucuuggccaggcuggucucaaacuccugaccucgugaugcacccaccucagccucccaaagugcugggauuacaagcaugagccaccgcgcccagccuuaaacugaccauucuuaaagauaacuggugcucauuuucaucauuauccaccuuaaagugauaaucuuuguuggccuucaguucacaaccgaaaagauaguucuagggccucaggaggcucauguccauguccaucaaaucuuccaucggguggcagcacgcacuuagguggcagagaagggggacagagauaaaugaccacugcucaagagaac

SEQ ID NO: 18617 - RNA, 1355 nt, Homo sapiens
aaggacgcccgagaguuugugcagccugggagacggcgggggguuugauucaggggugcccgugggaaggggagggcugggucgucccagaaccuacugacuguccucgacccccgacucucugcaugcuccggaucucacucccgggagggcccggagaaaacccaaguuggggugagacucagaggggggcgguucuaguggagagguaaacggggggggacaacgcugcagcccccuggggcgagggugcgcucuacagagcgcugggggcaagggcaccuggccucucagagaaguuggugggggagggcaaugugacaauuaaagauauguagucuugaggaaucaguccccaaagagagaggcgauugaaucuacccggauuucguuuaaguggggagcuggucuucuugggggaaaaaagugcaaaaagaaaaguagagaggguggagcaggggaugcggcgaguggacccccagugggugcucggggcgcgcgggguguugcugcugcuggacgcccuccccgcaccuccgccccaggcgcggggccugccccaacccucgcgcggccccucccccguucccccuccccgccgagcgggccugagccgcggagcagcuacgcgagugcggaacucggggcgcgggcggcgguggggcccgggcgcgggcagggcuggccauggcgcgggcggcgggcgcgcggggcccugccggguggugcaggaggcgcgggcgcugcgggcggggcacgcuccucgccuucgccgcguggaccgcgggcugggugcuggcggccgcgcugcugcuccgcgcgcacccggguguccucuccgagcgcugcaccgacgagaagagccggcgcauccuggccgcgcugguaggucccgccgccgcucugccccgcgccgcgcguccggggaggggggaucacacccgcucccgguccccagccuucccggggacuuggguggcgguggcacccgccggggacauggguucccgacaccugcguggagugccagaggcgcacgccccggucccccgaauggggacgcagccggcagugcucugugggcgcgcugggggugucucuccccuuuucgccagaauucgcccuuuguccccagacagccucuccguccuacccucgccaccccugagcccgagcuccggaagaaaguuugcgggucugauccgaguguccagggaggugccgcguccggugucaggccgccgggcucggggcgcaagccagugcgggguucgggauccggggugccacgccucugucucucggguccgcagcgcuccagcccagcccgcguucugugauuccacccugagcug

SEQ ID NO: 18618 - RNA, 1223 nt, Homo sapiens
ccuaccucccccaccucagcaaauaacacuguguccucccugcuaaugcccacaccugaucacauugacccuuucucuuuguuucucaaacaagccaaacuuguuuuuaccuugaaaccuuugcccugguuuccccugugucaggcuuggcccuguucaggucucagcauggugucccaucccguuuugugccucugcuagcaguuagacccucccggcugugauaugcugcuuuuuccacgcgaugagggcuccugccugcccgccugcugugcaccuggcccauguccggugccaggaagucacucuuccggggauggaagaggagagccugguggaggaacagauacgagccccugcucugugacuaucuuauuuuuuucccccuuuuuccauacacagugcauacuagugugaucccuucuuacucuguggcccuuguccggugccagaaaguaacuucccaggauggaagaggagagccugguggagaaacagacacaagucccugcucugugacuaucuuauuuuacccccuuuuuccacacacggcacaugcuagugugaucucuucuuacucuguaggccuuggccugggauuuugucccugaggauugcacaguuagaaacuagugggacuguauugugaaagucuggauugugacauagucucagagcauggaacacaagaauggcaucgagggaggcucccaggcagucaguagaagggaagaggagaauuaaaggugaggggagcacuuuggucugcauuuuccagucucuuccugcccagagcccgggccuccaccugugccugagauccuguuccccuucccacucacagacauucccuaagccacccgauguuccccaguauaaaccaggccccuccaggccacacccugcuggguuauucucaucaguguuccugcuguuuucuccuuuccugcaaaacacacacacacacacacacacccuccucuccugcaaaaacacacauauucccuucuccccugaaacacacacauacacacacacacacacacacacacagccucccuugacucuucugcccccuccaggauuuccucauuuuucugcuccccugaauaguagaagccucugaaaggguuguuaagccuggucuccaauccaccuccuccauucccuuuuaaaccacaccuguucaccacagcuucucuugccaaggucucccagggugc

SEQ ID NO: 18619 - RNA, 1223 nt, Homo sapiens
gcacccugggagaccuuggcaagagaagcuguggugaacaggugugguuuaaaagggaauggaggagguggauuggagaccaggcuuaacaacccuuucagaggcuucuacuauucaggggagcagaaaaaugaggaaauccuggagggggcagaagagucaagggaggcuguguguguguguguguguguguguauguguguguuucaggggagaagggaauauguguguuuuugcaggagaggaggguguguguguguguguguguguuuugcaggaaaggagaaaacagcaggaacacugaugagaauaacccagcaggguguggccuggaggggccugguuuauacuggggaacaucggguggcuuagggaaugucugugagugggaaggggaacaggaucucaggcacagguggaggcccgggcucugggcaggaagagacuggaaaaugcagaccaaagugcuccccucaccuuuaauucuccucuucccuucuacugacugccugggagccucccucgaugccauucuuguguuccaugcucugagacuaugucacaauccagacuuucacaauacagucccacuaguuucuaacugugcaauccucagggacaaaaucccaggccaaggccuacagaguaagaagagaucacacuagcaugugccguguguggaaaaaggggguaaaauaagauagucacagagcagggacuugugucuguuucuccaccaggcucuccucuuccauccugggaaguuacuuucuggcaccggacaagggccacagaguaagaagggaucacacuaguaugcacuguguauggaaaaagggggaaaaaaauaagauagucacagagcaggggcucguaucuguuccuccaccaggcucuccucuuccauccccggaagagugacuuccuggcaccggacaugggccaggugcacagcaggcgggcaggcaggagcccucaucgcguggaaaaagcagcauaucacagccgggagggucuaacugcuagcagaggcacaaaacgggaugggacaccaugcugagaccugaacagggccaagccugacacaggggaaaccagggcaaagguuucaagguaaaaacaaguuuggcuuguuugagaaacaaagagaaagggucaaugugaucaggugugggcauuagcagggaggacacaguguuauuugcugaggugggggagguagg

SEQ ID NO: 18620 - RNA, 11206 nt, Homo sapiens
ucagucaaaguguguuacgucagggagacgagugucuguuauauuuucuauacuccuuaaauguuggaaauuuuuauaauuaaaaacaucuaaaacaagcagucaaaccaagaaacuaacuaaauuaagcagggagauaaaguaaaaaggggagauagauugccuggaggucucucuauccugaauaucccaaaauuucaagaacacaucagaaauuccucuacagacaguucucggggagaaggaacaaacacaucagaggggauaccucacacugaagccaccgcagauaaacaugguucuagaccccucccaaugcacauagcacuuacauagauauggaaucaggaucuuguaagugaaggucacuuuuuuccaaauccccagcaaauauuucaaauaaaauagaauuuccuuuuuuuuuuuuuuuuucuuuaaggggccucacacacguauuugaaugucucucauucacucccauguucuuuuggcagucagaaguaucagugcaaguaaguucuaaaggggaugagggcacuucauggcugccuucuaugguccaggcuuguaccucucaucacacugccauccuaacaacccacacaacagggacacuugaccacgcaccugcuagaaaagguggggugggugcccaggucuacccaacuugggaguguguacuuuucccgcuauguacuaggcccuuaauucaugaagcgcgaaauaugagacagauuccuaaaacucacacaauuuugaagaauguauuuaccaucugguucccuauggcccucaaccauuuucacaugcuuaucucaagucagauuccaaaguaugcggagggcagcugcuaaugacauauuuguuaguuuuaauuuuauucugcagacauuaugcaguucuauaauauaaaaugaauacaauacuaaaaucuauuuccuuuauuuacaugguguaacauuuccaauaacaaacauuucuaaucaugaaagaugguguuaaagcagaaauauugucaugauugagucaaugggagaacauaaaauaugcuguauuucauaauuuuuccguaagaaaaugucuaguuuguuuaaaugcaacaaauacuguauuagauucacuuuauaagccauacacuccuucuugucuuucuuuugaacacauucuggaaggcagcugugaagaacggaguagcgaguccacgccauucaacauccaucagaaacccuauuuuaaucaucuugggaucgauuaucuucaaugauaauaguucuucuaggauaagauucaauuucuacaaauauauaucgaaaaucauauucaccacuuccuggguucugaaaaaaauguaguguuuccagguauuauuuuccuuuccagaacuuaaauaacaccgcgcucagaaccucugaccccacaucccaugauucccacaccucuuucacuugcgcauacaccguuccuugcuucccuggcucagagcccucaauguagaauuucacacacguguguuucagcccaucuuuuacauauucagugaaccugucgagaaaacgaaagaucagucuaaguuccuuucauuuaaaaaucuccccagagccuccucugaauucaagccacaguaccugacaugcugccggcgaccccgccuugucaccuccccauagccuuuaacagacucaccaaagacaccgaucaccugcagaacaaggacagugcuuuauuuuguguuauuuuuuuaagcuucuaaagaaauaauuuuuaacaaaccagaugauuuuaggaaaaaaaaaucaguaagcuuaggaccuuuucaaaaaugaccacuccuggcucacgccuauaaucccagcaaucugggaggccaagauggguggaucacaaggucaggaguucaagacuagccuggccaacuaggugaaaccccgucucuacuaaaaaauauaaaaaucagcugggcauggugaugcgcaucuguagucccagcuacucaggaagcugaggcaggagaaucgcuugaacccaguaggcagaggcugcagugagccaagaucgugccacugaacuccagccugggugacagagcgagacuccgucucaaaacaaacaaacaaacaaacaaauaaaaaaaugaccacuccaauaagaaaacugaaaaaaggguuauuauacaaaaaucaucccauaaauaauuuaaacaaauauuucaugcacaaagauuaaaauagguagcuuuauggugugacuuguaguuucaaagcaauguagguugacaugacgcaguuccugcuccucuuacagaaaacaaacauaacaacacagaguucagauguuucucuacuaaccccuuaugguuugaagauaaaauguaugaacauuuuuaaugaaauguaauuaauuaauagcaucuaauacuaaaacuaugagaucaaaaaauuuuuaaaguuaccaaacacagugaggaaaaagaaaacagauaaugacauuuaaaauaaaucagagcuacaggugugaaucuacuauuucuaaugagaaaauccacaugaaguagaaauguaguuuuuauugaauucaaaaugcaaauacuguggaacccucuaaaaaauauaaauuugauauuaaacuaaaaaaguuugacccucaacucuacgaaauuuaucuuauuuugucuguuuguggaguaucuucaguaucacauuuuccaggauaaaaagaaguaauauguaagaugauauugcagaauuguauagcacaaacaaauagaacaauuuacuuuaaucuauuaaacauauaaauaucaacauccaucaagauuuuguuuuucaagcagacacaguacccagcaaagagaaggguaccccuuaaaaaauguugacaaaauuguuaaaguuuaauuauuauuuguagaguuuuuucaggcagcaaaugaaguuacgacuucaauaauaucccacuuuuguauauucuuguggaguuuuuuguucaaaaugcugaaaaaucuacgaaaggcugaguuugcgaauaaaacagcaacucuucaucucuuuccagagaugcguccuaacauuuaaugagguuaccacccacagguauuuccggagucuguaaagaauguuucuugucagauaaaauuuggauucccaguaacuauuaugggaacgaaccuuccuuauuuccugguuuucaccucugagauacuuuauccucccugccuuucuccaugguuaccacuggcuguccagagcucaaugaagagaaaucaguggauuuaaaaggaaagaugccagagaucguuagcuucugagguuuccacccugacaugauuagaaaacugguagaacauucagagccggggccccagggaagaucagcaccgggcucuauacugagcacgcuguggauugaaaucuuucuccucuucaggggcugcaaaugcgagcuaugacauuacuccuuggucugugugaagaacagcccuaauauuuaugaugauaauggcagacgauuaccugcuguuaucuuucagggugaaugaaguuguauuucaaugaguaauauuuucagugcugaaggucugcagcagggaguaagaaaucugacacuucccaggccacaccggcuacgugugacuggaaggucacaucuaaagccuuccuucuugacaggguccuucaaagaaccaaggcagcuuccccauguccacuccucccagggaaggguagaggcagacugugcuuaagagcuuagauuuggaagcaaauuuuggauuuguguggauucggguuccgguucccccacuuacuagcucagugauccuggugaaguuacuuaaucucuuuaagugucagucuccccuucugcaaacugaagacaaaguagugccgaacacaaaugguuuuugugagacugaauaaagaugaugcacugagacccugggcagagugcuugcacggacacauuuucgguaagugucagcaaugacauuaugaccaugaggucaugcaucaggcuuuaaaaagacuagaaacuuaccaugaguucaauauuuugguguauucuaaaaauuuaguaucuaugaacaaccagcaaaaugacugucuuguacaauuagcaugaaaacaucuguacacugacuuuuggguucucuuaaagagcaaagaccuaauaauguaaugaugacucgaccauuauguauuauuaugugaauuucacuagcgugagaacugguucuugaauucugcccacuuccuccucccagacauuuucucccccucaucagaguucauguaacucaaucuugagaacuaaccucaggaugugaucugcauuuuucuaaggcucucccauauaucuugcuaggacuggaugaagaaaaaaguucuuugaaaaucguguaaaacaagccaccugaaaucacagaaaacaaagaugaagcgaagcaagggcaacauaaaaaguccaguuuaaaaaauauucaagggcuuauacuugcuguuuuuugcaaccuguaaugcugauuccaaaaagcaccacuauuaaauagguaaaaucucuuccggcuucuuucacugugaagagaaaacaccaauggguuacgggugccggcugggagcaggcaagcuugucugcugcuuuugcacuucuugcgagagaaaagcagccuccagaucaaagcaaggggucuguguguguucaggggcagcuguuuugaaaacucccugugugucagcgccucagcagaauucucagagcagggcuugggaaucuauguuuuaauuuaggaugaagaaauccuuuuaacaagugauccaguccacaacugcuguagguuaggcaacacucccagauuaggaagagugcuggcuuuugucaaccaaauggguaagggacugaauggaccaaaaugggugucaacucuuaacaguuaguaacuagcucgaaugccagucccaccccacacugacuggugcauaaaaacagaacuguguucagaguaggaauaugguuggccagaaagauuuaugaauuaaacuuagaaaaugaagaaaaugcacagaccagacauuuguuuucccacacuaauaaaauaugugcauauggguuaaacagacacucugagagcuagagaaacucaaucaagacagugucagggggccaggcgcgguggcucaugccuguaaucccagcacuuugggaggccgaggcaggcggaucacgaggucaggagaucgagaccauccuggcuaacacggugaaacgccgucucuacaaaaaauacaaaaaauuacccgggcgcaguggcgggcgccuguagucccagcuacucgagaggcugaggcaggagaauggcgugaacccgggaggcggagcuugcagugagccaagauagcgccacugcacuacggccugggcgaaagagcgagacuccguccaaaaaaaaaaagacagugucaggggacagaauauauacauauguauagcuauaaauaaauguauuuguauuauacagaaauacauauacaaguacgcuuauuugucccuauuaccccaaucacccuagauucccgauugucccucccaacauuucauuccugccuugcuuagcguaucaggugagucuuucuauuuuuucacuuaccaacagcuacuguauaucuaccauguguaucuucauauauaugcaaagagcuauaacauuacaguuacacuaccuuaacauuacaauuacgacuaugcuuuucacugaugcugagaaagugagucaccuccuggcauuauguuuauagacuaauuuauucaccacauuagccauucagacuucugaaauauaaaucuuuaaaaaauuuuuaagaaaaaaacuuuuggaagaaaauuuuaauagauguugcuguuauuuucucuucuguauaaaaagcuucuauuauguuuauaaacaacauuguuuaaaagaaguauuuagcuaauacaacgcuuguuuaaaaguagucuuuagcguaucacaauccuucaaguuuucagcaagguucccaacuuagaagacauuauucaaauaauaaaaagaccucaucugccaaaaucuguguaauucaugggacugacucaaacaauugucacaaauccaauuucccuuccaagguucaggaguuggggccuacaaugacgacaucucauuccacucucagugucacaaaauacauuucaauaaauauuaccugccaguuauguaucaacucccagguugagaauacaauaacaacuaacuaguucuaguaaguauccuuauuuguccuuguuacccaaaccgggucauuggccccaacacccuggacuucugacugucccuuccaacaauucauuccuaccuugcuuaggguaucugacaggucuuuuccauuuauuugauaaacaacagcuccuguauaucuguuauauauaaagcccugugcuaaauauucuccauauucuacacacuugaaaaauuucuguuuguuacuuuauagcugucuccaauggaagcugcucacugucuaacuuucugaacccuaucagaccuaauacuuguaugcaaaaaacccucaugccauuuauuugcuuccacaauucucuaccccuccuauagugggugcugugguauggggcucccagcugcagggagcacugguagcggacaguugucagcugagcuccucucugggcauuccaucauaagagagcuuccucacuuaggucacggcacuucccuggaccagcccauauucaaugccugguugaugcagaagcauaagacucagcccccauauuagguaggacagugacuggccagcucagcuccagaaguccccagagcagcagcugaggccccaacugcaaaugcacuucggccucucccucugcccaguccugcuucccucaucccucaagacguauucugagagcacucccugauaaaccuuacgcaaaucccacuucccugggaagccaaccuacaacgggugcuaccaggagugguaagcagcucucaauuuggauuuuggagcuggcuugccggccacuggcuggcaaugaggacccugucccuggugguagggggguacugacagcaccugucauagagcuguagugcagcugaugcagcucucaccaauggggaccugggauggaaugcuggcggaagggaauguacuggcugauguguuauucugggaguuuaggaggaaucagcaauuuuaaggacuuauaucagacggcuguggcuggggccauggagagggauggugagaugaaguguguaacuaaucaccagugaaggugagugccaagggcaggagccuccuccccggcagaacaagacucaaauugcacccagaggauagaaaaugcgugggugaggucuggggcggaagggauucagggaguuuggcauuucaagcccaugagaccucccacaccaaggucaggguccugauuugggaggaaaggcaaccuaaagcuggguagggggcccuugaggucaauguuguaaaaaaucuugaaucccaauucuccugaccccucuagcccugaagcagcagcucagugucugguaaagguuggcacuuccuccaccuuggaaacugggcgagggguggguggggguuucugccuagcaagauacgugcugcucucaggagggcucuccaccuccccuccuggccaaguuacaacacgacugggcaugagaagggugagaagaacaauacucggaaggagcuggagguccccccggggggggggggaacauagacaccacugcuucuuaaggguggugugucaagggcacagaacacaaaaccagcugagaguugaucagcauggggcacgcuccugugaugaauuuagcaaccaggcaagcacccugggaacugauaugcagcuggcuaggucugcuccuggaaacuucgagacagugaugguccacauuaaguaaaagugacagaacagccauggcaaacuggacgaaaggcucaacagccuccaagaauggggaugcuaccauagauauaagauauaaagcccgaaaacccaccagcugacuauguucuuaggagggacaggaggacacuguguaccaaagccacaaggaagccacaguuacaucuuuauagagcaggaugcccugacagaaauggagaugaaagaauuaugaagcagagaccaggcugggguguuaaacagaagccaaggugggugcaaccaucauaacuaauggcaaggcuggaguggcagucgggagugucugaccuacagaaagcaacagaguugaugacuagaacacaguguuuccaaagggaagacacaagggcagcggacaaggcuacuucugaauuacacagucaugagaaauuaacuacagaugauuccugaggcugaaggcagcugcucuaaugcaaaguccugaacauugccccaguuucuggaccugaaccaguuuucagaccuggaacgcauuuacugaaggaaagcguauguaacugacuccccccguccuucaccaaaaggaccuacaguuaucaacuuggacauagucugugcugacagugauacccaaggacccaaagagucaugaugacccccugaccgcccuccaucaccggauguaagaagcucacagguggguccagggacuuaccuggcaauaauuucugugauuuccaaauguauaaaucaaggggauguacugaguaacuggcaacaauaacucccacuuuaguuccuuuggaaguggguuaagagccaucgcagugggaaaagucaaauggaagccccugaagcugcccuuucggugaccaagauaggaaauuaaaaaugauaucacaucuauggggaauggcagaguauucuuagagaccuuagauacaggcauggcgauccccaucacggucccuuguaauuuaccagucuuccuuuacaaaacacaaauaggugcuggagaaugacagugguuaacugcaaacucaaccaaguggcagccgggguacacauguaauaccacaaaugguaacuuuacaggggaaugcauuaacacaaucucaugguauuggccauugcuuugaagaacgccuucuauucagaagcagcagcaguagucuguaguaacaugaaacagauaauaacaguguauguuuaugauccugcccaggauuugcuaauucucucacccucuaucauaacagucuuaagggacugaaaccuucuggaccugggcugucuaauacaguagccacuugccacucauggcuauuucaguucaauuuuaaauuaauuaaaauuaaaucaauucaguucuucagucacaaguuuuagcaacauuucaagugcucaaaauagcuacaaguggccaggaacuacccaaauggacagcacagauauaggacauuucuaugcagaaaguuuuauuugaauaaugcuguucuggacauucaggagaauaucacauuugucuacuauauuuaugccaucauguuagagcccauaaguaacaaguggcaaguguguuagaaggcuuggucagagaagcugcaagugugagagguggguccaacaaagaugcagaggcucaucaacacaugagccgaccucguggggcuacacuggggcgugccaagacaugcccucccaaguaaaagacaauuguacccuauaccuccuaccacaaugcuucauaggccuguuugaauucuggacgcagcauauuccauauuugggaauguugcucccaucaauucacucagccacaaggacugucacgucugaauggggugcagaugagggaaggggucccuaagcaggccuggugugcagugcaagcaugagcacuguugccugagccagaugaccugaugcacaugcuguuugccacuucuaugccuuucaccucugcauacagguuguuccuucgugcugaacuaguaugaaugaaaagcuagguuuuuggcauagucagcagacucuaaaacaauugguaugauccaauuuuuuggguuaaaaauuauuaaaagguauguguaugaaagugcaaaauguuaaaaauagucaucuucgugugguauaaucauggcggucuaaauugcuuugucuuuuuuuuuccuacaaaucacaugcgaaaugaagacauuaaaaaaaaaucuuaaaauaucugugaauacaucucugacuuucccugacaacuuacauuccauccucccuauuuuauguuuuucuauuacugcagguaacaugugaaaguuuucccuaccaguuaugagucaauaaucucucucucucucuuuuuauccuauccaauuacucuuuauuauauguaacagagccaauauaacuugagaaaaauuucccaaacauaaugaaaaaaaguuauaucaaauucaagaucaacuuucacaucugaguuccaaucugugaagaaaacuguagaucuauauguucuaguucuaaauuauguuuaaacgguuuuuaaaaauucaugugaauugcuuuuucaccuuuagcagugaacuugguauaaaagggcauuggcagcucuugucaugucuguugaaagcccaaucauuaaaguacuccuuuuuaccuuuuugugauguugggacggcgguucccccucucugacuccugugcacagacacuuguuugcugccauccuccuuugcuuuucgggggcucggucccugcguccagaugguuuucugggugacuccaagaauacaucuaggucgcagcguuuucuuuugauauugaagcccacaucucaaacugggcucagucuucaagcacgcuuuguuaagcacgauguauggcaaaagcaaucgcuuugccgaggaccugugcagcuucuccguauacuguacggcucguagaaaaguacaaaucauguucacggaaaaucguuccgcuuagggacgaugcuaacuacaauuaggaaagcuuuaggguucacuacacaugcggccggacacguacucaagccuauacguuuacauuacaugggguguuaggcaaaaacgucaguuuccgcagcguaaaugaaaacgaaaagucuccagggagaaccugaugucuaccuucccuucugucuucuuuccauuuuaauuaacaggcucugaucaccuucugggcugacauucacaguguccccgccaugccuucgcaaagucaccugggaaacccccgucuu

SEQ ID NO: 18621 - RNA, 11206 nt, Homo sapiens
aagacggggguuucccaggugacuuugcgaaggcauggcggggacacugugaaugucagcccagaaggugaucagagccuguuaauuaaaauggaaagaagacagaagggaagguagacaucagguucucccuggagacuuuucguuuucauuuacgcugcggaaacugacguuuuugccuaacaccccauguaauguaaacguauaggcuugaguacguguccggccgcauguguagugaacccuaaagcuuuccuaauuguaguuagcaucgucccuaagcggaacgauuuuccgugaacaugauuuguacuuuucuacgagccguacaguauacggagaagcugcacagguccucggcaaagcgauugcuuuugccauacaucgugcuuaacaaagcgugcuugaagacugagcccaguuugagaugugggcuucaauaucaaaagaaaacgcugcgaccuagauguauucuuggagucacccagaaaaccaucuggacgcagggaccgagcccccgaaaagcaaaggaggauggcagcaaacaagugucugugcacaggagucagagagggggaaccgccgucccaacaucacaaaaagguaaaaaggaguacuuuaaugauugggcuuucaacagacaugacaagagcugccaaugcccuuuuauaccaaguucacugcuaaaggugaaaaagcaauucacaugaauuuuuaaaaaccguuuaaacauaauuuagaacuagaacauauagaucuacaguuuucuucacagauuggaacucagaugugaaaguugaucuugaauuugauauaacuuuuuuucauuauguuugggaaauuuuucucaaguuauauuggcucuguuacauauaauaaagaguaauuggauaggauaaaaagagagagagagagauuauugacucauaacugguagggaaaacuuucacauguuaccugcaguaauagaaaaacauaaaauagggaggauggaauguaaguugucagggaaagucagagauguauucacagauauuuuaagauuuuuuuuuaaugucuucauuucgcaugugauuuguaggaaaaaaaaagacaaagcaauuuagaccgccaugauuauaccacacgaagaugacuauuuuuaacauuuugcacuuucauacacauaccuuuuaauaauuuuuaacccaaaaaauuggaucauaccaauuguuuuagagucugcugacuaugccaaaaaccuagcuuuucauucauacuaguucagcacgaaggaacaaccuguaugcagaggugaaaggcauagaaguggcaaacagcaugugcaucaggucaucuggcucaggcaacagugcucaugcuugcacugcacaccaggccugcuuagggaccccuucccucaucugcaccccauucagacgugacaguccuuguggcugagugaauugaugggagcaacauucccaaauauggaauaugcugcguccagaauucaaacaggccuaugaagcauugugguaggagguauaggguacaauugucuuuuacuugggagggcaugucuuggcacgccccaguguagccccacgaggucggcucauguguugaugagccucugcaucuuuguuggacccaccucucacacuugcagcuucucugaccaagccuucuaacacacuugccacuuguuacuuaugggcucuaacaugauggcauaaauauaguagacaaaugugauauucuccugaauguccagaacagcauuauucaaauaaaacuuucugcauagaaauguccuauaucugugcuguccauuuggguaguuccuggccacuuguagcuauuuugagcacuugaaauguugcuaaaacuugugacugaagaacugaauugauuuaauuuuaauuaauuuaaaauugaacugaaauagccaugaguggcaaguggcuacuguauuagacagcccagguccagaagguuucagucccuuaagacuguuaugauagagggugagagaauuagcaaauccugggcaggaucauaaacauacacuguuauuaucuguuucauguuacuacagacuacugcugcugcuucugaauagaaggcguucuucaaagcaauggccaauaccaugagauuguguuaaugcauuccccuguaaaguuaccauuugugguauuacauguguaccccggcugccacuugguugaguuugcaguuaaccacugucauucuccagcaccuauuuguguuuuguaaaggaagacugguaaauuacaagggaccgugauggggaucgccaugccuguaucuaaggucucuaagaauacucugccauuccccauagaugugauaucauuuuuaauuuccuaucuuggucaccgaaagggcagcuucaggggcuuccauuugacuuuucccacugcgauggcucuuaacccacuuccaaaggaacuaaagugggaguuauuguugccaguuacucaguacauccccuugauuuauacauuuggaaaucacagaaauuauugccagguaagucccuggacccaccugugagcuucuuacauccggugauggagggcggucagggggucaucaugacucuuuggguccuuggguaucacugucagcacagacuauguccaaguugauaacuguagguccuuuuggugaaggacggggggagucaguuacauacgcuuuccuucaguaaaugcguuccaggucugaaaacugguucagguccagaaacuggggcaauguucaggacuuugcauuagagcagcugccuucagccucaggaaucaucuguaguuaauuucucaugacuguguaauucagaaguagccuuguccgcugcccuugugucuucccuuuggaaacacuguguucuagucaucaacucuguugcuuucuguaggucagacacucccgacugccacuccagccuugccauuaguuaugaugguugcacccaccuuggcuucuguuuaacaccccagccuggucucugcuucauaauucuuucaucuccauuucugucagggcauccugcucuauaaagauguaacuguggcuuccuuguggcuuugguacacaguguccuccugucccuccuaagaacauagucagcugguggguuuucgggcuuuauaucuuauaucuaugguagcauccccauucuuggaggcuguugagccuuucguccaguuugccauggcuguucugucacuuuuacuuaauguggaccaucacugucucgaaguuuccaggagcagaccuagccagcugcauaucaguucccagggugcuugccugguugcuaaauucaucacaggagcgugccccaugcugaucaacucucagcugguuuuguguucugugcccuugacacaccacccuuaagaagcaguggugucuauguuccccccccccccggggggaccuccagcuccuuccgaguauuguucuucucacccuucucaugcccagucguguuguaacuuggccaggaggggagguggagagcccuccugagagcagcacguaucuugcuaggcagaaacccccacccaccccucgcccaguuuccaagguggaggaagugccaaccuuuaccagacacugagcugcugcuucagggcuagaggggucaggagaauugggauucaagauuuuuuacaacauugaccucaagggcccccuacccagcuuuagguugccuuuccucccaaaucaggacccugaccuuggugugggaggucucaugggcuugaaaugccaaacucccugaaucccuuccgccccagaccucacccacgcauuuucuauccucugggugcaauuugagucuuguucugccggggaggaggcuccugcccuuggcacucaccuucacuggugauuaguuacacacuucaucucaccaucccucuccauggccccagccacagccgucugauauaaguccuuaaaauugcugauuccuccuaaacucccagaauaacacaucagccaguacauucccuuccgccagcauuccaucccagguccccauuggugagagcugcaucagcugcacuacagcucuaugacaggugcugucaguaccccccuaccaccagggacaggguccucauugccagccaguggccggcaagccagcuccaaaauccaaauugagagcugcuuaccacuccugguagcacccguuguagguuggcuucccagggaagugggauuugcguaagguuuaucagggagugcucucagaauacgucuugagggaugagggaagcaggacugggcagagggagaggccgaagugcauuugcaguuggggccucagcugcugcucuggggacuucuggagcugagcuggccagucacuguccuaccuaauaugggggcugagucuuaugcuucugcaucaaccaggcauugaauaugggcugguccagggaagugccgugaccuaagugaggaagcucucuuaugauggaaugcccagagaggagcucagcugacaacuguccgcuaccagugcucccugcagcugggagccccauaccacagcacccacuauaggagggguagagaauuguggaagcaaauaaauggcaugaggguuuuuugcauacaaguauuaggucugauaggguucagaaaguuagacagugagcagcuuccauuggagacagcuauaaaguaacaaacagaaauuuuucaaguguguagaauauggagaauauuuagcacagggcuuuauauauaacagauauacaggagcuguuguuuaucaaauaaauggaaaagaccugucagauacccuaagcaagguaggaaugaauuguuggaagggacagucagaaguccaggguguuggggccaaugacccgguuuggguaacaaggacaaauaaggauacuuacuagaacuaguuaguuguuauuguauucucaaccugggaguugauacauaacuggcagguaauauuuauugaaauguauuuugugacacugagaguggaaugagaugucgucauuguaggccccaacuccugaaccuuggaagggaaauuggauuugugacaauuguuugagucagucccaugaauuacacagauuuuggcagaugaggucuuuuuauuauuugaauaaugucuucuaaguugggaaccuugcugaaaacuugaaggauugugauacgcuaaagacuacuuuuaaacaagcguuguauuagcuaaauacuucuuuuaaacaauguuguuuauaaacauaauagaagcuuuuuauacagaagagaaaauaacagcaacaucuauuaaaauuuucuuccaaaaguuuuuuucuuaaaaauuuuuuaaagauuuauauuucagaagucugaauggcuaauguggugaauaaauuagucuauaaacauaaugccaggaggugacucacuuucucagcaucagugaaaagcauagucguaauuguaauguuaagguaguguaacuguaauguuauagcucuuugcauauauaugaagauacacaugguagauauacaguagcuguugguaagugaaaaaauagaaagacucaccugauacgcuaagcaaggcaggaaugaaauguugggagggacaaucgggaaucuagggugauugggguaauagggacaaauaagcguacuuguauauguauuucuguauaauacaaauacauuuauuuauagcuauacauauguauauauucuguccccugacacugucuuuuuuuuuuuggacggagucucgcucuuucgcccaggccguagugcaguggcgcuaucuuggcucacugcaagcuccgccucccggguucacgccauucuccugccucagccucucgaguagcugggacuacaggcgcccgccacugcgcccggguaauuuuuuguauuuuuuguagagacggcguuucaccguguuagccaggauggucucgaucuccugaccucgugauccgccugccucggccucccaaagugcugggauuacaggcaugagccaccgcgccuggcccccugacacugucuugauugaguuucucuagcucucagagugucuguuuaacccauaugcacauauuuuauuagugugggaaaacaaaugucuggucugugcauuuucuucauuuucuaaguuuaauucauaaaucuuucuggccaaccauauuccuacucugaacacaguucuguuuuuaugcaccagucaguguggggugggacuggcauucgagcuaguuacuaacuguuaagaguugacacccauuuugguccauucagucccuuacccauuugguugacaaaagccagcacucuuccuaaucugggaguguugccuaaccuacagcaguuguggacuggaucacuuguuaaaaggauuucuucauccuaaauuaaaacauagauucccaagcccugcucugagaauucugcugaggcgcugacacacagggaguuuucaaaacagcugccccugaacacacacagaccccuugcuuugaucuggaggcugcuuuucucucgcaagaagugcaaaagcagcagacaagcuugccugcucccagccggcacccguaacccauugguguuuucucuucacagugaaagaagccggaagagauuuuaccuauuuaauaguggugcuuuuuggaaucagcauuacagguugcaaaaaacagcaaguauaagcccuugaauauuuuuuaaacuggacuuuuuauguugcccuugcuucgcuucaucuuuguuuucugugauuucagguggcuuguuuuacacgauuuucaaagaacuuuuuucuucauccaguccuagcaagauauaugggagagccuuagaaaaaugcagaucacauccugagguuaguucucaagauugaguuacaugaacucugaugagggggagaaaaugucugggaggaggaagugggcagaauucaagaaccaguucucacgcuagugaaauucacauaauaauacauaauggucgagucaucauuacauuauuaggucuuugcucuuuaagagaacccaaaagucaguguacagauguuuucaugcuaauuguacaagacagucauuuugcugguuguucauagauacuaaauuuuuagaauacaccaaaauauugaacucaugguaaguuucuagucuuuuuaaagccugaugcaugaccucauggucauaaugucauugcugacacuuaccgaaaauguguccgugcaagcacucugcccagggucucagugcaucaucuuuauucagucucacaaaaaccauuuguguucggcacuacuuugucuucaguuugcagaaggggagacugacacuuaaagagauuaaguaacuucaccaggaucacugagcuaguaagugggggaaccggaacccgaauccacacaaauccaaaauuugcuuccaaaucuaagcucuuaagcacagucugccucuacccuucccugggaggaguggacauggggaagcugccuugguucuuugaaggacccugucaagaaggaaggcuuuagaugugaccuuccagucacacguagccgguguggccugggaagugucagauuucuuacucccugcugcagaccuucagcacugaaaauauuacucauugaaauacaacuucauucacccugaaagauaacagcagguaaucgucugccauuaucaucauaaauauuagggcuguucuucacacagaccaaggaguaaugucauagcucgcauuugcagccccugaagaggagaaagauuucaauccacagcgugcucaguauagagcccggugcugaucuucccuggggccccggcucugaauguucuaccaguuuucuaaucaugucaggguggaaaccucagaagcuaacgaucucuggcaucuuuccuuuuaaauccacugauuucucuucauugagcucuggacagccagugguaaccauggagaaaggcagggaggauaaaguaucucagaggugaaaaccaggaaauaaggaagguucguucccauaauaguuacugggaauccaaauuuuaucugacaagaaacauucuuuacagacuccggaaauaccugugggugguaaccucauuaaauguuaggacgcaucucuggaaagagaugaagaguugcuguuuuauucgcaaacucagccuuucguagauuuuucagcauuuugaacaaaaaacuccacaagaauauacaaaagugggauauuauugaagucguaacuucauuugcugccugaaaaaacucuacaaauaauaauuaaacuuuaacaauuuugucaacauuuuuuaagggguacccuucucuuugcuggguacugugucugcuugaaaaacaaaaucuugauggauguugauauuuauauguuuaauagauuaaaguaaauuguucuauuuguuugugcuauacaauucugcaauaucaucuuacauauuacuucuuuuuauccuggaaaaugugauacugaagauacuccacaaacagacaaaauaagauaaauuucguagaguugagggucaaacuuuuuuaguuuaauaucaaauuuauauuuuuuagaggguuccacaguauuugcauuuugaauucaauaaaaacuacauuucuacuucauguggauuuucucauuagaaauaguagauucacaccuguagcucugauuuauuuuaaaugucauuaucuguuuucuuuuuccucacuguguuugguaacuuuaaaaauuuuuugaucucauaguuuuaguauuagaugcuauuaauuaauuacauuucauuaaaaauguucauacauuuuaucuucaaaccauaagggguuaguagagaaacaucugaacucuguguuguuauguuuguuuucuguaagaggagcaggaacugcgucaugucaaccuacauugcuuugaaacuacaagucacaccauaaagcuaccuauuuuaaucuuugugcaugaaauauuuguuuaaauuauuuaugggaugauuuuuguauaauaacccuuuuuucaguuuucuuauuggaguggucauuuuuuuauuuguuuguuuguuuguuuguuuugagacggagucucgcucugucacccaggcuggaguucaguggcacgaucuuggcucacugcagccucugccuacuggguucaagcgauucuccugccucagcuuccugaguagcugggacuacagaugcgcaucaccaugcccagcugauuuuuauauuuuuuaguagagacgggguuucaccuaguuggccaggcuagucuugaacuccugaccuugugauccacccaucuuggccucccagauugcugggauuauaggcgugagccaggaguggucauuuuugaaaagguccuaagcuuacugauuuuuuuuuccuaaaaucaucugguuuguuaaaaauuauuucuuuagaagcuuaaaaaaauaacacaaaauaaagcacuguccuuguucugcaggugaucggugucuuuggugagucuguuaaaggcuauggggaggugacaaggcggggucgccggcagcaugucagguacuguggcuugaauucagaggaggcucuggggagauuuuuaaaugaaaggaacuuagacugaucuuucguuuucucgacagguucacugaauauguaaaagaugggcugaaacacacgugugugaaauucuacauugagggcucugagccagggaagcaaggaacgguguaugcgcaagugaaagaggugugggaaucaugggauguggggucagagguucugagcgcgguguuauuuaaguucuggaaaggaaaauaauaccuggaaacacuacauuuuuuucagaacccaggaaguggugaauaugauuuucgauauauauuuguagaaauugaaucuuauccuagaagaacuauuaucauugaagauaaucgaucccaagaugauuaaaauaggguuucugauggauguugaauggcguggacucgcuacuccguucuucacagcugccuuccagaauguguucaaaagaaagacaagaaggaguguauggcuuauaaagugaaucuaauacaguauuuguugcauuuaaacaaacuagacauuuucuuacggaaaaauuaugaaauacagcauauuuuauguucucccauugacucaaucaugacaauauuucugcuuuaacaccaucuuucaugauuagaaauguuuguuauuggaaauguuacaccauguaaauaaaggaaauagauuuuaguauuguauucauuuuauauuauagaacugcauaaugucugcagaauaaaauuaaaacuaacaaauaugucauuagcagcugcccuccgcauacuuuggaaucugacuugagauaagcaugugaaaaugguugagggccauagggaaccagaugguaaauacauucuucaaaauugugugaguuuuaggaaucugucucauauuucgcgcuucaugaauuaagggccuaguacauagcgggaaaaguacacacucccaaguuggguagaccugggcacccaccccaccuuuucuagcaggugcguggucaagugucccuguuguguggguuguuaggauggcagugugaugagagguacaagccuggaccauagaaggcagccaugaagugcccucauccccuuuagaacuuacuugcacugauacuucugacugccaaaagaacaugggagugaaugagagacauucaaauacgugugugaggccccuuaaagaaaaaaaaaaaaaaaaaggaaauucuauuuuauuugaaauauuugcuggggauuuggaaaaaagugaccuucacuuacaagauccugauuccauaucuauguaagugcuaugugcauugggaggggucuagaaccauguuuaucugcgguggcuucagugugagguauccccucugauguguuuguuccuucuccccgagaacugucuguagaggaauuucugauguguucuugaaauuuugggauauucaggauagagagaccuccaggcaaucuaucuccccuuuuuacuuuaucucccugcuuaauuuaguuaguuucuugguuugacugcuuguuuuagauguuuuuaauuauaaaaauuuccaacauuuaaggaguauagaaaauauaacagacacucgucucccugacguaacacacuuugacuga

SEQ ID NO: 18622 - RNA, 5442 nt, Homo sapiens
ucuugcgaaaauacaagcucugcuacucuagcagagaaauuaaguaggaugaaaauucagugggcauggaugugaacaggugaacuugggguggauucagaacaacgagagaagaggccagauucgagggggaaguguaggcaggggaucuagggccaugcauggaguauccuuggagaaaucuggccuaaagucgaaaaagguggggccaagggccaacuccagaauauuuuucuaugggugugcuuuguaauuucuuaguuuauccgucgaguuacccuuugcuagucugauuucaauugauuuauuuaccugagaccauuaaaaaaauagcaauucagggcuucaaaacauucacguuguuauauauuuuccucaauucaucucaacuggcaaaauuuuugggauugacuuucuuuucagguucccugcugggugucuuugacagcaagaaccaaaaagaaccaaauccaucaaguugaaugcugauuagucuucugugguacacucagccguuucauuccuuguagauccuucaaauucaauacugaucagucuucugugguacacucagccguuucauuccuuguagauccuucaaguucaaugcugaucagucuucugugguacacucagccauuucauuccuuguagaagaacaaggagcugguuuggagcaaagcagagcaggccauugcuggauuuagaacacaaccuuagcaucacauuuccaggaccucuguagacccuugagaaauuguuuacuucuuggcuaauuuaaggcagugugcuaaaguuuuaacccauccaggagccuucguguauaguuuuagauccuuaaaguggccacauuuccuaccaaguuaaaacucuuuggcauggccaugaggugcuggaagauguagccuuuccuagccuuuccaguuugcuaauaaccuccuacaagaugugguccuucuuauuccaggggcucgguuuccuuccuugauguccucacuggaccuacuggaguuauagcaugucuuugcaugauuguugggcuuguuugcugcugcugcuggacugugaggucauuagaacaguguuuacuugauaucucuuugcuucuccacuuccuagcauggcuccuggcauagagucguagguauucaaaacauccugcguaacuaaagaugaauuguuauccaaaugaauuuagcauaguaaauuauaauuuuggagaacuggugaucugaugaugauagccacuuuuuaacauucagaauauuuuauuuuuacaaucugcaucauaggaaauggaauaaauccauuuuucuuaaaagguuggcaauguucauacaauuugagucauuuaucaucagaauggucccucuuccuuuuugguuuguuuuguguucaauacugagaaaauauuuuauuuuaguuccccuucuuccaaauaugugucuuaaacuugugggaggaaaaaaucaaucacuuucuguggccaugacaaagguuggcccugacucugucaagggucaugccacaagcggagaagaagggguauuuacaaauguuaacucaucagccugaaucuugcuacaucagcuaugugcuuuucuaaauagucuuuuuuuuaauguggcagugagcuguguauauguaauauaccuaguuggaaugcugaaagguauuccaugugcauaucuaaaauugucaacuagcaugaguaagcacaguacguacugaauaaugccauacgacuucuacauaaaauuaaaaguuguaaauauacuugucuuuucugcuuuacuuuuuauuauuuuaaauuguuuaugcaccuaaaguaccuagaacuuuauugcagaggauuuucagaugccuagcaauaagauaaacuuauuuauuuuaguauuaauggaguaaaauuugacacuauggccuugcuaucauaaauaucuucagcauggucaguaagacagauggcuuuuugugaugucucucuggauuucuacuaagccacagugacaagugaaauauuaucuccaauaugucuuuuuuuuuccagaugaaguagagggucaguagaauguguauaguaagaaaaagacaguuucuaauuauuuuuuucaaguaacuucagcaacuguuauauaaaauaucugcagaauguuuuguguugagcacagggaacucuuuuugguagucacaaaucuuucuuuuuucugucucagauaaaaaauaaucuucaggagauauugggcugagggguuuggauugacaagaaauuucacuucaauuuucaagaggaucgaaugacuuagaauaauccauaggaggagacacacagauaauucugggauuaugguggagaaaaggggguagauaauaaaagccagagaaaaagugugcuucaaaaacaaucagcaacauuugaaaagucauaaaauuuauuguuguuuuuuauuuuuuacuuuaauuucuaaauauuuuugaaacaaucugaacuuacaaagaaguuggaaauacauugcaaagaucuuuuuucuaaacuauuugagagucaggagccaacaugaugcccuuucacuccugaacacuucgggguguauuuccuggauaguccuuaaaaucaggaaauucacauccuuauacccuaaccaccccagguuuuaccaguugucccaguaauacccuuuaugggaaaacgacccugcuuagaauugcgugguacaugaaucaucauguguauucagucuacuucaaacuggaacauuucuucaaucugucuuugcuuauuauggccuugaugcauuucaggauuacgggccaguugcuuugucaaaggcuccucaguguggucugugguuuccucuggugggacgcaggcugucugucuuuggcaggagcaccccugccguugccuuguguucuucucuucucucugcuuccugucacacagcacacagcguccacuggacccacugcugauggaggucacccggccaccugaugagggugcugccagccuucuccccuggaaagcuacucuucucuccuuuggguuaauaggcauuucgaggaaaagauuuguuaaauuauuuaaauaaauccuuccucaucaaacuucaacuuaugccuuuauuuuauuugaugaaucuugcacaaucguguccaguuuuauucaucaaguugucacucauuauuguuauuuauuuugaggcucauauagucccagguuuggugagagggagcgcucccaaucucacuucugugucuuucugauacccuccauccucaucccuugagcacauucuuucuggaauaacaggauguuucaggaguaucuuguacuuuucccacuccaucucuagaaggaaccauuucuguauucaguacagaugcccuuuauugaggaauggcauacuuagaaaccaagaucugggcaccagaugugcucauugcuauugggguagcaccgaucccaggccgucuuaguggucagagguaggguauacgugcauguaaacacaacacacaaacacacacacacacacacacacacacacacacaccacauacacauuuauacuguacucauucccagaacuagcucuccacucauucuaucuauauaucuaucuaucuaucuaucuaucuaucuaucuaucuaaaauuuaccuaccuaccucaauccacauagaugccuccaauuguaauccagcaccauaggguucauacuaauuuccuuccuuucacuauuugugauaaugauaauuaucuuuaauaucuucauuuauuugcauacuuguccuagguguaaccauccuuccaucaccauccccuccucugcauggaagcccucuccuugcacugcuccaaccuuaugggcugugcuucccacccgccgggguagaaguccaucccacccacugcaacucugacaucaugugcccccaccccgcucaggcaccaacaccccacucagauccuccagcgcuccccucuucccccuuccccucucccuaugggccuguaugauggcuuugcccuucuugauggauuucuaacugcauugucuagggaaggaggggaagagcaaggguaugaggaaguggaaugaaagcaaugcagugaagccacuuauucuaacugugaagggcaagauccaggguagaggaacucagugguuuccuuugcagcacugccuuaaaugagauaugccugaagagcugauuccaacuguuuguuggaaaagaaauacuaacuuacuggaaggauacacuaccugccaauguuuagauguggugcuauugaaaauaugcgccgugcuuguaaaucccagagagaggaugaagacgcugcaggaagcuguggagaguagaggagaugcagaggaaggcaugggcaacacggaagcucuugcaagugccucacagauaggacacaugcugccguggaagagaaacaaaagggccuggaaaagauagggauuccguugacaaacacagauuccagaggagacucagaccagcaguuguggaaaccucuaauucuuucagauguguccugagaggcauccucuggcagcccuguauugaugucucccaccgcccaugugcucucuccagcccugcuucauucucuguagcacuugucacuugccaacauaccguguuuauucccuguauuccccacuuaaaggccaacuccaugauagaagaaaguuugcuuugcuugccgcuauauuaccaaugccuaaaaugugccuagcacauaauagcugcucauuacaauuggcauaaauggaaaggaugaaaagcuaaccaggagaaaggagaacaauggacauuggacuaaaaacaaccacgaaacaggcacauuucaacaaggucuauuacagagcagucugcaaacagcgaccuccaagaacauaaucaucaaggaaaauagaacaggcaggacaaacacgugaaaucaucagaaagagaaagauggaaaagucugaaauauugaaaugagaguaacuucuugucuuguuucuaaggaagacaguggcggggaaauggaauugaugaaucgaagcccacccaggugggcucuucuucccaccaccugcugggcgaauguuuccaacacccaagaccuccaacuuuugcuaagccaccccugaggccaaagacagagaccacagagaccauggagauuugagcaggugaaacaucugagaaggaagauggauugaaauguucacagagggcgaggcucauuguguaaaguagaauuagaaaugaauaaugaugaaauuuaaggguacuuaauuccauagaauuaaaaaaaacucaaauaaugucugguccuguaagagaucagaaauacagccacagaguaguuaaauauugugaaaauauaaauaucacauaucaacacuaaagacuugccaccaaaacaguacuuaaa

SEQ ID NO: 18623 - RNA, 1674 nt, Homo sapiens
uuccuagaagagaucacccagcacagcugcccugggcucagggucuuaauuucugucuagucccuggaacuauuuauauuuaauaaauuuuauaugaauaccuggagaaauagaagacauaaaaucugaggguuugggagagaaagauuggggacuaggcaggaagccagagcaggggagguucccucaggccagcuugaccugcuccuugaccucuuuggcuccuggcuucuccuccuucauuuuucuccucuucugugacauuucuucaucucugagucucucuuuuucauccuguuuuaauccucuuggcuuuuuugaagaugggagagaucuugcagccacgcucucccuccucaucagagucgaagaacucuuccucacagguaauucaucugucagagaaacggauggagaugagcuugucagggucuucuucauucucaucgccacccucuugagggacagcauccucagaaucaccugcauuuggacugcagguggaugggccugcauuacuagguucucaaacagccacuguuuaaucuucuccagguacucauuaguguucugguuagucauauuggaaggacugauguagggcuugaaauaugguccaaaguauucaaaguaaucauuguaugaaggcucauuagggaucuccauauccagagccacagcucuuucuuauuuccagggcacugagcaacauuauaaaugguguaaccaccuucugccaucaauaacauaggcagguugacacucuugacagauuccacacacuuggcaugcccuuugaugaucagauuaaagcaaucuaagugaccccuagacaaggcaucugagccaugcuguaagaucaccacacuagacaggaacaucucuauuacuuuggacaugaccaguuugaaaauggccucauaggacucaucaucaaucccaucuaggagcagauaguuaauagcauaauaucugccuuugccagccccaauaacccauaaguccccaucuccugggaaguacucuccauauuuaugaaaggacacaguccuggccuagccuguaauauagaaggccucuuccaugccaucaucauggugaauaucaacgucaacauacaacacccucuggugauacuuuagcaguuccaagguggcccagauuguaucauuaacauaacagaagccagaugccuugaacuucuuugcauggugcaggccuccagcccaauucacagcaguguccaucugcugcucauuaaguuucacagcacuugccacagagccaccaguagacaacugacagaagucaaacaggccaucaaaugcuggacaguccucacuaacguugaaucucugcauccgcuugcugugcucagacacguaaucuggauagauggagcacaagaauuuaauguagucaucacugugguacuuggucaucuccucagcauuggcuuugugagggugauggguuuccauuuuucaguagaaaccauaguugagcagcaaauuaugagucacgcagauucagugaggauuccuugggugggcuuguccauaauaguaauuuccaacaccccuaucguaguaguaacagacuuuccuccuggugcccugccuuugcgccaucuugcucacuuccugucccucugucucuccugucagucaaucu

SEQ ID NO: 18624 - RNA, 2616 nt, Homo sapiens
uaagacuauucuauguaauuaucauuauuuauaacgcuuaaaugucugucauauaggugcaugauaaauaugaaugcugaacaaaggaauucaauaaagaaaaugaaacuuccaguuaaucauucacaaacauuucuggaguguuuacuauguguaaaauauauauuaaugcuuagaauacaaaaauauauaccacugauucagcuuuucgagaacacaaauuuauuagaagggacauauaaccuauaacuauggcuuuaaauauguucaaaaucacauggaggcuguagagauuaagucugcugcgauuggggagugggagcagugaaaaccuuucauuggaugugcaaccguugaacugucuugacaaaucaggaagagguuccuagacagaagauggagaaugugaagcuaaugucauguucauaaaggguggauuuuuugaaaaugguuauaauguugggagauaagaaggauguaaauuugcuaguugauguuuuuagacuuuuuaaaaauuauacaccaguuacaaauuucagcuaugccuaacguuaaaugacgaguuaaugggugcagcacaccaacauggcacauguauacauauguaacaaaccugcacauugugcacauguacccuaaaacuuaaaguauaaugaaaaaaagacugugauuauuagauuuguuucuuagaaauauaacuuuggcuggaguaaacuaguuuuuauuagaguaaacuuuggggcuguaaggagaaucuguacuuugcaacuauccaggcuggucaggagaguguugaaauauuauagaaaugugaauggacauggaaaacaacuaguuugaaggugaaauugacaggaacucgugcccuguugaguacgaacauggaggacaagagauacauuuucacuaauuuaaauagugagauuauaauauuuaggauagacguacuggaucuggaagaaauugucguaucaguuucagauuuuacgaaauaagaaaaaaauacauacagaaugaugaaagagauggauguuugcuugaaugccaugucuuuaguuuauauccauguuaaauuaagagaaaugcauuuaagaggaaauagcguauaggcauucauauuaaaauaaaauguaaaauauucaggagauaucuguaugaaagaugugucuuuauuaggaaaccauucuagguaucccucucaaagugcaugggucuuuuggcuuuauauaauuuccacucuuugacauuguaucuuauugucaugguuuaauugacauacauuuucggcacuggcccucauucuuuuguucacugugauauccacaacgccuugaacagugucugcaacaaucacaggacaagcuguggaugccacugaaucgauggacgcaugaacaaauuauuucuuuauagacuuguauuugguugaaugaauucuugugauuuugaaugcacauuaguaaagagucaaauaaugucuguugauggaaaagcaguacaccuaaggcagcauaauguugugaaagaauuauggacuaggaagugaggaugcucaugucuaauuuucaauuuauaccaucugagucugagcuucuucaucugaauaugacaauaaaaugggccacuuuauagaguuguuggaaguguuacaaaauaacauauaaagcaaguugcacaguacauuuuacucauaauuuuuauuuauguagcuuagcuaaauggcuugucuauauauggcaugaauggacagagacuagcuuggccuuuuuauaaaaaauuauacuucgacucaaaaaugaagcaguguauuuauguuaaauaauuugauuaaacaaaucagagagacugucuuucaguaucauuuuuguuuuucuuugguauuaauaaaaaucacauauuuuuguacauuuuuggaaguaaaaggaagccaucgaacugaaacaagaauguaucaggaauacuuaaaauacauuugcuaaucaaaguaaaacaguguguaaguaugcaaaacuaguaacugauuuccaguaaguuaugagaagacauaaagcgaauuuggguaaaaauacucagcucuagaaaauggugcauuuaaguaaagaaaggauaauagcauuugaaaaaaaauauuaaacacaguuuguucuuaucguacaucuucuuucuauucacaagggaaaauaauaagauugauugcaaucaagauugucuugugagacugaaaaagagaaaaggaguucugauacugauguacauucauauuuugauauguggaaauuauuuuauuuuuguuuuauagauuuacuuacgauucuuggacuaugagaugcagaauucaaaugagugcaagaggaauuuuguggcuguguaugauggaagcaguuccguggaggauuugaaagcuaaguucuguagcacuguggcuaaugaugucaugcuacgcacgggucuuggggugauccgcaugugggcagaugagggcagucgaaacagccgauuucagaugcucuucacauccuuucaagaacguaagauucucugcacuugacuauuuuuccuucguauaugccauaugaugccaguuucauaagcuguuaaugguguuuucuucacaca

SEQ ID NO: 18625 - RNA, 1177 nt, Homo sapiens
aacgagcgccggggaaggagcaagccgagcgagccacucaccccaagcuuccugcugcggauuuucacguagcccugcuugacuaugucguuaaaguuggaggccauggccagcgcgaucgggcuccugcgccccgcgauccgcucuccggagucgagagccgccguccgccgccgggucugcgcgggucucgcauccagccggccgccgccagcagcagcgccgccgcccgcucuuccccgagcucccgccgguggggacgcggggucgccugcagggccgccgcggacggggaacggggcccggcgccgcgagccgcgccagcccuccgcguucuggcgcucaccuucgcuccccgccgcgagcccagcgccgcggcccgcgccuccgccagcugcgggagcccccaccgcgccgccgcccccggcagcacccacgggcuggcgccucgcucggcggcgcacagcuggccggagcgcaccaccgcggcuccccggcgcggggggagggggcgggccggggggggcgggcugaugcgccggccccgcucccucccccuggcccgugggguggcugggcucggagacgcucgcaagacgcgcuccaucccucuccgcgcgggugggagcgccuccgccgccgggcgccccgaggcccgcuccccacccggcuccccggucccucagcgcuccccgggcgcgagauuccuaaggacacggcgccucauucccgggcucuaaaucuccacucgcaagcugugcagcggggaaagggcaguggggacacuuccaacgcggaaggccagcgggagcgagacacuuauuucauuggccuuguuuacaguacauuuuuauucccaagcacucgcggccguuccaggucucugccccguuaggaaguguaaaucgacgccagacccuuccuggugcacacaaagagaccaaucgugcgcaugugucuaauccucccgcagccuagagacaggcaggcgggcgaggcagccgggcgccgacguccucugcugaaggaguggagaagaccgaccgacccgagugguugauuuaugcaugcguuuucguuaacuaggacugaaaguggcuccuggcucuucugggaaaauggagaacgugguuguuaucaauggauaccaaugacuuccugaaaugcucaacuugua

SEQ ID NO: 18626 - RNA, 1177 nt, Homo sapiens
uacaaguugagcauuucaggaagucauugguauccauugauaacaaccacguucuccauuuucccagaagagccaggagccacuuucaguccuaguuaacgaaaacgcaugcauaaaucaaccacucgggucggucggucuucuccacuccuucagcagaggacgucggcgcccggcugccucgcccgccugccugucucuaggcugcgggaggauuagacacaugcgcacgauuggucucuuugugugcaccaggaagggucuggcgucgauuuacacuuccuaacggggcagagaccuggaacggccgcgagugcuugggaauaaaaauguacuguaaacaaggccaaugaaauaagugucucgcucccgcuggccuuccgcguuggaaguguccccacugcccuuuccccgcugcacagcuugcgaguggagauuuagagcccgggaaugaggcgccguguccuuaggaaucucgcgcccggggagcgcugagggaccggggagccggguggggagcgggccucggggcgcccggcggcggaggcgcucccacccgcgcggagagggauggagcgcgucuugcgagcgucuccgagcccagccaccccacgggccagggggagggagcggggccggcgcaucagcccgccccccccggcccgcccccuccccccgcgccggggagccgcgguggugcgcuccggccagcugugcgccgccgagcgaggcgccagcccgugggugcugccgggggcggcggcgcggugggggcucccgcagcuggcggaggcgcgggccgcggcgcugggcucgcggcggggagcgaaggugagcgccagaacgcggagggcuggcgcggcucgcggcgccgggccccguuccccguccgcggcggcccugcaggcgaccccgcguccccaccggcgggagcucggggaagagcgggcggcggcgcugcugcuggcggcggccggcuggaugcgagacccgcgcagacccggcggcggacggcggcucucgacuccggagagcggaucgcggggcgcaggagcccgaucgcgcuggccauggccuccaacuuuaacgacauagucaagcagggcuacgugaaaauccgcagcaggaagcuuggggugaguggcucgcucggcuugcuccuuccccggcgcucguu

SEQ ID NO: 18627 - RNA, 41615 nt, Homo sapiens
gccgcacucccgcgcauagccggagacggagacuggccggguagccccgcccccguaguuagcgcggugcuucucuuccgcuccgggucggcuccguuucccuuuccgggcgggcaggcggcggaccccagugucuuuaucccucuuuugcacagucagcuucugcagcucucccgggcuagcauggcagcguggaagaguuggacggcccugcggcucugcgccacagguaaugggggcucagcggucgggacgcuggcgggcgcgugggaccuggccccgccguggggccgggauuggacccgggucuggggcgaggccugcgggguucguggagaugcccacccauucccggcagcguccugccgcccccgccgcgccacccugccuggcccugacggagcggacaccuugggguccuuccgccgccgcugugccggaccaaugcuggacgugggaagggcgcgcugccuuguguuuguguuuuucucauuguggcagaaguuucaauaaagcuuacuccuuugaugggcaagaaggaugccgccgucccagcuuaacgaccaaaucuugccuuggcuuuagguuccgagucuugucacguuuaaggauuuuuaccaccaguacucaagagaggguggucgaggacagaucagggucaggccgccgggauugugcggugugaaaaggaccugagugugugucagcgguucucagcugccucccgucagcauggagugcccucauucucacugggguccgcucacuuaacaaccuuuuagagcccacucugugucaggcacugccguguaauaaguauuagaguugcagcucgacuuucuuccuacguaucuauuugaggggaaauauuuugaauggcauuuggaguuuuuacggaagagguaauugcuacuaaagcaaaagaaauaaagaagaaugcugucuauuuguauuccaaaaagauaggaugguuaaaaagagacguaagaugagagugaaaauauggaggaaaaaggaacuguguguauuagauuuauuggcuuaccuagaacuuggccggucacgauaugguugcauacagacuaaauauuuauuaaauggaugaacuaccuuugcuuuugcaucauuugcacccugggaugcaucagugaugaauuuuuugguagguugugaaaggucaaaaacacuucagagaugacuaagcuuauacgguaugagccaaauaaucagcauuuauuguguacauuuugucuuuuuuuuucaguuguuguacuugauauggucgucuguaaaggauuuguagaagauuuagaugaaucgugaguauacauauauauauuuaaaauauuauuuuaacuguccaacucagauaucugaauauuugcaugugauucuaauauuuuagauuggaaccaauuuuuauauaucacucauuuuuuucacuuguuguaagugaaggugagggugugcccagaagaguuuuauuaauaguuaugagaucaaaaaacuguggcaaacuuuuacauauucuuuuuuuccucauuaucuuaccuuguauuuaugucuuuuuccuuuaauuauauugaauggguguuagaauuugguaacuguacuguauuuaucuucauaguaugacagcauuaaucagccuugcuuauaguaagugaggagguucacuucagacccaaauuccugugugugaucuuucaggcuugaccauagacaauugcaaggcuuuuucuggcauaggggaaggugcccucccuacaccaaacuugguguauaaccggugcauuacagucccuggagggagugguagucaaggauucggccucccaggccagccacgcucauuugcaugucuacacucccaacccaguggucucuguuuagcagccuccuuauugggaccucaccugaggcauuuccugagcacuucugcuaaaacaucuuuauugagggugucagcggaggcacuuuucuacucuaguccuuuucucucucaccccccauaaagagacagaagacuuuuguucagugcuguaggaaaugagaugaauucucccaucugugucucauccaccugacucaccuggugcuguuucauggggagagauggaacacugaggagcuggugccucuuuuuuuuuuuuuuuuuuuuaaaccucuugacuugcacugucacaguaagugaauaaagcugugauuguuaguuucaguuuagcuuguuguccugauugacuaccuggacaccugauggcaugaccaaaugggugcagugagagggugaucauacagugcuguucuguaagagcaaaaauccugacagucccaugggggcacuucgcugcucaugcuguugggucaugggggaugcucacugauuguuuacaggaaguuuuugauucugagaagaacgauuguuaacaaggagauagucuuauuaaacuuagugccuuguggggugugucacuacagacuuccuccuucagaguguccuaacaggggcaacucuuccugaggaggaggaagggauucugcuccuaauaaccauuuuguuacccauguggaugcucaccagaaaggucccuaugcugaaaaaggggaccuuuaccaagagcaaacuguucgucagcuaaauguggaaaaugaauuguuccuugcuccagagcaagcagaugugcaaccaguugccuccgggauccacaagagauggcucauggaaauucagacaggaucccagauugggcaagaaugcauggacugcgacaguugugagaagacaccauaacaacgugaaaaagcugcuugcuugucagaccccggucaaggcuaacaauacuguccagggacagguucauaaagccagugggccaggauauucucagcagauagaacauggugggccucucauucugucuguaauguuccuguggcuccugauugcagcugacaugucucuggguuucgcuuagccauuccuauguguuccaaugacuugggccacacugucuaggcccuacaagaccaccuuuguuuccuguucaguuaccuuaagaacacugcaucugauaaugacccuggauuuuuggcccaagcuacacaucagugagcccaauuaugggugaaacaaugggcucgucauaugcuguaaacucugauccgcagggugguugaacauuuuaagggacaguuaaagguugggccugaccagcugaugguaagguacaguaccccugcuggacugcacaucuucaggggagugaucugggaucccagcacaggaauuccucaauccaauauuucucacgcgcauuuuaugaacacugagccaucauuaccaggaaauggugagaacacuucuaaaauccaaguucccagaugccaaccaaggaccauucuuagaaacaguuauuucuaagcauagcagccucaggcuuccuuugguaccuuuucuaaacagguguaaaauguucuagaagggcaaggagcuuaggcaucuguuuguguuucuaccaaguccuacuuuaauucuuuuucuuggagucuuuccuccuaauuacuuuaucauugaucaguccucugcuuuuaucuuugagauguuuaauggauaggucacugaguaaaaauuuuauguaaaguauuauugaaggaauuugggucuuucccuuauauuuaucaauguauuaucucugccuauacuauacaguuguaaaguggacacaaacauacaaucaaacauuuguuuucuuguuuuuuagguuuaaagaaaaucgaaaugaugacauuuggcuuguagauguaaguauguaaauuuuauaugcuaauuacccaccccuaccauuuuaaguauuauuuucuauucuacucuacccaaaaauggcaguaaacagcuagugcuuauguauauacucaauuuguuuucuuaaguauuacuauauuugagauuuuacauuaaaaagaaccuuagaguuuuaagguuccaugcgagggaacguauuuuugaugaaauuuugggggugagaauauuaagaggaaaagcuggaacccugucuuacaaugaggucaacuuuuggauuauaucuuaaugauauaggguaugauuuuauuacagaauucacucuugcuuucuugauaguuuccaagagauugaguauauuaauaucacuuagucaaagucauauuuucaucuuaacaguggacaaaauuaaaguuucaccuuccuuucuuuaaaguuuggaauauauuuaaaccuuaugauaguugagauuuaacaugccucagcaaaaaguagaauaggagcaaaagagauggaaaaagaauggcagaguugacagaucacuguuuaauuauuucuccuuuucuguauguuugaacauuuucauaguauaaaguuaaaaaaucuuguuucaugaaaauauaacaaguaguuuguaacaucacuuaauuaggggaaccugaguaucaccuccaccaucugguaauucuaaagaagaguaaaagacugacuucaguuuaaucaaccuggcuugucccuaugccaaaccagucaucuuaaugaccuccccuucuugccagugguuacaauagaacucagcaaagucaccuacuauguugacauuuuuguaauagaaguagauugauauuaucauuaacaauuagguguguauguuguauauauauguuuauuuuguggauucauuuuauauaaaacguuucauauagaacauuuccuuggaaguaaagacauuuuuauuguaaauuguauaucuguuuuaaaucaguagucaauuaaaaugagcuuaagauaguaccgguuuugagguaucuagguuuauguuuguauguuuugaucuuucauuauguaucuacuuuaaaaauuauauuuaaacuucuugucuaaaacauuauuagaucauuuagucaaagggauucuuuaaauauuaagauucauauuuacuguagcacaacauuuuaaugguuaucuuuuuuuguuuguuguuuguuuuuuuaaaacaaguuuuaugcgccaugguguggccauuguaaaaagcuggaaccaauuuggaaugaaguuggucuugagaugaaaagcauugguucuccaguuaagguuggaaagauggaugcuacuuccuauucuaguaagccuucacuuaguuuauuauuuuacuguucucacagcaaaaacauuuauaugcaacaguauucagggugggaggaagacuuuuuuuugcucauguaaaauucaauuaacuuaauaauuuaagacuguauacuuuaugaguuaaaugaauuagccauugaacauguagcguguaguguguguuaaucuuaugcuuaacagauguuuaaaccauccuuucuccuuugagcccacuucagaugguuuauaugaggcagcuguaaaaggaugaguguuaaacuauugauauugcuacuugaguucagaauccguuuuuuucugaguagccugagaugugcuguaaagaaaaaaugggaacuuaaaggacgaauugaguuagggugaguacaagugaggaucaggaagcuuuucacauuagaaagaauacuagagcaaaauaauagagugugaaagagguuaaugaguguguacuagagaauagaaugaagugaaggugagcaaaccuuggucuguaggccaaauuucuccuacuacccauuuuuauaaauagaguuagauugaagcauagcuauuuguuaucuguuuauggcuguuucugugccuccauggcagaauuccguaguugugacagaggcuguaugccccagaaagccuaaaauauuuaucugaccuuuuauaccgacaccuguuuuaaaggauuugggaaaaagaagaaguuaaauuuagagaagugugagguaucauagaauuuggaaagagcauggcuuucagagagcagauuuugauucaaauccucgcucugccugcuacuuuugcuguguaacacugagaaaguuucugaacaaaccaaucuuugguuuccauauugauaaauacuuaauuauaaugcuucuuuuauuggugguuuugagguuugaaugauccagcagauauaaaaucuuuuguauucaauaccugcaguuucucuuucauuagugaagaaaguggaaguacguaauguauauuucguuuuaggaaaucagcaauuuuacuuuggagcaagacagagcuauguuuuaaucucaacuuugccauguccuacuuuuguagcuuugggaagcacuuaaccucucuuaauuuuaguuucuguagcuacaaaggagaguaauaauccucaagguuguggaaaucauguuaauaucuuguauuuaaaacccccuagcacaauggcugcacguauaugacacuaaaggauaaugccacauuguuaagagcuucccaggucaggcaguguuuuggauuuuaucacuugucaguaugagguaauacacauuuuugugaaggcaaugacuugauaaaaauaauuuugucagcagcuuuuaggauggaaaauaaagaguuuguagaaacagggagaucaucuaagucagccuuguguauauauccugguguuggaugcugggagccugcuguuguggguggugacaguagaguacaauggaaacgguaauuuucauagacaugucccauacuaaaaucacagaaguaacagauugguuggcuuuguacugugaagaaaacaauaauagugugagauuccuagcauaguugcugaacuaugcuaccacuggguauauacaaaauaucaguuuuaauuuuaugugcauuucuaaguuaccaaugauuuugaauuuguggucuuuuaacugauguuugugaauagggaccuacaguguaggugagauauuagugcuggaauuauugagucacccaaaugaaacguugaaauuuugagaggagaagagauaaauggcagaaauuguuagagagggagaauaauauguuugaguugauauuucuuugaaauaagcuuuuaacaaugucuaagaaguuaucguuuuccacuguugcucaugaaaguaauuucuuguuuccauauauauauauacacacauauauauacacauauacacauauauauacacauauauauacacauauauacacauauacacauauauacacauauacacauauauauacacauauauacacauacacauauauguacacauauacacauauauacacauauauauacacauauauacacauauacacacauauauauguugauuagaugugcauacacauauuuauucauagaugcgcuuauucauguauucacucaaucaauauuuaccaaguacuauuugucaaacacugugcuaaucucuagagauuaaagaaagauccagacaaaucuugcuuguccuggaaaugcuuacaacauaauaaagggagaaagaugaauaaaccaacaagagcaguaagucucaaaaauggcaaauugcugugaucacuugaauaggucaguggagucaucgagucauguauaaaggaaugugggacuaugaagauaaacagucaaugagaaaaauagugcauauaaaccaguaaaagucuuagugguaaaguguucauguaauacuucauugauaauuaacaauuuucauugucacauucuauauuguaucuaauucauuaguuuauucaguauuaagugccccuguguacuacuguuuauuaaguggcacuaugauuagggaaaaacauagccaagauuguuuuccugagacacuuagagaagaaaguguuuuaaaugcuauuuuuaaaaagcaguaguaagaccucauauacagguugcgacuuuuuacucauuggauauggauaaaccuccaccaucccccucucucaacuacuugcccccgaccuuggauaguguggcuugcuuggaaagccuacuugaauuauccaaacauaguuaauugaaaaaaaaaaaaaagucccuuuguagaaaaguuguggaguuagcauucauucauuuagcagacacuuaaugugcuuaccauguuaggauaugccuggcacauaccaggguacuggugauacaucauugagcaaaacagauuaaacuuucuagucuuauggaacuuauauucuugugggaagagacaaacaguaacuugugaacauaagucaauugucuaauguuauuuucuagaccauuauuagaguuaaaugucagugauggaagcauuauccacuuaaauauuagcaccaagggaauguguuauguguagugaagcaaccuuucuuccuaguguuaaagaaguuaaguauucaaaaccaccguucacauauuacaaacagauuuuugccuugugaauuucagaguuugccuaaauuuuuaaggcaguugaaauacagacauuuuaguagaacuuggaaucaaacagguaaaaaauggaauuacuuucaagucaucugccauuguuauucuaagucuaccuguagaacacuaaaggauuggcuguuucauagauaccucuugcggccaguagguugcuuuucagacaguugcgguaucacuguuccucagcauguaaucuguagacgaccugcaauagaauuaccuggguacuuauugucaguucagauucugaaggcccacaccaguccuacuggugaacagugaaaaucuuugcaauugggucuugagagucuguauuuuuuauuuuauuuauuuuauuucuuuuauuuuauuucuuuauuucuuuauuuuuuugagacagaguuuugcucuuauugcccaagcuggagugcaaaggugcaaucuuggcucacugcaacuuccgccucccggguucaagugauucuccugccucagccucucgaguagcugggauuacaggcaugugccaccacacucgacuaauguuuuguguuuuuaguagaaacgggguuucaccauguuagccaggcuggucccaaacaccugaccucaggugaucugccguccuccucaggugaucugccugccucggccucccaaagugcugggauuacaggcaugagucacugugcccagccgagagucuguauuuuuagcagcacuucagaugauuccacugcacacugaguuuggaaaaccacaaaguguagaauguuauuuugguagagaguuacaggguuuuaguccggggugagauaagacuauucaaagugaucaaguuuauauacauuucuaggagucuuugauaauaacucauuucucaaucauguauuaaaucauugcagugguuggaagcaaaugccaucagacucaguccagcaaaucuguguguacagaauuuuugaacuagagaaauuugaacuauuaugacuuagucuagucuguguuuggaauuguaccaaaaugucuugaugcauggauuuaacuaauaccauaaccaaauaauauaaaaauuauguccaguguaaauucagauagguguuuuagcuucucuuuuuguacauaccucuucaaaaugagugcuaaaauauuucucauuuggaaguuaaaauaugacauaauauuaccuguaguggcaugcugaucuuuauuauggaaccacugaaauucuguuacucuccaaccuaagugugacaucauuuuaugauaaagaucacauuuuagcucucuuucauguguaaauuuggaaugacauuuggccaauaacauucugacaucuuguucguagauuguaguuaaaaauuaauuuugccuuucuagauuauaaacucuuuuuggucagugacuguuucagggcuucucagccuugcauuauugacauuuuugggcuggauaguucuguggguuuuuuuguuuguuuguuuuuggugcagaggaagucagugacuguguuucaggguuuaucagccuugcacuauugacauuuuggaccagauaauucugugggguuauuguugggaguuggaugggaggaggaauccugugcauugugggauguuuaggagcuucccucaccucugcccacuagauaccaguuguguucucucccaaucuccuccuacccccuuacucacuguuuuuagaaaacaaagugucuucaguugaugguaaaccacugccauauguuauaccuuuuucauguuagacacauagugacauucaguaaauacuaaaacagguaguauccuugagcuaaaaaggacuuuagagguugaguaacuccugacuccuuucgcccuuucccauuuuauagaugaaauaacaagguaacuagaagugaaaugacugaguaauuuugcacaucaaaguuagaaacagaauuaggccuaguauccaagaucaccaugauucacauuccuacuuaccucuagcaucaaacuguuaccauuucaagaagaaaauagaaaugaaguagaagacuucauguugaaucuuguuuuauaaacauuuaaaaucguaaaacuucaaagcuauaacucuuguugcaaauggacucuucaauuuaugaaggaauugagcucagauuucuauauaaacuauuucucucuaauaugaaaaaguaaagaauaaaaaaauuuaaagucaauuagacugaguuucaaucucagccccgcuaccuaaucaauguuugcucucaaacaaguuaccgaaucuuccuguuuuaguuucuuaaucugaauuaccuuuuuuucuuccuuacaaaauuguuugcucucaaaagaguuaccgaaucuuccugauuuaguuucuuuaucugaauuaccuuuuuuucuuccuuacaaaauuguuugcucucaaacgaguuaccgaaucuuccuauuuuaguuucuuaaucugaauugccacuaguuuuuccuccucacaaauuuguuuugaggugcaauuuuaaaauauuaacgccaguuauaaaauauucugcacauuaauuuuauuaauacuaugugugcauugaugugucagcagcuaauuaaugaagucaggaucaagaguagaaaggaaaaggaucuagcauuuaagaaucuucuaugugcuagacucagauuguguuccaucuauuuuuucguuuuaaaaucccaaccuguagcccuacgagaugaguaguauucucagaaggggaaucagagaaguaaacaaaaacauccagaguuacauaggcgauaaaugaaguuagaguccuaacuggggucauuauguguuuauaacucccgcuuuguuugcuuuuuuuuaaauuuuuguuuguuuguuuguuuguuuugagacagagucucacucugucacccaggcuggagugcuguggcuccaucucagcucacuguaagcuccgccucccagguucacaccauucuccugccucagccucccgaguagcugggacuacaggcacccgccaccgcgcgcgacuaauuuuuuguaguuuuaguagagacgggguuucaccauguuagccaggacagucuugaucuccugaccuugugauccacuggccucagccucccaaaggcuuuuuuuaaauguuauacugucauucccuuuuagaggaaucuaagacugaaguuuuauagaaguuacugucaauuaaaauuaugucagaagcgaagguuaauguuaacugucaagaagccaagggauguggguugggugauagaucuccauugucucgaugugaauacugaggucgaggaaaugauguaauaggguuaaguguggagcugggauuuuucucucugaggcuuaucaugggauccacaauaucaggcuaugaagcaugaccaguguguuuucucauugauugcauacuguauuuucuuuauuugauuuguguauaaauacauuuugauauaauuuaaguuauacaaagggauuacuaguggaauauaacuuugucccccaaucaauuauauuaguccuuauguuuugacaguuuuuuaaaaugaguuuuaauugaagguaauaagggauuuuauuucccugucuucuuaauuuggaaaggggucauuaaaaauauucguuauucacauaaucuccccaaaguaguuucuguguuuuugcugggaagaaagcagucuccauacccacagucuccaauuagaacauacuugacagaaugaaguccuagauuacagacgggcacaaauaaauuaugugcuugcucugaguuugcaugucuguucagaagcaggaccuguaucuucagaacuugaguucuuaauuguuaccucugcuguuuaugcuaccucuuaggaagauacgugucggccacuguccaggucccucuauuuaccuaucuccauguuuaagggagaaacuagaguugacaaaugaaggaaaaauuuuggauauuuucacaaaucgacugcccuuauucuugugaauugaauuggugaguugaugagaaaccaaagauuagugaagauuacuaaagugauuguuaaauuggaauucagauguaguagcuuccuuacccaagugugauaacaaaauacccuggaaacaaagacaauuauaaagggaaagaucaugugaauaauacaguggacuuuucauauacuaguguauaguuuuguaaauaucuuuaugguauaacguguguuaacugagaauauuuuauuucuucuuuccuguccugguggcguuuugucuguaaaguaguguugcauuaauuuggcauaugauuucucuacuguuuaaggucuuauuucccucuuuauauuugcuuguuuuuguuacuauuucuccuuucccugcagaagaugauauuguagcaacuauucucauuuuaauucaugugaggauuucagaauaaucuuugagauaauuaaaauuacucuagguuaucacaaaagcagaaacuccuaaaacaaaguugcuuuucgauccucuguugaccauaguaauuaauuuugcaaauacaaguuaugcuuuuaaaauuagaauacacugcaguuauuugaaaacucaaaaaacacuaaaagaagagaugggcuuuuuuuuuuuuuuuuuuuuuuuuuugagaggaguaaaugagaccuagaagaaauauuugucuuggacaugaagucaaaugagaaguacuuacguauuuuuauuuuuauuuuuuuuaccaguauaucuuuuaaaauaaguauuuuauaaauuuuuaacuauucuuuugacgugcauuucuuauuuugucauaguauuuugugcaggucacagauuggacuauuaaguaauuguuuucuaugagaaugucauguuuuuuucuuuugugugauuuuauaaucuuaagacuuaaaaacaacguaucuauauggguuguauaaauaucucuauuuuuaaaguaaaagccucauuuguuaccuaguuucucauauuuaaaaaaaauuuagaaugcuuuauucuuuuucuuaucaaggcauugcuucagaguuuggaguucgagguuauccaacaauuaagcuguaaguugaguguuguauguuuauauguguauuuuuauuaguucacucuacuuacauuuuauuacguuaauuucuaguagauucccuggaggauugaagauugggguuuggccauucuucauaggugaaguauguaauuaaaggagagggacugcuucuuuaugcuuuucuucguauuuaagcaaucauguuguuuauggcuaauucacguguuuugcuugcugugugacacgcacugugcaggacaaguauacagucauaaauuaugaaaggucuuuuacccuugaggaguucaaguguggauugugagauaaaaacagaaucaaaguugaugauacucuaaucuguagguguugaucaagucuaauaaaguguacaaguugaaagaaaugugauaauucuaaaggacuuguuuuaucaugacuucauugaauuuucucaugauuuucauuaaucuuauuuugguaauguggggagcuguggaauuguucggaaaguuauuuuuauaauaacguaaguuuaaaaaauauuuuaacaucucaaauuuuuaaauuugaguaauuucaauuuauauauuggguuuugugucgaccuuuuuccuucccccacuuuuuaaaaauguuugcuuagccucuuacuuuuuguguuaaguaaaucauccuuucguuuccuucuguuuaauuguagguauucuguugugcuucccaauuuuuccuuuuuaaaauuuuaguuaauuaggcacacagauuaauucauugguuggcuuuugaagaauuauguacguuucuagaagagcuguuuuuaaugcaucguuuuacucuguaauguuggagcaucaaguaacugucauguuguauugcuuaacauuuguuuugccucuucuaaaauacucuuauuucccuguccuuucauuuaccuuuugacagggaagguaaugagaauuauaguacuuuaauuuuccaagcucuugaccaugaauguguagauuauuuuucagaaggcguagauacaaugcaguuaucaaaugcagaguaagauauuuucauguaauuuuaauagaauacagccucuuuucuuuuguguuacugguccucuggcaagccuaaugucuaccauauuuuacaugagagcuacuucuaaaacuucucugcauuuacuauuuuauguaauauaauuuuaugaaacaauagauaaugauuaacauuaaauauuaaaacuguuagaacaauccagguuuuaauuuuuuuuuuuuuuuaaagauuaaaaggggacuuggcauauaauuauagaggaccacgaacaaaagaugauauuauugaguuugcucacagaguaucuggguaaguuauuaggaaaggccuuuacuguauguuauuaauauuugaaaauuaaauauauuuuaauagacuguauugaacaaacauauuuuaaggacauaccuagguaaaauuuauuugauuauuuacuuaugagagaagauaggauuauacagcguauccaaagaaauacuuuaaagaaagagaccaugguuuguauuacauacuuguuaaccucacauuuaaauucauuuugucuauagaagaauuuuccccagagauuuuuuaauacauuuuccagauuucgauuacguguagcaacucugugaaucuuaauuuuuauuuuaugauaauuuugcuuuuggacugccugguucagaguuuucaacaaagccuugggauauuauuguucugaacagacuugggcuuucauccauacucuuugauacucgaaaauguauuuuagauacagcuaaaauauuuuuccuuauuuaucacauacugcuuccugccagcugugagguauucgugcauuuuauacuuagaaugugacauaguuaaaacccaaaggaucuguucaaguuaccgaucccuaagguuuuacugauaaggaaacaaauuccucuguaagcacuuuuuguugguuugaauuugucguugauuuuuuuaaaucuacauuuugaugggauauaaagaaagucggugcuuauaauuauuucacaugauuaugugaaaguucuugagaauguucaagcuguguuaaucuuuauuggcuuuaaaguauaggcacuuaugaguuuaaugggauauauuauacugauagcuuuaaauagcuuuaagguaaauuaaaauaaaaugaguuuguugguggcacaauacugucucaaauuauuugagacaauucagaggauuaggagugaucuuuauauauuaaaguuuguggugcuuacuaauguaauuuucacuguauuuucuugucgaccguguuucauuugauuuccuuugugaauaaauaaauuuugaaauaacuuuauguuguaugaggggagugcuagcgggagguacugaauccucccaggauuuauauuagucauuauguuugagaaauuuuuaaugaguuuugguuuaggcuuaagaagggauucuccugauguaauuggagaugacuauuguagaugaaauuucaggagucaguucuggaguugcaucacuuacauuuaguuacuaaguauuaaaauugaggcuaggguagagugaugaugcaaugcaucauaaagaauuuugaaaauguauuugccuuucuauguucuuuuuauaaaugugauagagugaaaauuauguauuguaauauacacaccauauguaaaagaugacuaccucuucuuaguuuuugguuuuuuuuuuuuugaggcggagucucgcucuuucgcccaggcuggacugcaguggcgcugucucggcucacugcaagcuccgccucccggguucacgccauucuccugccucaaccucccgaguagcugggacuacaggcgcccgcuaccacgcccggcuaauuuuuuuuuuuuguauuuuuaguagagacgggauuucaccguauuagccaggauggucucgaccuccugaccucaugauccacccgccucggccucccaaagugcugagaguacaggcaugagccaccgcccccggcccucuucuuaguuuuuuaaugauauuuuauaauugacacgcuuaauaaccuaugacguaauucauugcucaaucuauuugcuuugaaaaaugcuuguauaacauuuuuuguuuucucuucaugagguucuuauguagugcuaugacuaucauuuucuauuuuauuuuuucuguaaaugauuaaugauaugcuuuuuauacucuuuggauuuuaaccuccauaggguacuuaaaaaguauauaccauuuaaauugacauaguaagauacaaauauucuuaaugaaguacuguauauuccugggaugguauucacaguguuuuugugaaugaucuuuugaaagggagaaaaaaauaacucucuugggaauugucuuguuuuaggcugaggauucuaaauggacaauacuucucuuuuugcccaucaaaauacuaguaaugaugguacucucugaauggauguuuugacacuuauuuugaaacugauagauuaaauuguggguacuauauuaaccuuuuauguaugugcaauaguagucauggaccacaguuuuauuauauucauguggauuuugugauauacuuaaaaugcaguugauauauuauugaaacuuaauaacuugagacaugauuaguuauaguauaaauaguaaauuauguacuuuaguuuauaauucaaguuuguuuuuuguuuuguugugcaacagggcucuaauucggccacuuccaagucaacaaauguuugaacauaugcagaagagacaccguguauuuuucguuuauguagguggagaaucaccuuugaaaguaagacuuuuuuuuaauccacaaaaacagauguauuguaauuuaauuuacucuauaaucaagacuucacuagaaacgcagaacuuauuacucugcacuuacuggaaauauuuucauucauucuaagcauuucuuauaauaaaaacacuuccuucuauaccuucugucauguuuuccuauaugaaacagaaguguguaaaaagugaguaaauguugccugccuuagcauuuuuuucuguuauuaaccugguuauuuaagucuuguguugcuuuuucaaauucugagucuuugagacugcagacuuuguauguguguauacacacauaucuuccuauaaucaucaccaucauuuugucuaauuuauaauuaaaugaauacauacaaauugaacuuguguuauauuuaaugaacuuuauuugcagaaagauaaaagcucuuaauuacguuggccuuugccuuggaaacaauuuuauuugcuuacauuucuucucuucaccuaagaggauguaagguagcacauuaaggugaugacucuuacuacauaagguaacucucauuguuuaaugaggaaugaauuuuggccuuuaauauuuuucaaugaucuuuuuucuguuuguaucuucauaggagaaauacauagaugcugcuucagaauugauuguauauacauacuucuuuucugccucagaagaagugguuccugagguaauauuuaaaauuugauuuuaacgacacaauuuuauuuauuaaauuauuacuugauuuaauaaacuaaauugugauuuuauuacuugauuaaauuauugauuuuaauaucagauuuauuuacugugauauguuuggaaaaaguaaacaugcugauucuuuacuacugguauuagauugcuuuuuauuaauaaauaccaucagauucguagcauuuagggauuuacauuagugcuucuuguuuuuuaaaauaaaaguagugaugacaagugauaccucaaacuccuaaauuggcuuacaagugguggauuauuuugcgugcguauguguguguguguguguguguguugcagauacagucuuuuuuggguccucaaacugagauaguaguccucaguaaacaaaucaauaaacaggauaucauaagugcuaugaaaaaacaaauuaaaggccaggcgcagugccucaugccuguaaucccagcacuuugggaggccuagacagguagaucacccgaggucaggaauucgagaccagcuuggccaacauggugaaauccuaucucuacuaaaaauacaaaaacuagccaggcaugguggcacgugccuguacuccuaguuacucgggaggcugaggcaggagaaucacuugaaccugggaggcagaggcugcagugagacaagauugcacgacugcacuccagucugggugacagagugagacucugucucaaaaaaauaguaauaauaauuaaggccgggcccaguggcuuacgcuuguaaucccagcacuuugggaggccgaggcaggcagaucacaaggucagaaguuugagaccagccuggccaacauguugaaacuccaucucuacuaaaaauacaaaaauuagcugggugugguggcgcacgccuguaaucccagcuacucagggggcugaggcaggagaauugcuugaaccaaggagacagagguugcaucaaaccaagauggcgccacuguacuccagccugggcgacagagugagacucugucucaaaugauaauaguaauaaucauaauuuaaaaaauuaaaaaacuguguaauaguuggggcaaauaggagugggaugggugcuguagguugauuggucaagaaauguuugucucaagaaaauacuugaacugagacuuuuacgugauaugaaggagccgugcaaagaucuguggauacaauacgccagaaacgaacagauaacagauguccaaaaugcgaacacaccugacaugaugcaggaacaaaacaguaggccaaugugacuguagugccuacagugugaugggaaguggguggagggcaguguaggcauuguaagucauggcagugcaugugaugagguugaaguuggugaagaacauggauugauguucuuguuuaaggacauuacucugugcuaagcgcagagugcguuagauagguaugcguagauccacagauaccaacugaacuuuugcgguaaucuaagaaauuugggcuugaugguuagugaggguugggaagaagugaaaggauuguuguguuuagaagauagaauugucagagcuugcugauauggaagaauagggaugaauugagggugacucuuagauguuuugguuugaacaauuggguagaggguggugguugaugaacuugaggaauuuuggagaaggaagaaguugaaaauauggagggugaaaagugcuuugaauuauucauuuuaauuugauucagcaugucauauuaggaaucuaaauauaagcaucaaauaagcaguuggacauaggggucuagaguuaagucaaggcuauguaaaagaaccuucccagacaugggaagcaauuuuuuaaggaaaugaguaggcccagaaccugaggucagcaaaggaaagugagaagaaauaguaaauuaggaaaaagagaugagcuggaagccaagacgaaguguuuuaaaagaagugaacaguuugugugagaauuuugcaaagugaucaagaaaauaaugagagaaaaauaaccacaauguguguccacauggagguuguuggugguuuucagaggaguaauggggagaaaaaccucauugguguuugagagacacugauggcaaguaagaaaguggagaccacaaguauagucuucucuuuaggaaacuuugaaugaguaggggaccuuaggaauuuggcaguaauucaggggaauuaugaaagaaaugaagggagcuuuucuuuuuuuuucuuuugaaucuauaaauuauaaaaaaauugaaauauuuuucuuuucacaaagguaagugaaacauuucauuucuuuuacaugauuuaauguuuaaagauuuuaagauuacagacuugccgaaguagguguuuaaugcuuccugcaauauguauguagauguuuaucuuauguaccccacaaugauuuucaacuccuggaggaaccucaguuucuggacaacuuaaacccauuuugguuugccaaguauuuuaugcguauguauuuacuuuuggaggggaaauuaaugucacgggauccuuagggugucguuucaccagccagaaaccucuguggccacuggcgccucugcuuggguuuugcuugcgcccacugggcuuauucuacccacucagccuggcaggcugcccuuggcucaugcuaccggcccagauccugugccugccaaggacgagcgaggcauggagcagcaagggauaugugagugaacaagcguggaaucuggccacugcgcacagccaggcaugcuggcugccacggggaaggcagcuccaggcaccugcuccaugugaggcugcggcuggaccagauguacugcaaguggcuuccacugcaagaaccagcaucuagacaaggggaacacaauggugccugaaagcucagagacgccaggaacugcagagcccugaagaggguauuacagugugucacagcccugacuuggggagccccaaagucuggguucccagaaggguuacagcucuucucuccuucuugucaccugcaacauggugacugggggguauguuucagcccuguuugcauuacagccccuucagucccuccauucagugggucccaaguucuugucccgcauccaggaagaaugagguacauggacaacuggaggaugagcaagguggagaggagcuucauugagcaacagaauagcucuuaggagacccgaguagguagcuccuuuccacaggcaggucauccggacaagucuguguuucgcuuagucugggguuuuuacgugcucagaaucgaggaagugcaugcugaaugguccauggguggccacagucaggccuggaaaaggcacgauccacuuggcugaauggucaucagugaaguucuuacuccaggccguggacuucacccagaacuaguagccuggcccccaggcuucaggccuucccuggccugaaguugggguuuuacuggggacccaccccuuccugccuaggaaccugucugacucccgccgucaucaucauaccgucuauggcacccaggcuguucaugccgaggagccagccucccucccacgcuugucaauguccaaagucuggaggaagcccaggcacuguugggagcuggcacgucagcgccgcgccaagcacacacacacacccggcuaaguugcgacaacacucaggcucggccacaacuuugcuucaaaaucagagcaggcgccaggagcagggagaguccagggagcaggagcaggcauuugugaaccugcagggguugggggguggggguggcugcuuuccaggccccggagagcucagggaugccaggguccagaaccacuccugagcagcuucagcuauacccgggagcguggggcucccaccccacgaacuugguagcagguaggacucucccgcuuguucccggcccccgcuggcuccacggagcgugcagucccugcugcgccuccccugcugcagcuggcauucgcgcagcagcugcuccagacgggcugccacugccaugaguaagaugagaaaaagaggccacacuugccaucagagucucugacagcauucccaaaagguuuuucuggauugccuuaauguaacauaaaggauuaaaauggacuagaaucugaacuucuuauacauuuuugucucccaaguccagugagccacauuuuuguaucagagaugagaauuuaugcuaagcccucaucuacaaagcuuugcaagcaguuggcacuuggagugcaccagaggguuugcuguguucuaggugcuggcaccauuugacaccaucuuaauccucauauaacaaugggggugucuuaggccaaaaucccuagaacccagagggccugggugggcauauauguagcaucuguuacaugagcauauuuaguauuuguguauuacuucuauuauuuuuuuaauugggcuucucagcuaguuuguuuaggcauucuuuauuccugaaaauaguaauauuugucaucucucuuuuuuaguuuuaaggauguauuuggaaaagucugcuaggggaaauaauaguuacuucacaauaauaugaggaguuuuacucccauagaugauucucaaauaagugcaaagcccauaauuuuguggucuucccauauuuugaauauuaauguuuguccuucagagcuucauuagcuuuacaacggguauuuaugaaaaccccaggagaugcaguaaggggguacaaggaugaauucagacaauuucugacuucagaauaguuacagaugaaugaaggagauugacaugcagacuguaacaguaauagaagaugguugaaaaaaacacacgggagaggaagagagcuucagaauaugugagacuagauggcugcaagauuugagacuguaucauuuguguucuaguaagaacuauucagggauauugaugaaagagggaggugcugaauguugaaaaauacuucccaagcaucuguguggaugaguugccaagagcaggugaauggagcaugcuugauuagagccuuaccuaagagcucuugcacugcccuuaaaauuguuauuuucauagugcuauaucauuuuuuaauaguaauguaaccaaauaauucuguauuauuuucucuccccugagaugugccucccucccuuuuuaauuuuuccaggauaacugucuuuauuuuauuguuauuuuacuucauuaucuacucauuuacuuauuugucauuauuuucaguauuaacaugcucauguaauaauucuuuguggcuuacucaaauuauuugucuucugauauuuguuuucuaguauaauuuuucucucaaaguaaguacagcucagcuauaagcagcugguacuuucugaaugaucccuuauuacuacuguaaguggcuuauaaagcaguuuacaguuuaagcagugcucucaguuaugguaucugacauaacucuccuaauuguucugugagauaggcagucucagugucuuuauuccacagaugaggaagcagacuccccuagguaaaguggcucauuaucacacagccagugagugguggggaaggacuuaaaccugaauaggcugguugauguuuaagucuguuaucagguaagaauaauccaugguuuuuacuauagcaaacaggacauuguacaaggggauauauaaaaagauucagauauacuucuuggaugaguuugggauugacuguacucuuuaacuguuugugacauucuuuuuuguuauuuuuauguguguuugaguuuucugguaucucaagacuuuugaaauuauaguuacuaauuagaauuuuuuagugauaaaaguuauuuaaacuucugauuuuuugcaguaugugacacuaaaagagaugccagcugugcuuguuuucaaagaugaaacuuacuuuguuuaugaugguaaguuccaaaucuuuaacucauguaaaacauuuuaaaauuaaaaugucuguuauacaacuuagguguaaagauuauguaaaugcuucuacuguucaaugagaauaacaguucucaugacuugaaugccugauguuuuggguuuuuuuucacccuucaacuuauaauuguuaguuauuuuuauucugagcuuuaccuacacaacauucuuuuuguuguuguuuguuaaauuauaugcguuuuugaggaauaaauucuaugugauuuuuauacauuacuuuaaaauguucagaauucauuuuuuugaaguaacauuucagauacagaaaaagacuugaagaaauaacacguguucaauaguguugaagccccuguguaucccucccuaauggcauuuccccuuagcuguuagaaaugacugcuuaccugcuauucagcauuucuucauugacgcauaaugcuuggucuguuuuuaaaauauuguaauuguaauaucaaacauacaucguaguaaagagaaugguaaagcccuacauacccaucaccgaaguuaaacacuuacgaagaucuuugcccaucaugacauuugcuccaacuucaacuuucaauuugcugaaguacuuuaaagcaaauuguaauggcauuucaucaccaugugcuuuauauuacgcaucucuuuacaaaauguagacuuuuuauuuuuagauaaaccacaugcagcuacaacaacugacaucauuccuugguauuuugaaauaccuacuuucguguuuuccaaaccgugcucugaccuagggcagugcagcaaacucacaggggcuacaggggauauuuuaaauuucaagggaagcagugaaacucgacaucuguaggccaccacaaagccacucaaaagcaaaagugaaugcagacucagcugauagcauuccugcuaacauucuaaauucuaauucaauaaaauuuaaaguucaauuucuuguucucacgaacuguguuucagugcucggugggcuccuguggcuugugguuaccauguuggaggccagauagggaacacccauucauucagaaauauucuagaauguguuuuucuuacugaauucuaugugacagaaaggaaccuaggacuagaugagagcaguagaguuuuaauugcugaaauaauucaaaugaguagaagacuuuucaauaaaaaggaacaauuuguuuuauuauaaguagcauuuuaauuguuuugacagucauaagacuacauuucugauuuuuauugucuuuaaauaaaugugagagcugaauuuuauuuguuucuauagauaauaacuacacacuuaugcugucauauaaaagguacuaucuacauacuugacauuuucauuuuauuuacaaaguaaucugugagguagguaauaaggcagauagauuaauaccccaggauuacaaaggauauagcuaagaauguuagauaaggagacagguguguaauuaaauagcagguuuaucauaugcuuauucagccauccauuaauuggauguuuauugaaugucuguauuagacguugggcuuauaaaagaacuucagagaaacuuguguauuugaaaauaugagaaggaaaauaauuuguagccacaccuagucuauucaccugcucuuugcuugcaguacuccucauauaauaaguacuuaauguaugugaucuuauauuugaucauuacaacauucccuuaaaaucacuauucuuaccauuuuacagauaaagaaacaggauuaaagagauuuuuuuuccacgauaaaauaaucaaugauaucaaaauucagucuucaaaucucauguucuuauuccacuauguguuucuuagcaauucagagaggcacuuuguuucuuccuuuaaaaaaaaaaaaacacugaucauaucuguuuaaauauaaacauauuuaaauauaaacagauaucagguuuuugagccugccuaggaaagcaucccccuguuauagcucaguguuucagauacauucucccacgcuuaaggaagacaggaauaugauauguuaaguuucuguagguauuguaaaggccccauuucucuaaccugcaguaguauuuagaaccugccugaaacauucagacaaagcaaaggcuuuacuuugaauccuuauuuaaauauuuaauuguugcuaauguuuagaagcauuggaauagggacuugggaguauauuuccuuucuuacauauauaauuucagcuuuuauuuuagauucagagucuacaugugcagguuuguuacauggguguauuggaugaugcugagguuugggguacaaaugaucccgucacccagguaauaagcauaguacccaacagguaguuuuuuuagcccuuguccuccuccccaucucccuagugucuguuauucccaucuuuauguccguauguacccaauguuuaccgcccacuuauaaaugagaacuugcgauauuugggauaguuuauuuucgaaugaaauucaaauugaucacuguaugcaaucucguagaaaauuugcuuuuagcaugcaguggacauuguggcccaguaaucaauuucuaguuuuauguuuauuuuccuaauuuauaaauuuaaaucaauaaauucuuugagauuugcauugcaucacuuauuuuauggguuugauaacuugaaaauguuuuguuuagcaaugcaagaaaaagcauaccuuugaagaggucauuaaaauccauucuucaaccagauguauugguaggcuuuuauagacauuugcuuuacaucaccaccuuuuuuaugcaauuguaauaauuuugaacaauuacuugagaauuacauuucuaauuaggauguaauauuucucuuagauauuauauuuucuaucugcuuagcagaggaauuauuuuauauuggaaaaaagcuaagguacuaugauuuuauauguguuuguguuaguuguaccuuugagaaagaguuguaaacuaggaagacuaucauaaagagaggagagcaaagaaauuguaauaaaaauuaccuguagugccaugacccaaguauaaccauugauucagggaaaccauuuaggaauaacugacuucauuuuaucauucuaugaguuuaucuuuucauacuuucuuuuacgaaguuacaguuaugcuguuauguauuguauuguaaccuguauuguuuuguaaucuguucaauuauaaguuuuuuugaaaauuuauaaaugaucuuuaucgacauauaccaaaauuuauuuaaauuauuuccaauuuaggauauuuugauuauuuccuuuauuuuuaauuauuuuuaugcuauuuuuaaugaugcuauaaugaagauugcuuugugcauuaauccuucuguacauuugauuguaugcuugcaauaaauuccuaaaaacaauauuuauggaaguaugauucucugucaggcguuuuauaccuauuaucagauuaaagcuauuauaacucuuaaauucauauuuauacuguaauuugucaacuuugucuugguuuuaagaguaugaagauggugaucugucaucauggaucaacagggaaagguuucagaauuaccuugcuauggauggcuuccucuuguaugaacuuggagacacagguaacaagcauauguacaagucuccauuauguuacaugauuuuucuuugauuauuuaaaaaucuuauuuuguaggaaaugaauuuaagcucuauuucucaacuuaauuuuuuauuuuagaucugaaugccaguucuuuacgagaauguaaacugauauuaccagaagauauaccuuugcaugugggucagugauuaaagagaugguuuacuaauagaacugauggugauaaggaaaacaaaaagccuggguaauaagagagugagaaaaauaaccaacuaagaagcuguacucagaacugauuuuguaauaggaguuaaaauaaaacuuagcacaaccuauuuauaaggccugcuuuuaccugugaaagggaaaaauguaaguuaaauuggcaugguuucuucaaguuacgcuguuggaaaugacaggcaacgcaaacacaaacacgaauacaaaaaugaaagcuguaagaagccgauuauauggucucagaugcaaacuauaaaaauaagaagcuaacuguaaguuuuaggagaaaguguuuuauaaauuuauagcaaauuagaaaugagaaauauugguuauuggugccacauuuguuuccauuaauagcuuuaugauaaguaggauggaaguauagcuuuugaguaaaacaaugagaacauuuuauucaagacuuauuuuuuuuuaauguaaguaauaggcauaggguuuccucuucaugauugccuacucuuaaaucuaauuaauaaaaauuagagacauucuuacauguucuccuguuuguaacguuuugggggauauuucuguucuguuccugagcuugcuuuuaauguucugugucuagugauauuucugccuuugcuuaucuuuacagaaggagcuguguauuagcucauuauuggaaguugccggggacagugucaaagacugugguuuuacuuucugauuuuuuuuuuuuugagauggagucucucucugucgccaggcuggagugcagugacgugaucuuggcucacugcaaccuccaccucccugguucaagcaguucuccugccucagccucccaaguagcugggaaucagcaugcgccaccacauccagcaaauuuuuguauucuuagcagagacgggguuucaccauguuggccaggaugggcucgaucuccugaccucgugauccgcacgccuuggccuccuaaagugcugggauuauaggcgugagccaccgugcccagacuuuuugauucuuucagacucacaugaaaggaagagggggaaauguaggaauauaguagucuugcuuuguauaguaaucauaggaaauagcaugaccuugaggugauuaaaacagguggcuuuggcucaacugaacacaucuuuucccagaugaauuuggaaacagaagugugcuguggcaguguuauuuuaugugucugacauaauugccccuguuaggcaucagcuguggucgugccccugcccuucacccccaccuguccccugaugcuagcaccauagcagccuccugacgcugugcggcuucagacaccucaugucuuuucucagaaguucuaacucuugccuacaccuccagccucauuucacucuagccucacacucuuccuucuugagccacacuaaccuuuuaguuucuuuuauuguuauuacuauuauuuuaucauuuuuacccaaguuugcuugauaccaguuucuugaaaaggcuaugccaauugcaccaaagcacguuuuuacauacuuuuuucuuugcuuggaaauacucaguuaauucguauucauccaucaaacucagaccaaauacugcuuccuuaggaaaaucuucacugaccucgucagacuacauuaauuuaugcuguaauuuuuuuuauagcagcauauucuuauuuuuaaugggacauuuauuugaugaaaaugucuaccaguucuauuguguugugcuuucacaagcgcagagccuugucuguguuugcucaucaccauguccucggaaccagcccagugugugguacauuauuugacacucaauaauuguugaauuaauaaaugugagaaacugugucuguguuucucagaauccuguuggucuaugggagaaugcucugcauguuguagacauuuugaaaaaaacucacgaaccauuugaaaauuaaagaagcauauaauacaaaaaaagaauagcaaacgagauauuucaggaagguagaugucauugugaacuguuuucaucagagaguuagaagacugaagguuguguagaauuuagacagguguuuaagcaguauggaauuagaagcagcauuaaaaugcagggauaauacugaaagauuauggauuuaauccuacauguauguaccugcucugagccagguuuaugcccauauuucugggcaucuaaucuuacuuaacucucccaauaacucuaugaaauauauauuaguuuuuggaaauaaguugaaguuuacugaggcacuucccuguuccccuguggcuugguauggugccuagaacaugauagacacugcuugauggcaguguuuggcguucugauucuaacaccacucuucugguuauuacaucaugccagcuuccuagaagauaucaggauacauaugcuuuauguuguauuuaggguuaaguaaaugugagucaguuuaauucugcauauuauaacuggcaaguacugaaccaugguaccaaagucaacggccauguaaaaaccauuuucuuauucuucuagaccauuguuuuagagcuacaguaauucuuagcaaacuugcuuuuaaucaacuuauuuccugugcuuuuagccuuugaaaaaauaguuaucuuagccaauuuguaggguguaaggaaaaaauacaauucaagcuuguaaguugguauaaaaaauacuauuuaaguguauaaauuauuacauauuuacucuuauuuauauuuuggggugggacguggaagggaauuugucacuggaguugacuaauucacugauugacucuacaaacauauaccguaauguguugauuuaauuugauauaacauguagggugauuggaauuaaauucuagaaauacuuuacuaauuuccuacucagaacuaaagugauaauugaacaguuuguguaauaagggugauugaauucagaugugucauucuuuauuucaggaaagcuuguggcucuugcaguuauugaugagaaaaauacaucaguugaacauaccagguauaaugccuugauauaguuuuaagcuucaaauguucauuucagacuauauggcuuuagauagacuugauaugguaucuuacuuuuccugcagcaauuagauguaagacagcagauacuaucauugaaaaauuauguuuuucaagugcagagaugaacuauucauauguuuguucuucuacagauugaagucaauuauucaggaaguugcaagagauuacagagaccucuuccauagguaggugcuuauauucugagagauuccuuuauuuuuguuuaauaccauuuuguaauuuaguaaagcaaacuuaguaguauucaugcuuuuagaggugaaucaaagaaaugaaguuaaauaacaguaauccucgcuuauccacaggagauacauuccaagacccccagugggugacugaaacuuagcauagaauggaaugcuacauauacuauaauuuugucuguaccuacauacuuaugauaaaguuuaauuuauacauuagguacaguaagagaucaacaacaguaauuaauaauaaaauagaacaauuauaacaauacaguauaguaaaaauuauguauauguuuauuuuuggaauuuuucauuuaauauuuucagaccaugguugaccauggggaacugaaaccacagaaagugaaucuauggauaaggggggacuacuguauagcacauugcauuuuagcgugaauugucuggaucuugaaauucauugaugguauguccugcaagcuaaaaaaagagauacuuugaucuauaauuuguaucauaccugcuucuugauaggauuugagaugcguuuuauguaaauaaaauaugcacauguacuuauaauuggacauaaaugacugaucagaagucagagauaggcagauaauuauucuaacagaaacucaaaagaauaacugaauaaaaaauggcaucggaaauacauauauuuuuacuuuaugcugaaucauuguugcuaucauaaaaaaagacagucaauauaaauauauuuuauuagugaauuauuauuucuuuccuauucugaaucuucuaaugaugggucauuguauaguuuucuuacauaguauguagcgucuucugauuauuccuuuuuuuagagaaaauaggaauuuuucuuaaacauauuucagguagaauagcugauauuucccugaauuuuaaauaugcauaaaccaaguagaaaugucuuagaauuuccucuacucguguauuuguaucucagaagccaguagaauuuacacuuuuagcaguguuuauuguauaugauuuacaugugaaauguuuacaguuucugggccuacugaggccugaauuuaacuucauuguuuuauuuacuuuuuuacuauuuaaugagcuuucucucucucucuccccccacccccucuccuuuuauuuauuuauuuuugguugguggugguuagggauuuucaguuuggccacauggauggaaaugacuacauaaauaccuugcugauggaguaaguaaagugcugaaugauuuugcugucaaaucuauuaauuuuuaaauuuguuucugagauacagguagaaggauuaaauagcugaaaaauagcaaacaguugacauauucagaugcagauauucucccauuaaauauuuuacuuuaguuuuccaauucuguauuuggaacuuaacugacuuuaauauuggucuauaguaaaaaaaaaaaaaaauuaucuccugauuuaauguuuucuaguauucugaaaagccauuauuccaaaacguguaaauuucauggcuucuacuuaaugcauaccuugagaaguucuguuuuaaugggcaauauaacuauuaaauagaaaauguuuagcauucaaaaacuaauuguucuagaauuggauagacuaacuuuguaagaaaauaugcaauuuuaaaauuuuuaucuguuuaaaauuuauauaaagacuauuacauagaaaauguuuagcauucaaaaacgaauuguucuagaauuuauuugaguagacuaaauuuguaggaaaauauguaguuuuaaaauaauuuuuaucuaaaauuaugauguagagauuuaauuugccacuucacaagacugauauuagaaaacauuuaccaaacccuguacugaauuaauaaaugugaaacaagaagccacucuauucagugaacauuuagugaguauuuacuguauguuguacacuauauuagacaccguugauggaaaaaugaauagagucccuuucuuuaaaugcuuacaguccacuggauaagaccacagauguuaguuacagaacuguaugaaaagaucuauguaggacagggcugggagagagauacuuucccauccucaccuuccccaccccgccaccugcacccagugcacacuaagguggaagggcucaggaaacauuuuccggaagaggcaauaauuaagaaaacgucuaaagagugagaaguuagcugaaugaagaacacagggauaguauuucaggcagaacauaauagcaaguaugacagguaguaggaaaacugggcuuaggagagugcuagagagauaagcuagucucuaaaugaagauggggaaaucucacuagagacacacuaacucuuagccucauugagggcccaguggaagcucaacaacaugaugcugugcuuugguuuucucuagcuuugcuuaguaucauagauguagcaaaugccuucauuuguuauugcaauguauuagguuauuuuggugucuucuauuuucuaaguaagaacacugagcgaggaagggagugaacuuaacaaaucugaaguaacauucaucaucuucagcuaaaucuugaaauguagcaucaccuuacuucauuuauuaucccucucauuucaguaagaacuuaagaggauuugccaaagauuaaaguaccagauguaggauauaaugaagaaucaagagaaaaaaaguaucuauacaauuauuaaagggacuguugaccguugaacaacauaaguuugaauugugcagaccacccauaggaauuuuuuucaauacauauguuauaaaauguuuuugagauuuuugauaauuugaaaagacuuaaagaugaauugcguauccuagaaauaucaaacaaauuaaaaagguaugucaugaaugcauaaaauacacguaaauacuaggucuauuugaucauuuucuaccauaaaauaugcacaaauguguuaaauagcuucuauaauuauggcuacugagauauaaaugaauaucagaauacuugcuauugcuguguuuaauguauauuuugauuuguuuuuauauuuucagugaauugacagucccaacuguaguuguacugaauacuucaaaccagcaauauuucuugcuagauagacagauuaagaauguugaagacaugguccaguuuauuaauaacauuuuggauggcacaguagaaguaaguuguucacuucuguuucaaagagaugauggacaggggguagaggagaaacuaguucauuucuuuacuugugauucugaaaagaauaguuggccaucacccggaguagagggcuggaccuccauacauugcuucuguccaauuauaggcagaguagagguacauucucccagauacagaagguucuucuguggcagagguugcuaaagauggaaguguccuuuuauggguuauuuggaggguauuuuugguugucauggugauggggaggggcuguuggcuaagguugaggcuuagggaugcuaggaagucugcacugugugggguaaucuuaauagugaacuugccugucucuuaguauguuucuagguccaaaaguacaauuggauuaagucguuaggauugguuuucuaagaaaaucugcaaauaagaugacaauuucucaagaaaugaggaaauuuauugagaguaaaagcccccguggagaguucuagacuuaauccuauaaaauauuucucagaaauaagugaauagucuuaauuuucuauuuuuuuccuauaaauuuuaacugcaguguuuuucaaacugugaauugcaaccuauauuagaaagucaugaaaccaccgcaagucacaaucagguugugaccagcaugcaucuuaauucaauagacuaggauaaaauuuaaaagaaagcgccuucauugcuuuugugaaauguaauuacuaguuuuugagaguuguuucaguuuuacacaaacuuuauuuaaaauuugcuuacagaguaacaaacauaacuacuuucggucaaggugaagaaguuugaaaaacagucaaauaguuaagaauauuuuugaaaauaauuuguugaaaugaaacucucaccuauauaaauaaucagccuucuauuuuuaaguuaguggaaugcaacucagacuauuuaacaacagauuuuauugucucauagagcuuggaaauuuaaaaaaugagccagauugcagguauggccgaauauaggauuugagugauuuucaucaggaauuuuucacucucuucccuucagcacuuucauccucagggaagcucucccugcacaguagcaaagguauccugcagcagcucugguuuugcggucccagcuaaacucaaaagcugguuaggcuguccucagaggugggucagcuucagccaagcuguguggguuaugaauagaggaggaggaauuguuuagaguagaaucagggugaauuaacacaagcaggcaggaggaaugcuggacaugacacagacaaaaaacaacacaguaaauguuuaccacauggccuuuucaggugauuauguaauauuuuggagucaaccauuuggccugcaauuguaagguuauguaacaccaaguaaaugaaguaauggugcuuaaauaauuuauuuuucuuuuccuuuuuugaaggcccaaggaggugauagcauuuugcagagauugaaaagaauaguauuugaugccaaaucuacuauugugguaaguugugacaguuuaugucauugauaaugaagaagauauagguucuuuaugucuagcuguguuaaaaaucugaauuugaaaagauuaggucaaaauaugucuuuuuaauuugcaggauaugacuagucaguauuuaagaaaauauauucauuagguggaaauuguuucuaauuguuuauaugauugaugaguuaaaacuaaaauucagaaucaauuaacuugauaguauaauuuaaaagauuuuauuucugcaaccugccauguaaaguuuuuacuuaguaauuucuaugauuuguugaaagugcagauaauaugaaauuuuuaguuccauuacgugcugucuucuguaaauuggucauuuuuguuaaagaaaaugaugugugcugggaagucacuuuuuauuuugcaggagucaaaauaaaauuuuagaucuuacaauuuuaaacaucccuguuaauucuguacuuuucccuaguugguaaauaauuaagaucauuuacagauguuuuuccuucuucccuuuuucucuccuuccuuuuuuuuuucuuuuauucuuuuuauagaacacuuuaaauguggaauuaaaaugugauggaucaaauccuuucuaacaguguuuacuuucauuuguuugucccaguguuuauucacaguuguuauauguaaguagaauaucaacagugguagacgaauugacaugucugccccuaauuacccgucucucuuguuuuuauaauuauacuuucuaaauauauuuccuugacuuucuucacugucaccucucaccugauuauuucugcuauucuaauuuccucuuccuuucacucuaucaaacuaaugcucacucugucaaacuaauuagaucuguuguauuuccccuggauuucuuugaagcauccuuuccuugacauucuccuuuccgugcugcugugaguaucacuacuccccugcuccugccccaucucuucaguguuuuucagcaucccuuuccucccuuuccccuuugcagucccugggucugaaccuucucgcuugacacucuuacgaaauuguucucccucucccagcuuuaacugucaaucaacuugacagcagaggaauucuuaaauuuguuugagcccuaaacuuaguuccuguuguccuucucgagcucuuacaugggcauuuucauucacuguggcccaaagcaaucauaaaaauauagcuaacauuuuuugguuagaaguaaauucugggacucuuuguuuuuuuccuugcauaguauucuucaguuugcuuuacuuuccuguugccacgagcauggauuaggcccuaaucacauucugucuagcugcuggucucuuucaccugguuuccauacuuccacuugcccagucuccaaucuauauuauauuccacuacacaguuaauauuacuaaaauaaucgauuuugaucacuuuccuucccuuuuccagggacaucagaauacucuguccaucuaaaguauuuuccucguugguuuuugaauauuagcuuuugcuagugcaaauugccuggugcucacuugucccauauccugccuccuucucacucauccuuaaauuccuaccuaaaacacaccuuuauucugugaaacuuucuuuuauuaucucaauccaaagugaucuuuuucuucucugaacuucucuauguucucaagaguuaucguugcaauucaugcaguauauucuaguugaaaacccuauucauuaaaauuacuuuuacuuuccugggagcuaugaagacaguauguaaauugagggaaauuaguaagucaaugaaguuuuacuacuaaccagauaaguaaaaaauauuaaaaaugucaugugaaaagaguauguguguaccuucuuugugguaaauaacccagccuucuccauaagcagauuccugugguucaggaagcaacucuaaagcugcugggcgcacauaguaagcaccuuaaagagaccuuugugguuaauguagaaaaaucagugucuuuaggaaaggcuguagaauauuugaugccuuuuucuguugcuaauagcugguucugcacacacaugcuuauguaugugcauauagaaauuauaucucuuaacagugucuuucacaugguaguuacugcugaaaugauugauucauuggaacuaaaaacaagcugaauagcaacaagagaaaucuauagugguuucaaguucauuucaugcuauauauaucagaauuacaugugaagggaacugaguuuuaauucucuuuccacagucuauauucaagagcucaccacugaugggcugcuuucucuuuggccugccacugggugucaucaguaucaugugcuauggaaucuacacagccgacacagauggagguuauauagaagaacgauaugaagugucuaaaagugaaaaugaaaaccaagaacagauagaagagagcaaagaacagcaggagcccagcaguggaggaucuguagugccuacagugcaggagcccaaggauguauuagaaaagaagaaagauugagacuugaugacuauaaaauauuuguuaggacuucaaauuauuaaagagucuauuuauugaauuuagacauuuaaucaugaucuuuacagaaaagaacauguuauucguauuuugcuaauaucaacugcauggauuaaaguagucccuccauacauggggaaguguuuggagcaaagagaugaacaguuugucugaaacaaacacagagcacuccaucaaaauuuaccugaucuuugugauuagaacagaacaauucuauuugcauguuucucuaucugaauauucugugacaaaaaguuaagauucuugggcagaauauuuaaauuggucagucagguagaagauacaugugugauauagaaaaauaaugccucuccugcugccauccguuucccucauauauuuuggacaagauuuauauggacaaaauuaagucuuuaaaauuuaggcacuuuaaggagaacuaauaacuuuuuccauguaucaagauuaugagguuaaaaauaaugugguuuuauauagcauagugguuuuauuuuguuaguuauuuuuaaaggagaagaaauguuacuuuuuaacuuuauacucaguugcauuaucauaaaauuuucauauaugccuagauaauggggaaaaaaagucuugugauugacuuucgcaaaauaaacaggauuuacugaguagagguuucagcccauuccuuggaauacuaacagguauuucaucagucauuguagguugggaagggucucuguuaauccuacucugcuuuagccagaauagccuaguauuuuauuucuauuuuauauauugagauuucuucuaacauuuccuuugauaaaaaucuucugcuuuuugaaaagugguauguaucauauuuuuauguuucuggugugugaacuuuaugguaacuucuacucuagaauacguacguaugcacccacagacacacacaguuuauugacacaucuauuauguaaugcuguagaccuguccgugucugcuucauaaggaguaacgacugacauuagcauguccagugacaagucacauccgguguaaaaaaaagagaucagccaguuaccuucuccauugucuuaguucugucacccauuucgucaagugaccucucaucuucuauaaacuaauacaggaauucuuuccaaagcaaugucuaaaaacucuuuuuuuuaaaguaacaguuugguauguuuauuguagauaaauuauuuuugaggccuucauuuuagcuaaguuuagaauuuauauuaggcaacuaugauuugagugguuauucauugaguaauuuuccacuauaaagaauuuuauugaacauuuauuaaaaaauaauguaaugcauggucaaaaaauauguaauucauggucuggacacugacguuguuuagggauuuagucaucaaggacagcccucuguuguuucuaaugccguacuaaucaagacuguauggacacuugcaucuuaaguacuaaggaauuacuagugauuguuuuauuuuauccauguacucuuuuaguauuuaauaauuaaauaccuauucuuaguguuugacacuccauauuucuuuuuuuuggaaaugaaacaaauaugcaguccaaaauucaggaacuacuagagugaaaugauauuaaguggaaaccagagauaaaugcuguuaauuuaacaaguagauucuucuccaaagaaugaugagugauucuugggaagauaaauguuaauguucccaauagucaagcuuguuuugcaguagugaaaagcuuagaugaguacggauaccucauuugaaacucagccuaguaaggaagugaaaacuuagcagucagugacauggggaaauaguuauagaaaaugucacugaauuuuuucauauuuauaauuagucauuuacauauuuuugucuuguugaucauuaccuguaaaugaaagaccuuaauaggaaaaaaagaguaaagcucagugugaaugcaaacauccacaaaauaugaucuucguuuauauucugugauguuguuuauaaaugaaugccucaguucucugcuacccuuuucacagcuuuguacuguuugccuuauauucuauuugugcuuuuaaagugugucuguugggaaaacaaaauguguaggugguuuguaagugaauaauuuuuauuucuucuuguauuaaaauuuuguuuuuuucucuacuuugggagauguuuauuuacauugucagacuauucacaaaacagauucuaaaauuuguuugcucguaugcuguucccuucaaugugauaucagagauuacuaugaauguuaguuucauuccgugaaacauuacuuccauauaaagacagaucucuuaauaagugaaucuaguggaagaacauagguaucauucuaauuccaugguaaauuuugucaugauucuauaugaauaaugggguccuucaggaaguuggaauuuuugccuucucuuuuaauugcagugaaguucucuuuauaacuucuaaaauucggaauucuagauccuugcuuuugcagaauuuggugcucagacaauauuuaaggacauuucagcgagacaaagugcauguuuuuaucgaguacccugugcaccacauuauaucuggcaauucuuuuuguuucauuaugugcaucaauauuuuucucagcuacuauuaccugaaacuuguuuaacauguauuagaccuagaauuuucauuuucuuucucacauaguugcuuccugguaucugauuuagaaauaacauuuaaaugccaaguaucugggggauugaaggaagggucuauaugagcaggugaauuagcaguacuguuuuuguuuaguggauauuguuagugacuuuuuguguguguuuugcuuugggaccuuuuuauuuugguguugcaaaaaguaacauauuuucaucauugcuucauacgacauggaguuaggacagggaaaaaucauucaacacuccuuaugcauuaaaugaucaaauaaaccaguguaggauauuaagacuaucaauuggugggauuaggcuugacauuuuauuuuuauaaauauauauuuuuucugaaugugucugaguccaagagugggcaaaaaauaauuuucuacuuuggacuaaucuauagagguuuuugaaagucugcauuacuaacuuguugaauucaugauauucugccuauggcacaaauuguaaaccuuuguuuuucuaaaauaaaguaauugaaaaccugcaauuguuucuuauuuuuacuguguauccugguuguuugcaauaugaauaguucuguguacaaagacaacagcuacgaccauaucuuccagaaaguguugcuuuuauuaaaauuauaauuguagaaauauagaauuuuaga

SEQ ID NO: 18628 - RNA, 512 nt, Homo sapiens
uuauuuuuuuaaguuuaaguuauuuauuuaagccaucucccgccacaagcaaagggaugggagaccaguauaccagucaucauuugauacaaguaaagaaggugagcuuaaggucccauauacuuuuucugguccaugugcagaguaaugguccaaaccagugcuguggucccuggugcccggguagugguccagauucucuuuauucaucuucguagccaguuggaaguggauucacaugaggguuauggaauagaguaugguuaccaucuccccagggaaacggcuugguccugaugcggagauggggguaggcgaugaacucgggucucucgugcucuccguggugcgacuucagguacacauucagcaugcugacugccaccccggggagcgcgacgaagaaggugagggucuuccacaugcgagcugagcccucuucuccaugggcgccacucgacauaggccgccccagcugugggcgggaccgacccagcagccgagaaaccgag

SEQ ID NO: 18629 - RNA, 1557 nt, Homo sapiens
uuugggcgcuucgcugauggugucggugagcgcguuucccgccugagcgcaacuagcggcgggucgugggcaccuccagguaauggggguaggggaggcgccggagcaggccgcggcgcggggugugcgaggcgcgcgggcaggcgcggggccccuccaccuggccucagcggcucagggagggaacgucccggccccucuccccuccccccccggaauucgucgcuccgcgggcccgggaggcgcggcgccgaguccuucccggccgcuccccguccgcuccuguuagccgggggccccgccaggacgggcgccgggagcgggacgcggucggggcggcgacuuugugccucguugacguucgcggccuggcgcggcgggcgggcgaggcgcgccccugacccggcucuggcuccagccuucccgcccgccggccgcggcccgcagucucgccccccgcccggcccgcgcccggucuccgcucccgcugggccucccgggggccucggggagcgcgucaaguugaggcagcaacucgccgucaagagucgcgaagaccauuguuggacucugcucuucgggaaacaaguuuuguggguuucuguuaauucgccgcagagucaucgggauccacaccagccaguuccgaggcucccaguacccuucccaguggcuuuuuaacuccugugagguggcuuguauguaaacugucucgaaugccucccugguguauuugagccggggguggggggggugggugguccuucuuguggcuugaagucccucccucuuaaagaagcccauucacuguuuacuuggagguguuuccuguugagguccugcuggcugugaucacaauuuagacuuuuuaauuauaggugaacgggaugggucuuuggauguaccuccgugcccugacguuucaaccgcgugacuuaaugucauuuuccugguacuucacguuuucucuguggggcuuugggucuguuuugcuuuuaugggagggggugcuugacaggcguucccuuucauccucgcagcacuuguugacggggugguguccuuuauucgugggacguuuacuuugauuuuguccucaaggucauguugcagauaggcuucaagggggacagggacuccagguuuccaaccaccgaacugugccucaaguagcaaguguaugagacccaguuaugguggugguuggguuuuccucacuguggaguggagucagugaccacuuuuuagcucugugaccuugggcaaguuacccagcuucucuuuuuuuuucucuguaguaugggaauaauaauaagugucccagccauaaguuugucaggauaauugcccuaauacauguaaaacagcuagagcugugccuggcacauacagucaccucaguggcugauuagugguuaggcuaguuaauggcuauuauuguuuaauuuaaauuugauuuuuaaauguuuagguacuauugggaagucagaugagcauuugagucccgacucuuggugacugccuuuagaaagcucuguguaagacucaguugggcug

SEQ ID NO: 18630 - RNA, 9421 nt, Homo sapiens
gaccucugucugagugcuuccuuaaaagaaacugcaguagaaguugcugcauuggaagucguuguuguuuuuuguuuuguuuuuuugagacgcaguuuugcucuuauugcccaggcuagagugcaguggcucaaucucggcucacugcaaccuccaccuucugguuucaagcgauucuccugccucagccucccaagucgcugggauuacaggugcccaccaccacgcccagcuaauuuuuuuguauuuuuaguggagaugggguuucaccauguuggucaggcuggucucgaacugcugaccucgugauccacuagccucggccucccaaaguguugggauuacaggcgugagccaccgcacccagccugcauuggaaguuuugacauugaaagcuuugauccauguugucguuuucccaguggaaugaaugaucuauugaauucugcucuuuuugugccucccuccucacuggaauuuuccuucaugccuuucauaaggaauguggacuuuuuuucaaacucuagaugcgucuguuacuagaguggagagucuaccuucgucucacaugugccacaaaggauggcauggcccgggagugccccaccacguggcuuucacccccugcaaagccagacuucgcccagcgacacagugucaagcccacagcucuccaaggaggaagaugguccaggcugggagcauccccuuagcagcagccucugguaaguguccuggcccugcaggcugggccugcuuguugggugaugggacggugagcccagagggagcuuugcaagaucaucagagggucaagggaaaaggaaagacagccaggccuuauaguaaccaaggaaggcccaggcccagucuguggcccuuaacugucagaggcccugccuccauuuuuuuuuguuuguuuguuugagacaaugucugguucugugguccaggcuggagugcagaggugcaaucuuggcuuacugcaaccucugccucccagguucaagccauccucccaccucagccucucaaguagcugggacuacagaugcauaccuguaguccuggccaauuucuguauuuuuuguagagaugggguuccgccauguugcccaggcuggucucuaacucaugagcucaguccauccgccuaccucagccucucaaagugcggggauuacaugcaugagucauugcaucugaucaggaggccuuaucuucugaguggacuggggugguggcccaugaacaggauggggaucacgcaauccccugcaacccucuucggcuucgugacacaaaugcaaguuaccucaagagguucucccugaccuuggugaugccgugggcacucacagaagccuccucugugcugcagggaggcugugucuuacucaugcagggugguggaggggcgccucuuagcagaagaugaugaaaggcuguccccucucaggaaggagaagguccuugucuguuccaaggcaaagaacuggacaagaaggaggagguucauucaguacauugagucugauccucccugcuguagcuggagcacggucccugaagcuggcugaagugcuaaagcaggggcuagcaaacuguggccgaaucccaccugcugccuguuuguauaaauaaaguuuuauugggacacaaccaugcccaccauucacuucuauuccagggcugccucuguaccguagcggcagaauggaguagcuaagacacagaccaaauggcccacagaaucccaaauauuugccauccuguccucuauagagaaagugugcugaccccugcccuagagauuuguagugagggggcagcagaaggccuggggcugggguacauucaggagccgagacccucuucacccauaagaagccccugccacaucaucucaccuuuaacucacccagaggaccucaaaucccgggcucgggccuggggaacauaccaggggugguagcauuuuaaaaacauucgguagauguuacuggcccaagagagagccauuuaaauacucauauuuaucaaaagcccagcugcacugccuugacccguggaggauugugaguucuuugugcccgaaaccuuccaguuucaguucugccuugcaugauauugguuaguuucuucucuccccaucccccccgccacacuuuuuucugucagaacaaagaaugcuuuuugcacucuagaucugugguuuguaaggccaaguaauuuuucuaagccccuaacacauuaggagcccuuacagaccauuuugaagagaaagcaccauuugaagcuagagaaaaguuagugacucuuggaaagagaccggaagucucguggaacacaccagccuuccagaggagugugugcucuaagggcuuucuccagccccggggcagcuugacaacaguccacauggauuacaggaggcaggaagccacccaggggcuucuuguugcgcaguggcugcuuuugcguagcuggaagugcuucucgggugggcugcuggcuaagccaggcgccaugcuggguccuugcccgugugaucccaugucccaugucacucccaugcagcucagcggggcucagagguccuguggcugcacaugucacuugguuagugagcaugggagcuggaguuggaacgcaggcagugcuguuggccucuguguguccugcuggucucccacuccccuugcauggucucuugacccuauuacaguagcuuccucaagggaaugacagugaaugcugaaagagcuaaaaggcugcuucugccacucaugcauucaauggccccuucgucccugagugaccaaugggcagcucacccagcaccccaaagccccagucugccuacagcuaugcagcuggggccacacuuugcugugggcugcuaagugcugguuaccuugugacuguuuucauuauuuuaucuaacaaaacaaauaaaccaaaccaaauaauuuuuuuauaauacauuaagggccgggcacaauagcucaugccuguaaucccaauacuuuggaggccaaggugggaagauugcuucagccgaggagcuggagaccacccugggcaacauagcaagaauccucucuccacacacacaaaaaaaauagccaggugugguggcaugcgccugugaucccagcugaggugggaggaucauuugagccugggaggucaaaacuguagugagguacgaucaugccacugcaguccagccugggcagcagagcgagacccaucucaaaaaaauaaaaauguguuaaggcguccacaucacuucuguggagcauuagaaugaaggagagggcuuugcuuuacagcaacuugggccggcuguggggaccacugcagucucugaagugggucagucacucauucacucaugccuucauucauugagagagccucuguaucaggugccuggaucgcugccccucacuggcugccccugccuccccucuugcuaaaagcaccuuucuguucuugucuaaggccccggagggacucgcaucccccuacugugaaaucuaaacugccacauggcucauggggccuccucacgcucuccagacuaauucccgccucaccacgcucuuccuugccucugacccugcuguugucaucugcugcucccucuccaccugccugcccacccccacccagcuuucagaaugcggcccaggcaucgcuuucccaggaagccuuccuuggcaugccgaccacaccaccacuggcugaacuguguccucugggccccuguggcacccuguccucuggggcccagccacccuuggggcuucugcccagaguaucagccuaccucacucuucaaggccugcccgcauacugucuccuccuugcuucccagcacugagucacacccugcacaaugcuugugccagccugcaaugaccucuuuucugugucucccauggacugcaggucccugaagagcuuguguguuuuucaccuuuuuguccuaaguguacugccuggcacaugagaaagcacuaaguaaauauuggaugaaaggauggcugggugcauggauggguggguggguggauggauggauagaugaacagauggauaggauaugguggguggauggauggaugaguggguggauggauggguggauggauggauggauggauggauggacuuauggauggacaggugaguagauggauagaauaguggguggauggauggauggauggauggauggauggaugaguggguggauggaugaguggguggauggauggguggguggauggauggauggauggauagauggguaaguggguaaguggauggauggaugggugaguggauggauggauggacagaugaguagauggauagaauaguggguggauggaugggugggcgggcagguggauggaugaauggguggauugauggaugaaugguuaaguaguaucucccaugugaaaggcacagucaccugucacagggugcacauggggugcauuaggcuugauuuguacucugcagacuaugggggaagcugaggaggaagacuugaccagucuuggugaugagaaggccuucacccuaugaacacaaccaagucuuagcccucucuccugcuccuuuaaacucugaacucuaggaugggagaaugggaacuuuugcagguugagauucauagugaaaucgggucaagaagugaucagaugcaaagcacagggcaguucauuacuauaccauggcugaggucuuccugggcaccaggcccuggucucagcacuuggcucagucugcaccuuggacccugccagagcccuccacagcaggugcucucaggcaaggcuguguguugcuggccagacgccuucugaccagcgugcuuucuugaccacagaucccuuggccaagcaggagggaaccauuagcagccugaggagcuggcuggcugggagccucggggaccgcccagccuugcucccagcucacccacaagauguggacagcucuugugcucauuuggauuuucuccuuguccuuaucugaaagccaugcggcauccaacgauccacguaagugagaaagcugugugacugcuggaugggcccacgguggccacaaagcaugcugagcccuugaaagcagcaucugcaaacccaggccaacgcgucaggaaccgcagcccucccaggugccgcacagggaaggguugucaggccaaccuuccuucuccagggccauggugggcaaagagccccuagcaggaccaggcagcugagcccugaaagguuugcucgcuuggccugcaagauuugaugucaucucuaaauugaaucuucacuggggaauugauuccuucauacaucagaucuuuaacugcguucccacucugugccauucauuuccaagaauuccugcagugaauccuuucacaaagccaagcguucuuuuaugaugugaauaccugugcaguuuaucugcuuuguaaaccugggugugcguucagugggcuuuuaauggugaaucacaccuguugugugagacuuuuacucugauguuuugggaauuggaucaaauagugaaggucugaagccuucaaugggcaggggguucauagagggcaaaggaguuuuaaaaucaaauugacaagggcuuuuucaaugagcugcaugccaacagugggaagagagauggggaggaagcauguucgcacaucaccucccccgacucuggcugggcugaggagggggccccacaggccuggguggaagccgaucccugagcaaucccccugugcaggauugaacaugauugucucucuuuuucuccuuuuucugacuuuaaggcaacuuugucccuaacaaaauguggaagggauuagucaagaggaaugcaucuguggaaacaguugauaauaaaacgucugaggauguaaccauggcagcagcuucuccugucacauugaccaaagggacuucggcagcccaccucaacucuauggaagucacaacagaggacacaagcaggacagaugugagugaaccagcaacuucaggaggugcagcugauggugugaccuccauugcucccacggcuguggccuccaguacgacugcggccuccauuacgacugcggccuccaguaugacuguggccuccagugcucccacgacugcagccuccaguacaacuguggccuccauugcucccacgacugcagccuccaguaugacugcggccuccagcacucccaugacacuugcacuccccgcgcccacguccacuuccacagggcggaccccguccacuaccgccacugggcauccaucucucagcacagcccucgcacaagugccaaagagcagcgcguugccaagaacagcaacccuggccacauuggccacacgugcucagacuguagcgaccacagcaaacacaagcagccccaugagcacucguccaaguccuuccaagcacaugcccagugacaccgcggcaagcccuguacccccuaugcguccccaagcacaaggucccauuagccaggugucaguggaccagccugugguuaacacaacaaauaaauccacacccaugcccucaaacacaaccccagagcccgcccccacccccacaguggugaccaccaccaaggcacaagccagggagccaacugccagcccagugccaguaccucacaccagcccaaucccugagauggaggccaugucccccacgacacagccaagccccaugccauauacccagagggccgcugggccaggcacaucccaggcaccggagcagguagagacugaagccacaccagguacugauuccacugggccaacacccaggagcucagggggcacuaagaugccagccacggacucgugccagcccagcacccaaggccaguacaugguggucaccacugagccccucacccaggccgugguagacaaaacucuccuucugguggugcuguuacucggggugacccuuuucaucacagucuugguuuuguuugcccugcaggccuaugagagcuacaagaagaaggacuacacccagguggacuacuuaaucaacgggauguaugcggacucagaaaugugaggggggcgggggccuggcgggaggccuggccccuuccucguccuuuccuuuugccuuugagaccaaaccaagugcuuccaaauucuuuuggugcaauugaggagauaugccagaugcuuaaacacauuuaauugcugucagauuaauuccaugaucacuaaagaguugcugcuuuuuucauauuuauuuuuguaaaugauucugugcccaggagcagcuggggguuccaccucaggguggggcgggcaggaccccgucuccccaggugucggagccugaccugaauuaaaguacugacugcucgccacaaucgugugggugcauccugcuccuuggggagccuugcuuucugccgugcacguggcaggguuuuguucugugaaugugcaccaucacuccgcacccuggagguugacugugucguugccacugacuuggguuucucccugguacccacgcccgcccuggugcuugcugggaggcuccugggccccagaggaggccacagccagcaucuuuaauccuuuuucugaccuguucgaugaaccuccuggagccagccuuaggggugaaggagcuaaauucaacacaucacccccgugguguggccagcucggccugaaccugcgcagaacagaaucugauccugcccugcucaugagguggggucacuauugcuaguccugaauagugcaagucccuugcuccagguaacccaggaccccagggccaguccugggauucgaccccggagccugcuccuuaggccaguuccccuggauuccaggcucccauccugaacauccagccagcacuugcucugugcuuguuacaugccugcccugucccugugcugugugaaugugacuugcugugugaguguaaccugcuguguaugaccugcugugugaguguaaccuacuguguguaaccugugugugacccgcugcgugugugugaucugugcguguguaaugugcugugcguguguaacuugcugcgugagugcaacccacuguguguguguaaccugcugcacaugugugaccugcugcauugccucagccccaggagaucagcaucacaaucuccauuuugaagacgggaccacugaggcacagagcaaagucacuccuggaggcccagagucaggauugagcccugguccuagagucccagcuguuuguuuaacuagguuccuuugccaccugcccagccugagcuuggccuuugguccuucaucugcccaccugcccaaggcagcaagagcugaugggccacacguggccagggcaucuuguaaggccauguucucaggccaggucugcggcugcugagaccuggagcaagcuauagaguguucuggagcucggcuucuuccucugggaaauggggagagacagagcagcaucugcuguaaacauggcagcauggggccccacccaaaagugguuguggaguuggcuguggcuucucaaccaccuggcgcugaggcagagcugaucuuuguccggaaucuccugucucccacucaccaagaucucccugggcuagguuuggguggccagcuucuuauuuaaguucaucuccaaaaaggaugucaaagggccugggauaaaaggcuaagacgguaacucccaaaccauuugaaguaacuucaaagccgaggcugggaaaauauggaguggggagaaugggucagaagcugccccccaguccucuccuccugucuucucccucacugcaccccggcuuccccagccuuuucuuucucauugucacguccugcuggccccuuccccucucccagccuucacugccugagucaggccuucuggacugacagccacacuccacagagcuugugccugacugucuccuuuccuggccaucacacaucggagucgcaucugcaugcuuaacuacaggcacuggcgcuggcugggaaggugguugguuccagccccuggcuugucucccuugccaucuugagcucuaggccagcucgcagcauuguccuugaaucugacaagacaccgucugcccggaaugggcagcucugcccaccauggguagacaaucggagcuguggaggaugcccuuuccucugccugacuucaccccaguggcccaggcgaggaccagccugcuaagggucagcucuccacccuggcucauugagccuccccugggagagccagaacccugggccugugugagcuguggcuugggggguguucucauagacugugggcaccucguuccuuucuggggagguaggaugaag

SEQ ID NO: 18631 - RNA, 5986 nt, Homo sapiens
uacaguguagccuccgccucccgauugacuggccugcuuggcaaggcaaguagcggcggcgcuucaagguggguguucacguuuuggccgugaaagucgggcuugggcagcguggcgucgggggcgagugugguguccccguuggcgccgccagcucugcgccugggcuuccccucggcucacucaggauccgcggccuccguguccuucaggugcagcggggagccggcucucagggcgcaugcgccgcccgcucugcgccaccggccuaguuagggucggagaucacugggaagguggggaaggugcuggguugggucccuggaacugcagucagugauccaaaggagugggccuguuaggggguucacaggucgugggaugagcucuuaugagcgccggcuaagugccgggcucuggggugcccuuggcauguacgggcuccccuaauucccaagaccaaccgcccccaacccacuucauaggugagaagacggaggucaggucacaucaucugcccaaggucacgcggcaggcugggggacaguuccaggagggccuugaagcuggggaaaggaaugugguaccgaggacuguucaggccuugaagaguuuccagcagggcagggcuggguuccgauccucggcccaccuccuuaucgugugacuuccgacaagucacuuuuuuaucuuuuuuuugagacaaggucucacucugucgcccagguuggagggcaguggugcagucugggcucacugcaacuucugccuccuggguucaagcgauucuccuaccucaaccucccgaguagcugggauuauaagugcccaccaccacaccuggcuaauuucuguauuuuuugguagggacgggguuccaccauguuagccaggcuggucucaaacuccugaccucaggugauccaccugccucagccucccaaagugcugggauuacaggcgugagccaccacacccagcccuagcgagucacucaacaaacugagucccagcgccuuauuugugccucccucguggaguccuuguaaggauaggauggcagcgcuuuccaccccugggcacgguuccugggggaggagagcuaacaaaguucgcucucagugcaugcuggcgggggcugguaauguuguuuuugguuagauuuggggaggaugaagggaggagcagaaaggugggaaacaggaucucugggagggagaaaggaaggauggauuuaaaagguuucuuaggugaggcagaacuugggguccacagaaacugaauuguagcucagccaagcugaaucagauggaaagcugggaggcgcugggaacaggaaagccaucugugccucugacagcaauggggugcgaguagagggcaaagugacacaugucaguggagacuugggauccuugcggugccagucucagaagaggaugguucuugggcacaccccacccuccaucccuuuuuaugccaccagaugcgcugccugaccacgccuaugcugcugcgggcccuggcccaggcugcacgugcagguaggaccaaagaagccuuugcuggggguaggggaguccagucuccugguaugacgucacgcccuucuuuuugcaggaccuccugguggccggagccuccacagcagugcaguggcagccaccuacagugaguaccuggguggccucuagccucagguguuccugacugguccugcuggaguaggggaagagaccugaguuccaguccuggcuuugucaggggcguucuucucugagccuguuuccacuuuuaaaaugauuauggugauggagacugacucugauucacaggggcaggguccaucauugccgagguuagcaugugugaucucagagcucccugggugugauggggaggggguugccaggugugagccauggguaccugugccuauugccagucccuggugaaggcaaaggcucaagccccccaccuaccccccuugauuccucuuucaagcccuguugggcagggaagugcgucugggcuccaauggccacccaagcacagggagagguaggcacggacgggcucaggccagaggcggccuccaggguccuugcugaggcuggggagagguguggugaguguacagccccuuuguagcccagcaguugcaccuggaagugagggccaggcugcucucccugaggcuccagggagacagugugugaggccucuugccauggccucccugcccgccucucugcagaguaugugaacaugcaggaucccgagauggacaugaagucagugacugaccgggcagcccgcacccugcuguggacugagcucuuccgaggugcguccugggcaugaggggacagggaaggugccgggugggcacggaugcaugggggaggagggugccccugcccaccacacccgugcugcccacaggccugggcaugacccugagcuaccuguuccgggaaccggccaccaucaacuacccguucgagaagggcccgcugagcccucgcuuccguggggagcaugcgcugcgccgguacccauccggggaggagcguugcauugccugcaagcucugcgaggccaucugccccgcccaggugagccccugccccaaccggccaccacgccagccccugccacugggagagggaggccaggcagcccuaggcccaaacccuagccccugcuugaugugcguccccaggaagucccuuucccccucugagccacuucccucgugaaugggaaugaugagggcuuguuaccagagcacagagucagugaguuggcagagugaagcuuccagcccugggcaggcgccugacacacagagguucccccuuggggucuggccaagggugugaccccugggccucugagccauggggugacaccugaggccauccacgccucccuggauguagccaccguuuccggaguccugcuugugugccuguugcagcuucccuuccccaguggcugcuccccugaggcccggcuuuccguucucuuagugggucucgugcuuacccgugggggccaggccugccagcacgggaacaauaugacucggucagagcucuggucagaccccugugugugccuggcaggagccccggcagccgccgccgcuacuuucugugugcacagcaaccccucccaguguucugugacucggguggcuccuguccagauccuaguuuguccucuggagcacucccagguccuccaggccaugagcugcggcccugaugucucuacuccagccacggacugagagugcauaggaguguccccaaacagcagucacgauggucacaaccuuggcuuccagacagugagugcuguccacagacagacccggugcugugccaugugugugacucacagccucuccuguaaucuccacaaccccucgaggaggucgagguuauugucuccaucuuuauaagcacuaaaggaugagccugccagccacaggucccacugugaguuguggacacuacauuucugggaugggggcauaugagaguccuugccaagcacauuugaagguuuucccagccagccccucccccagcgggcuacccaggaacugagaguuaggacgugcccuugaguuugggcugugcccccacuugcuguguagcuuuggggagccccucaaccucucggaaccuuguuuuucucauccaucaaauggagagaaguagauuuaaggcacaggauugcacccaacaguguaggcauucuuggcgauguugcagguucggcuccagaccaucgggguaaacugagucacacagcuguuuugguuuuccagugcauuuaaaaguuagauuuagaccgggcacaguggcucaugccuguaauuccagcacuuugagaagccgaggugggcggaucacuugaggucaagaguucgagaccagccuggccaacauagugaaaccccgucucuacuaaaaauaacaaaacuuagccgggcacguuggcaggucccuguaaucucagcuacuugcuaggcugaggcacgauaaucacuugaaccgggagguggggguugcagugagccaaaauugaaaaaaaaaaaaaaaauuagggccgguugcgguggcucacgccuguaaucccagcacuuugggaggccaaggugggcggaucacaaggucaggaauucaagaccagccuggccaacauguugaaaccccgucucuaguaaaaauacaaaaauuagccgggugugggguugcacaccuguagucccagcuacucaagaggcugaggcaggagaauugcuugaaccugggaggcggagguugcagugaacuaugauugcaccaccauacuccauccugggccacagagcaagacuucgucucaaaaaaaaaaaaaggauuuacacuguacuguaggcugcgaagugucuaaaacacaauguauauaccuuaauuaaaaauacuuuaggggccaggcacaguggcucacaccuguaguccaagugcuuugggaggucaaggugaggggauuacuugagcccaggaguuugagaccagccugggcaacauggcaaaaccccgacucuacaacaacaacaaaaaauacaaaaaauuagccccuguaggcccaguuacuugggagguugaggugggaggaucgcuugagccugggagguugaggcugcagugagcuaugagcugcaccacuguacuccagccugggugacagggcaagacucugucucaaaaaacaaaaacaacaacaaaaacuuuauuccuaaaaagugcugacccagagauaagaagcaagcacaugguugguaaaaugacaucagugagcuugcuuuaugcaggguugccccaaaccuucaauuuguaaaacucaaaauaucuggaaagcuuggugaggcgaggcgggacuguaacucagcacucaccgcagggugagacccuuagggcagcgggugcuacacugaacaaagcggugaacagcccccucgugagaggggguucuuggcagaugacgccagcagcugacaaacaggcaaggcaggccgggcacgguggcucacgcuuguaaucccagcacuuugggaguccaagguaagcggaucacaaggucaagagaucgagaccauccuggucuacauggugaaaccccaucucuacuaaaaaauacaaaaauuagcugggcguggugaugcacacuuguagucccagcuacucagggggcugaggcaggagaaucacuugaaccgggaaggccgagguugcagugagccgagauugugcugcugcacuccagccuggcgacagagcgagacucuaucucaaaaaaaaaaaaaaaaaaaaaaaaaccagcaaggcagggacgccagcagggcacgugcugaggagacaggcgcgagcaccagaggugcagggcggccucuuagccggaguccaggaggccuuugaggggagagggcuucuggcagaccccagggguggggaugagcagugacaggggcccugggggcugggaugugacagggcagcguggcagugucugguggccccucccgcaggccaucaccaucgaggcugagccaagagcugauggcagccgccggaccacccgcuaugacaucgacaugaccaagugcaucuacugcggcuucugccaggaggccugucccguggaugccaucgucgaggcacgugaggcccccgggugggagggggccugaggcuccucagcagggccuaaccaccgucccugcaccucaaccugcagggccccaacuuugaguucuccacggagacccaugaggagcugcuguacaacaaggagaaguugcucaacaacggggacaagugggaggccgagaucgccgccaacauccaggcugacuacuuguaucggugacgccccaccggcccgcagccccugcugcccaauaaaaccacuccgaccccacggccuc

SEQ ID NO: 18632 - RNA, 5006 nt, Homo sapiens
cgccaguccugguggcccgggaagcccagauccgcaucagcgguaaguacccccugaccugagaccccugcaccagcugggaggagcaagcaggaggggcaggaaggcgaggcuguugccuagaacccagacacuccacagcuaacucuggugacacuuuccacuccccacgcugugccucaguuucccugucuauaaaaaggagcgcaguccucuuccuauagggagugugccuuggugaacccaucuuccugaacaguugggccccucuucucaauuuaggaaaaagaaacuucuuuucuccaaaggagcaggaaaauugucuccucagagaaagggccacugggggugcaggugggacacagcugagacacucccagcuguccacaccucuugacagguggcugcccuguggagccucccaccgccauccuugcccugagcccagaucccuugcaucggggccagggucuccuaaguaugcccacccccagguucugcaccccacaccagcaugugcucacugccugugccccgggagccccugcgucgcguggcugugacugggggcacgcauggcaacgagaugucgggcgucuaccuggcccggcacuggcugcaugcccccgcagagcugcagagagccagcuucuccgcugugccugugcuggccaacccggcagccacauccggcugccgccgcuacguggaccaugaccucaaccgcaccuucaccagcagcuuccucaagugagugcuuuugccgccagguuggcccaggcaguugggcaccgaguccccaccacaaaacuucccucccgccaccagcagggcccucccugccuucacuccugcuuccccucugccuauguggcccauuccuccacgggacaaaccgaacauuuagagaaaccaagauugaugucaccuccuccaggaaggccuuccugacugcaaguugguucaggaccucuucuggggaucccagaccuaauucuucccucagauuagccccacaggccauguuuacuugucgugugcccugaucacuguucaugccuccuuccaaugaauagucacugcauccuaucuccaggccaggcucuggccagcucaggugagagaauggggaauaggaccaagguguuggcuucaagcuuaauggggagacagaggaagaaccgggcaaccauaacccagggggcuaaaggcagggccggaggcuacacaaagcagcuaaccuggcugagagcagucagggaaggcuuccuggaggcaauggugucucagccaagccccaaaggcugacuaaaagcuagccaggggaagagaggugagagggaguuuccacuggagggccaagcacagcacaggccugggggugagaccagcauggugcucaggcaguguggcuggaaugagggcaugagaggcaggcaagugggcaggcaggugggagggcgggccaggcugagagcuuggauuuuaccgggaagugcagagccaagagggccacgggcagggguggacacagccacaacgucugaagggaaagcccucgcucgagcugcucagaguggcuccugcagggccccugccccuuuccccuuaaaccacugaagacugacugagacugugaagaucggugucccccauucccgucuccacaguuccaggcccaccccggacgacccauaugaggugacaagagcccgagagcugaaccagcugcuggggcccaaggccucgggccaggccuuugacuuuguccuugaccugcacaacaccacggccaacaugggcaccugcuuaaucgcgaaguccucccacgaagucuuugccaugcaccugugccgccaucugcagguggccccggccccaagcacacagcuccccagaggggagugggagggagggagggcaggcgggacaaugcuggaaccuccuuugcuuagccccucuuccccgggccuaguuuccccugggcuccagucccuggggucugccacucgccagcacuccaggcccccgguacccccuccccuacccugccagaggguagagggagaccuggccaaggaggguggugcccuguguuuccuccaugcaacaccuucccaccucaguuucccuucccaaguaggccugggccccuaaccugccucucucgcccccagcugcaguaccccgagcuguccugccaggucuuccuguaccagcggucuggggaggagagcuacaaccuggacucuguggccaaaaauggacugggugggccgcagccuucugagaagugggcggggccaggagggcuggaggggcggguccagucaccaaggggcagggccucuucaaggaguauauggguccugcaccugccuaaccccuugcuuccugguccccaggucuggagcugggcccccagccacagggugugcugcgggcugacauuuucucaaggaugaggacccugguggccacaguucuggacuucaucgaacucuucaaccagggugagaccccaggggacuuucgggaaacagguccggggaagagcaggucuggcucagggguuggggagccaggcucacaggcaggcugggaucuagcccugacguacccccacggcccagucuguccccuagccuggagggagggaugggcucacacacccagccucccacacagguacggccuuuccugccuuugagauggaagccuauagacccgugggcgucguggacuucccccgcaccgaggccgggcaccuggcaggcacugugcauccucagcugcaggugugugugugugugugugugugugugguggggggugauuucuggggccacagccuuggggaggaggauugucaaggaaaacugagccccagggggugcagccaagccucccacgagcucaccagcaucucggguugaggagcaggaugggaggcugggcuccgccaucccacuuccccuggcccugcugccuucccuggaaccccacacucaggccuagcacaagaggccacagugauccccauagcuccuguggagggcaugauggagacaacccuacccuggcuguaaaaggcagagggaggggacauggagcaggcaugacucaauucaccugcuuggaggugcaaauacaaaacucucuucugauuuucaauugguuccucgagcauccccaugcauguuggcaguaugucucucugcaggccuucccuuccugaauguuccaggauuaggcaauccugcuuccacaccuuucccuugggugccugagaagaacguacuggcugcugcucugcuugcugccacagggggucauuguugaauagggucuggugcaaucuuguggccuuuugugcccugaaguuucauuuugaggaguuaccuucuuacaaauggaggcagcaccaucccguccauguuuagggcuagacagucuuaauccagccgugcccagcuaccuugcagacguucagucauaacagucaauuuggguggcuccuccuacaauuuuaaaauuuauuuuauuuuuuauuauuauuuuuugagacagaaucuugcuucauugcccaggcuagagugcaguggugcgaucucaacucacugugacaucugccuccuggguucaagcgauucuccugacucagccuccccaguagcugggauuauaggcacucaccaccacacccagccaauuuuugucuuuuuaguacagacaggguuucaccacguuggccaggcuggucucgaacuccugaccucaagugaucugcccaccucagccucccaaagugcugagauuacaggccacugagauuaugagccacugugcccaggcuuaaaauuuauuuauuuauuuauuugagacagagucucgcucuguugcccaggcuggagugcaguggcauaauauuggcuuacugcaaccuccgccuccugaguucaagcgauucuccugccucagccucccgaauagcugggauuacaggcgcucaccaccacaccuggcuaauuuuuguauuuuuaguagagaugaaauuucaccauguuggccaggcuggucuugaacuccugaccucaugauccacccgccuuggccucccaaagugcugggauuacaggcgugagccacugcgcccagccaaaauuuauuuaauaaagaaucauauuguacuuaccgugugccagacacugcuguaagcacuauuaaccuguuuagucuaaacuucagaaugauaggaggagauauuguaauccuuauuuuacagacaagaaagcugagaaacagagguuaagugacuugcucacaguuacacagcuagcaagaauuugaacuccagcuucaauaccugugcccguauccaugaggguccacuuccacaugggcacaugccaccccaaggugaccugugucuucauuucuagacacagagcagacugguaucucaccagaccugcugucauauggauuaaggaagugaagcaugggugggaaaagccaugaaugaggggcaucuuuugggugucaagcuggggucaccccccucuggggccagggcagagguggccccagcaaucuuggccuuuggcucuccucccaggaccgagacuuccagccacugcagccuggugcucccaucuuccagauguucaguggggaggaccugcucuaugagggagaguccacgguguaccccguguucauuaacgaggcugccuacuaugagaagggcguugccuuuguccagacugagaaguucacauucaccgugccugccaugcccgcgcugaccccugccccgagcccagcuuccuaacccaagacacaccuccccaaccucagucuucccaucugaacgauggguccugaggcacagcucugagcacagaggucccuucugccaccuaccaugcaccauguuccuugccaggccuccccaaccccuggccucaauuucccuuucuauaaaauggaagauguccagaggu

SEQ ID NO: 18633 - RNA, 1223 nt, Homo sapiens
caucauaguccccacaucagcccuguaggcaucccgaagcucugcccagugccguccgcaucccugggagcacacaguaauauuaaaaguggugacuccagcccaguggcagggcugcacuugcccagaugaggaucgaaacuggcgcucagagaggcgcgggaccugcucaacgucacacagcagagcauggcggacacccgccaccccacguuuaaaugcugugcgcaaggcuggggucaucugguccccaagcccagggucugguggaagggcgcagaaccacgguggucagugaccacaggggccgagguaggaaagggggagggauuugggaauccggucaagacucaaggcaggaagggagaagagcucuggacgcugggacaaggaggucaaaggccuggggcuggaguccgacggagccagaggggaagacaagacugggggcggcgcgcgccacccagcgguaucgggagggaggaccggagggagggcugggccggacgcuccucucgcgcaccgaucgaccucggguuccuggaggggcguccccgugggaucccggcuccguacauccuggagccccuaggggagggacggaccagugggggccggcggggccucaucagacaccccaacgccaggacccaacgggaccgaggacggucgccgggcgcuucacgguucgcgugguuucaggaucucggagaacacaaccggcagguccugcagcuccgcgcccaucucccuccccgcggccacacccccggccacggcccggcccugccggaagcacaguccuccuggccacgccccccaguccuucguagcaaaagcuccgguccaggccccgcccccagcccgccccaaccucgauugccuacuaggccccgccgcccuuuggcaguaacguccgaguccggcucccgcgcaggccccgccccgccccgccccgccgcccuccgucccucccauccgggggacucaacgcgucccaccgaggccccgccuucaaacaggccccgcccccuaacggaccccgucccaccgaggacccgccuucaaacaggccccgcccccgaacagacccagucccaccgaggccccgucuccgggaaggccccgcccacgaacagacccaccccacugaggccccccgacgccgcugccgcucugcagccccccaggcgggacgcgucgcgcgggcugccccuucuccc

SEQ ID NO: 18634 - RNA, 1223 nt, Homo sapiens
gggagaaggggcagcccgcgcgacgcgucccgccuggggggcugcagagcggcagcggcgucggggggccucaguggggugggucuguucgugggcggggccuucccggagacggggccucggugggacugggucuguucgggggcggggccuguuugaaggcggguccucggugggacgggguccguuagggggcggggccuguuugaaggcggggccucggugggacgcguugagucccccggaugggagggacggagggcggcggggcggggcggggcggggccugcgcgggagccggacucggacguuacugccaaagggcggcggggccuaguaggcaaucgagguuggggcgggcugggggcggggccuggaccggagcuuuugcuacgaaggacuggggggcguggccaggaggacugugcuuccggcagggccgggccguggccggggguguggccgcggggagggagaugggcgcggagcugcaggaccugccgguuguguucuccgagauccugaaaccacgcgaaccgugaagcgcccggcgaccguccucggucccguuggguccuggcguuggggugucugaugaggccccgccggcccccacugguccgucccuccccuaggggcuccaggauguacggagccgggaucccacggggacgccccuccaggaacccgaggucgaucggugcgcgagaggagcguccggcccagcccucccuccgguccucccucccgauaccgcuggguggcgcgcgccgcccccagucuugucuuccccucuggcuccgucggacuccagccccaggccuuugaccuccuugucccagcguccagagcucuucucccuuccugccuugagucuugaccggauucccaaaucccucccccuuuccuaccucggccccuguggucacugaccaccgugguucugcgcccuuccaccagacccugggcuuggggaccagaugaccccagccuugcgcacagcauuuaaacgugggguggcggguguccgccaugcucugcugugugacguugagcaggucccgcgccucucugagcgccaguuucgauccucaucugggcaagugcagcccugccacugggcuggagucaccacuuuuaauauuacugugugcucccagggaugcggacggcacugggcagagcuucgggaugccuacagggcugauguggggacuaugaug

SEQ ID NO: 18635 - RNA, 17535 nt, Homo sapiens
ccagagaaaggacagggucucaucuggcuugaaggagauguuuauuucggcuccaugauuugggguggggugaaugugaaagcggggagagaggaaacaccucucugacuuggggcugggcaugaggguaaggcagccccagccgccaucauuuuuguggggacguuucaggcagcuguaguggaggggcggcaggcagggcccaugggcuagucgcugagcuggacaggcuugcuguccagcgggugccacagcuucaggcgguggucacuguggcccaggcacucaagccagugccgcaggcgcuccccacuggcauggcugcccagcugcaccccgccugccaugggggaugggucaggaaccgccaggagccuacugggcccccaccccagcuccucauguucccacucaccaaugaagucaucagccgugccuaggucauagucccacacagacaccagcagcgucuucugggccagcuccucccgugggccugaguaaaagaauuccugcagggagaagggcagagaggcgggaaggaggcagccucggcucucccacagcuuaagaagcaggccacgguaggguaguggcucagcaugucaaggccaggguuggcugggaccugccuggcccuggcucaccucauugaacucgggguucagggucuuccugugaacacugguuuugaauuuagauuucuucccugcauuuggaugcaggaaacugaucggggaagauuggcggguuagguguggcccuggagaggugaggagucaccgccuuauccucaccucccgccugccuaccccaguucacucacaggcgcacgaagggguccgaguaaccauuggcauccaugggggccaggugggcgcagcgcagcacaccuaccagcaagccacccugcugagagcuguagcacagugacaguaggacgugcccacauuccucccaggccaccucugucuccaccuccuccugcagguguaggcugaggucagccccaauccaguccaaagcccacccccuuuagccuccgugcucugggcaggaaagcucaaccuggccccaaagaaaucgggggcaacgacuucauuuccaauacagccacuugcccagugccauggaaguggcccuaugggucagcuguacccuccagggccugaccaaaggcgaggcuugcugaccacaugaccagucagauacgucugucauggaggggaagcgaacuggcugacaugccaguagcucccuaaguggccucccauccaguguguguagccaccccuguaggcaagcggcucugagaggauguucacuucccaaggagaagcagaucucuucaaaaccccacccucuucacccccuauuucccuggggaccagaugcugagugucguuugucacacucugggcccuggugcuucugaacaggcucagggaggaagcccggggaggaugcacugcucucacccgcaggguagguuuccauuugcggaaagccccaccaccuugcucacaggcgguucucaggaaugcggaagugcucugugggcacccaccaugcuccgggcgcuguugugcuugggaucuggggcggaggguacacggggcuggcgcugggugaaguggccuguccaugccaccuuggugggcuucagccacuugggcuuagcuaaucgacagcugcagcaacuuguggcuccaccagggggcggggcacccggcacuuuggggaggagcugguagagggccccgcucucagccucccagcugccucccccaccgaccacagggguucuaacuaggucuuuggucucuaguggcgucaaaccccugccagucacccucacugccuccggacaagggccugucuaggacagccugccccaggaguggcccccacacuccccucaggccagaccccagccagggagccccacccaucuguccucucuuccaccucgcccagccucccaucucgggccguggacaaaugccgccaguuucagccucugccucaaggcaggucucugcccagcugcgcccccagggacucugcuugucccagugccccacagcuccucugggcugcccuggcaagggagucacccucacuuugucaccuggcuguccccugugacaaugagggcucacagggccuaugagagcuggccucagguuccuccaaguccccuacgccccugccaccaggccugcccccucaucucugcucagcccaguuguccuacccaccucauagagggacaugccacaggcuguguccaggcucuugggccucuuggccugaaagggcagagagcccggucauccuggccagaugcugcccagaucccccucccuguuccuccccuccagcuccccccaucacagguuccuggccucugcagucccaccugugcuccagccccacucaccagccuccgcuucuccagacagaugucaaagcuccuggcucgguuuggcaccagcuuccucaggggcacccgcagcucccccagggaaggugccugccacugucgcuguaccauggguccucgcacacacacagccugguggccgcccaggucagaccuggccaggccagccccaucccucugcuccacccccagguggcccaggccagauccucaccuaagggucuugcacucagcauccuggcgggugaagccgugauaggugagugucuccucccagacagguacccucgugccccgaacgguguguguccgaagcuggcuggccuagggcccaagccgggugggucagggccuccuagggcuaagaccguccuguaacccccaacccuaccucccugguaggaccccccacuauuugcacaucccagcaacugagaccuaggccuugcaggauggggaggagccaagcagagccaagugggugccccaggcuggguguuccaccagagggcagcagugggggccuggggcuugcccucaccuugcuggccccuggcagcagauuggcuuugacauaggcauccgcggagccugaggccaauggcuugaggcccugggaacagacaguggguaugagacaggcccgugccccagcccucugucccaggaacacccacccccauccucaccuuggcacgaugagccgugcaaugcagggcacuguuguccgcuucaaaaagaagugugaacuccagggugcccagggcagcuagaggcagguggaaggcagcgucaccuccuaccucagcucagucugcccccacccauggcacgugcuuccugccuugccccuccauggccagaugguagggacaccccacucccccuccuggcugggcugagcucagggugucccccucuucccgccccuacucacugcugucgucugagucuccuucuggcucugggucgggcugcagcuggggugcagagcggacggcggacgccgcugcggggcgcagguucggagggugcagggcaggcuccgcaaaaggguaaaagugcgggaaguagugggaaaugaggcggaugggccggauggggcccgggcucacaucgauggccaugugcuccugcaugcuaacccggggaggcugcccaccugcugccgcagugcccgccauggggacccagacggggggcggugggcggagacucagagaaaugccugaggacuggggcuggcgggaacgcacccggccucggaaauggggugaagaagcaucgcugauaccaugcagggaccugaggacagagcgcaggguugagggaggggcugggggaguccucagccuggaggguuguggcaggcuuuggaggggacuggguguguugggagucaguccagcucccggcccuuaccgcucugggagcuacuucacccagugugaguugcugcugcuggcaguggguacgcacucaugagggcagagcccgugacugcuguguccccagugagugagggugacccagagcucagaacccucucagagcuccuuccuagcgcuggggcucagcuucccuccucccucugcccccuucacacuuugucaaagggaguuauuuuugccaccaucauguggcccugcucccaggugaggaggcuggugggccggaggugacagagggcuguggaggugauaagugguuugugggaaggagggagcgcauaggaggaggggagggggugcaugggaaggugggaggggagggaggucuggggaggagaggaggggagccacaggagggggcuccugugauggagcccuguggggguggccaguuuacacucugaaacaugaaccagaucaucccgccuccaccccugcuuggaauaaaaucugaauccuuuggugaggcacggccccuuuucaccucaccaaggaguguccccuuggcaucucacaguaacggccugcuccccucccaaacugggccacccucccugcccuuugaccugaccacuccuacucaccuuugguuucugggucacccccugcaggggaucuuggcugguuuuaaccauccagcauucccucuccucucuucuccccaguuauucuuuuaauuuuuaaucaacauaaccguagguguguaugggguacaauaugguguucugaugugauauguguagaaaugcaauuucuacaauaugcauuguagaaagagucagucaggcuaaugaaaaaaagaacacuuaaaaugugcucuucaggcaacugugaaauacacaaggcgcuauuguuagggauguuugucaugcugugcaacagggccuucagcuuacucuuccugacuggaacuuuguacccuaagagcaaugucuccccucuccccaucccuagucccccacucuccagccccuggugaccaccauucucucugcuucuaggaguucaacuuuuucagauuccccauaaaaaucagaccguauaguauuugucuuucugugccuagcuuauuucacuuagcauaucguccuccagguucauccauguugucacaaaugauagaauguccaucuuuguuaaggcugaacaguauagacagaccauccuauccauccgucugaugcugggcagucagguugcugccgugucuuagcuguugugaauggcacugcagugaacacggaggcagacaccucuucagcaugcugacuucaauuccuguggauacuacccacaagugagguugcuggaucacacgguagcucuauuuuuaguguucuaagggacugccauaugauuuuccaaaauggcugugcucauuuaccuucccacaaacagcacauaaggcuucccuuuccuccacauccucacgagcauuuguugucucccaugguuugguaguagcuuuucuaacaggugugagaugguaucucauugagauuuuaacuucuauuuccuucacgauuagcgauguugagcauuuuuucacgugucuuuugagaaauguauguucagguccuuugcccauguuuaaauggggauauuuguuucuugaguuccuuguuucuuuuggauauuagcccccuuaucagguguaugguuugcaaagauuuucuccuauccuguagucucucucuucacuuuguuguuucuuuugcugugcagaagcuuuuuagucgggugcuaucccauuugucuguuuuugcuuuugaugccuuugcuuuugggguccuauccaagaaaucauugcccagaccaaugucuagaacuuuccccauauguuuccuucaaguaguguuaccauugcagguuuuuuuuuuuuuuuuuuuuccuuuaagauaggaucucacucugucgcccaggcuggagugcaguggcacaaucucaguucacugcagccucugcccccugggcucuagcgaucuuccccccucagcuucuugaguaguugggacuacagcgugcaccaccaugccuggcuaauuuuuuuguauuucuguacagaugggguuucacuacauuggccaggccggucuugaacuccugaagucacgguggcccgccuuggccaaccaaagugcugggauuacaggcaugagccaugacgucuggcucacuucagguuuuuacaggccauuuugaguugauuuuugucuaaagugggaaccucaauuguucuuugggaaccacugcuucucaguccagggaguucccuccuacccaggcaagcaucccagauucuauccaucaauguacuguaaauccaacugagaggugacagcgugcgggcaguccucauagcccucgcucgcucgcucucggcgccuccucugccugggcucccacuuuggcagcacuugaggagugcuucagcccaccgcugcacugugggagccccuuucuaggcuggccaaggccggagccggcucccucagcuugcagggagguguggagggagaggcgccgggaaccggggcugcgcguggcgcuugcgggccagcuggaguuccgggugggcgugggcuuggcgggccccgcacucgccgcagccagccggcccugccggccccgggcaaugaggggcuuagcacccgggccagcggcuguggaggguguacugggucccccagcagugccagcccaccggugcugcgcuugauuucucgccgggccuuagcugccuuccugcggggcagggcucaggaccugcagcccgccaugccugagccucccacccccuccgugggcuccuguguggcccgagccuccccgaugagcgccgcccccugcuccauggcgcccagucccaucgaccacccaaggggugaggagugcgggugcauggcgcgggacuggcaggcagcuccaucugcagcaccggugcaggauccacugggugaagccagcugagcuccugagucuggugaggauauggggaaccuuuguaucuagcucagggauuguaaauacaccaaucagcacccugugucuagcucaggguuugugaaugcaccaguggacaaucuguaucuagcuacucugguggggccuuggagaaccuuuaugucuagcucagggauuguaaauacaccaaucggcacucuguaucuaacucaagguuuguaaauacaccaaucagcacccugugucuagcucaggguuugugaaugcaccaacggacacucuguaucuagcuacccugguggggacuuggagaaccguugugucgacacucuguaucuaacuaaucugguggggacuuggagaaccuuugugucuagcucagggauuguaaacgcaccaaucagcgcccugucaaaacaaaccacuugucucuaccaaucagcaggacguggguggggccagauaagagaauaaaagcaggcugcccaagccagcaguggcaacccgcuuggguccccuuccacacuguggaagcuuuguucuuucacucuuugcaauaaaucuugcuacuguucacucuuuggguccacacugcuuuuaugagcuauaacacucaccgcaaaggucugcagcuucacuccugaagccagcgagaccacaagcccacugggaggaacgaacaacuccaggcgcgcaaugaacaacuccaggcgcgccgccuuaagagcuguaacacucaccgcgaaggucugcaguuucacuccuaagccagcgagaccacgaacccaccagaaggaagaaacuccaaacacaucugaacauuagaaggaacaaacuccagaugcgccaccuuaagagcuguaacacucaccgcgaggguccacggcuucauucuugaagucagugagagaccaagaacccaccaauuccggacacauuuuggcgaccaugaagggacuuucgccuauugccaagcggugagacaaucgcugagcagugagaccaucaccuauugccgagcggugagaccauugccuaucgccaagcagugaguaccauuggaccccuuucgcuugcuauucuguccuaucuuuccuuagaauucgggggcuaaauaccaggcaccugucggccaguuaaaagugacuagcguggccgcuggacuaaagacaugggugucagacuuucugggaaagagcucucuaacaacccccgacucuucggaguugggaccguugguuugccuagaaccagcuuccgcuuuuccuguacuucugggcugagccgagggucgacagagaggaaggccaugcagcucugggguccugacaacaugaugguugaccccgcggccaugagcagaacucucaaaagcaugucgcccaagcgagacccgcccaucuauccuaucuauccugacccuagcccccuggguccuaaugccugccagacaaacuuccucuugccucccuucucugagguuagacccacuucuaaaaauugcuaccugucucuggugcuuuucuaguuucuccgauaagaaugauuucuaguauaaacuccaggacucuguuaccuucuuuaggcaccugggcucaccaaucagaaagacauaauuuuugcccaaagccccaucguaguggggacuaccuggaauuuuaggaucccuccucacacugacaggccuaacaaaagcuauuccugaagcuaggauauggggagccucagaaauuguauccuuccuauucauauaaguuaggacaaaagaugucacucuuccaacccuggagaccccuucccuccuucaggguauggcccuccacuucauuuuuggggcauaacaucuuuauaggacagggguaaagucccaauacuaacaggagaaugcuuaggacucuaacagguuuuugagaaugcgucgguaagggccacuaaauccgauuuuucucggucgguccuccuuguggucuaggaggacaggcaagggugcagguuuucgagaaugcgucggcaaggaccacuaaauccgaccuuccucgguccuccauguggucugggaggaaaacuaguguuucugcugccgcgucgguaagcgcaacuauuccgaucagcaggguccagggaccguugcggguucuugggcagggguuguuucugcugcugcgucagugagcgcaacuauuccgaucaacaggguccagggacuguugcggguucuugggcagggggagaaacaaaacaaaccaaaaccgugggugguuuugucuuucagaugggaaacacucaggcaucaacaggcucacccuugaaaugcauccuaagccauugggaccaauuugacccacaaacccugaaaaagaggcggcucauuuuuuucugcacugcggcuuggccccaauauucucuuucugauggggaaaaauggccaccugcgggaaguacaaauuacaauaccauccugcagcuugaucuuuucuguaagagggaaggcaaauggagugaaauaccuuaugcccaagcuuucuuuucauugagggagaauacacaacuaugcaaagcuugccauuuacaucccaaaggaggaccucucggcuuacccccauaucccagccucccuauagcuccccuuccuauuaaugauaauccuccucuaaucuccccugcccagaaggaaauaagcaaagaggucuccaaaggaccacaaacccccccgggcugucaguuguguccccuucaaguuguagggggaggggaauuuggcccaacccggguacauguccccuucucccucucugauuuaaagcagaucaaggcagaccuggggaaguuuucagaugauccugauagguacauagauguccuacagggucuagggcaaaccuuugaccucacuuggagagaugucaugcuacuguuagaucaaacccuggccuuuaaugaaaagaaugcggcuuuagcugcagcccgagaguuuggagauaccugguaucuuagucaaguaaaugauagaaugacagccguagaaagggacaaauucccuaccggucagcaagccauccccaguauggaucccaacugggaccuugacucagaucauggggacuggaguuguaaacaucuguugaccuguguucuagaaggacuaaggagaauuagaaaaaagcccaugaauuauucagugauguccaccauaacucagggaaaggaagaaaauccuucugccuuccucgagcggcuaugagaggccuuaagaaaauauacuccccugucacccaaaucacuugagggucaauugauucuaaaagauaaguuuauuacccaaucagcugcagauaucaggagaaagcuccaaaagcaagcccugggcccugaacaaaaucuagagacauuauuaaaccuggcaaccucgguguucuauaauagggaccaagaggaacagguccaaaaggaaaagcgagaucagagaaaggccgcagccuuagucauggcccucagacaaacaaaccuuggugguucagagaggacagaacaugaagcaggccaaucaccugguaaggcuuguuaucagugugguuuacugggacacuuuaaaaaagauuguccaaugagaaacaagcugcccccucguccguguccacuaugcugaggcaaucacuggaaggugcacugccccagaggaugaagguucccugggucagaagcccccagccagacgauccaacaacaggacugagggugccuggggcaagcgccagcucaugucaucacccucacugagccccggguauguuuaacuauugagggccaggaaauugacuuccuccuggacacuggcgcggccuucucaguguuaaucuccuguccuggacgacucuccucaagguccauuaccauccaaggaauccugggacagccuguaaccagguauuucucccaccuccucaguuguaauugggagacuuugcucuuuucacaugccuuucuuguuaugccugaaagucccacacccuuauuagggagggauauauuagccaaggcuggagcuauuaucuacaugaauauggggaacaaguuacccauuuguuguccccuacuugaggagggaaucaacccugaagucugggcauuggaaggacaauuuggaagggcaaaaaaugcccacccaguccaaaucagguuaaaagaucccaccacuuuuccuuaucaaaggcaauaucccuuaaggccugaagcucauaaaggauuacagaauauuguuaaacauuugaaagcucaaggcuuaguaaggaaaugcagcagucccugcaacaccccaauucuggaaguacaaagaccgagacuagugcaagaucuuagacucauuaaugaggcaguaauuucacuauauccaguuguacccaaacccuauacccugcucucucaaauaccagaggaagcagaaugguucacaguucuggaccucaaggaugccuucuucuguguuccccugcacucugauucacaguuccucuuugcuuuugaggaucccacaaaccacacaucccaacuuacauggauggucuugccccaaggguuuagggauagcccucaucuguuuggucaggcccuagccaaagaucuaggccacuucucaaguccaggcacucugguccuucaauauguggaugauuuacuuuuggcuaccaguuaggaagccuugugccagcaggcuacucuagaucucuugaacuuucuagcuaaucaaggguacaaggugucuaugucgaaggcccagcuuugccuacagcagguuaaauaucuaggccuaaucuuagccaaagggaccagggcccucagcaaggagugaauacagccuauacuggcuuauccucgcccuaagacauuaaaacaguugagggaguuccuuggaauuaccagcuuuugccgacuauggaucccuggauacagcgagacagccaggccccucuaaucaaggaaacccagagggcaaauacucaucuaguugagugggaaccagaggcagaaacagccuucaaaaccuuaaagcaggcucuaguacaagcuccagcuuuaagccuucccacaggacagaauuucucuuuauaugucagagagagagccgggauagcucuuggaguccucacucaaacucaugggacaaccccacaaccaguggcauaccuaaguaaggaaauugauguaguagcaaaaggcuggccucacuguuuaaggguaguugcagcaguggccgucuuagcaucagaggcuaucaaaauaauacaaggaaaggaucucacugucuagacuacuuaugauguaaauggcauacuaggugccaaaggaaguuuauggcuaucagacaacugccuacuuagauaccaggcacuacuccuugagggaccagugcuucaaauaugcacaugcauggcccucaacccugccacuuuucucccagaggauggggaaccaaucaagcaugacugccaacaaauuauaguccagacuuaugccgcccgagaugaucucuuagaaguccccuuaacuaauccugaccuuaaccuauauacugauggaaguucauuuguggagaaugggauacgaagguuagugauguaaccauacuugaaagcaagccucuucccccagggaccagugcccaguuagcggaacuaguggcacuuacccgggccuuagaacugggaaagggaaaaagaauaaauguguauacagauagcaaguaugcuuaucuaauccuacaugcccaugcugcaauauggaaagagagggaguuccuaaccucuguaggaacccccauuaaauaccacaaggaaauuauagaguuauugcacgcaaugcaaaaacacaaagaggugggaaucuuacacugacaaagccaucagaauaggaaggagaggggagaacagcagcauaagcagcuggcagaggcagcagaaaggaaagagacaggaagucaaagaaagagacagagaggaagagacaagaaguuagagagaaagagggacagacacagaaagucaaagagaggguaaaaaagagaggaagagacaaagaagaagucaaagagagagauggaaguaguaaagaaaaaacaguguaccuauuccuuuaaaagccaggguaaauuucucucuacccagccaaggcauauucucuuauguggaucuucaacccauaucugccucucaaaguuggaagaaauaaugaaaucuauccuuacuuuacaaucccaaauagacucuuuggcagcagugacucuccaaaaccgcugaggccuagaucuccucacugcugaaaaaggaggacucugcaccuucuuaggggaagaguguuguuuuuacacuaaccagucagggauagcaugagaugccacccagcguuuacaggaaaaggcuucugaaaucagacgccuuucaaauucuuauaccaaccucuggaguugggcaacauggcuucuccccuuucuaggucccguggcagccaucuugcuguuacucgccuuugggcccuguauuuuuaaccuucuugucaaauuuguuuccucuagaaucgaggccaucaagcuacagauggucuuacaaauggaaccccaaaugaguucaacuaacaacuucuaccgaggaccccuggacugaccagcuggcacuuccccuggccuagagaguuccccucugaaggacacuacaacugcaaagccccuucuucgccccuauccagcaggaaguagcuagagcagucaucggccaaauucccaacagcaguugggguguccuguugauugaggggagacagcaugcuggcaguccucacagcccucacucgcucgcucacucucggcaccuccucugccugggcucccacuuuggcagcacuugaggagcccuucagcucuguaucuagcuacucugauggguccuuggagaaccuuuaugucuagcucagggauuguaaauacaccaaucagcacccugugucuagcucaggguuugugaaugcaccaauggacacucuguaucuagcuacucugguggggccuuggagaaccuuugugucaacacucuguaucuaacuaaccugguggggauguggagaaccuuugugucuagcucagggauuguaaacgcaccaaucagugcccugucaaaccacucggcucuaccaaucagcaggauguggguggggccagauaagagaauaaaagcaggcugcccgagccagcaguggcaacccgcucagguccccuuccacacuguggaagcuuuguucuuucgcucuuugcaauacaucuugcuacugcucacucuuuggguccacacugcuuuuaugagcuguaacacucaccacaaaggucuguagcuucacuccugagccagcgagaccacgaacucaccagaaggaagaaacuccaaacacauccgaacaucagaagaaacaaacuccagacgcaccaccuuaagagcuguaacacucacugugaggguccauggcuucauucuugaagucagugagaccaagaacccaccaauuccggacacacaaccggccaugugacaggcucagggaaggacaugugacucaaggcaggccagugaagugcaauucuagguuagacuggccgggaaggagcggccguguuuucuguugauggaugcugcugcccucuccucaaccucucacgcucugcacuacagacaaccuccuuggggcugaggccagcacagcgcaaagcacagcaagaggggagcccgagccccuggauccagccauccuccacggcaagcucagaccacccgcucccucagcucuuucacagaacccuggucuaccuaguugaugucuuauauaauuccacuauuaucugugauuaauuaauguggaaccacaugauuaucugugugaccuggucugaggucuccccuagacugagcacccccucuggacggcaggugagcaucugaccgguccacagcuguggcccccacacagcagcuggcacacacaggggcucugcauguuagacuccugcaguaacacccaggggcaugggugcgccuuacuccucucugggaucccggagcccagcacagcgucagccaggcacagcagagagaacaggaggugcaggcugagacagggcagugcagugccuaagagucugggcuguggagucugagagcucugguuccaaucccagcguggggcccuuaggcaaggugucucuccucccugaaagcagucucaccagccagagacaguguuggcccugccuuaugggcuguugugagggugagaugaauugacuccaaguacuuggcacccaggaaguguccauugcuguggggcauggcgugacuggaaggaggagccccagccagcgaccuggaguggucugcccaaggucaaggccccaguacagcagaagcaagagcucuagagcugucaaagaccuuuauucaguccuggaguggagcuggccugacagggugaagccaggggcugcuuagggcgggccagacccucagccccugagcaggucaggccggccaggcggggcugguagguaccaggugccagcagcugcagggcaaacucagugaugacagcugugaggccccagacccggugugguccaugcaggaagacggguaguguguagcggaaguggccaccccggcagaaguggguauagcccugauucugcgucugcagcaggugggccagcggcagugcaaacaccucaucuaccugcaggcaggaggcagagaggguagacagaggacuggaacagcccaacccccucauaucccccagcucaccuccuccgaguugggccugaggcucuggggauccagugggccuacaccagcaagcacuggcaccacgguggccuuuugcuggggaagagggcagguggucagggaagcauggccuucgcuggguuugaaggcuggggaggggagugugagaggaagaccccuuugccaugcauaggccuuugguagucauguucggguccaccugccuguguccuccagccaugcugacugacucagguccccucaaaugcacuagaccuguucccucugcuuaggacaaucucccacuuggcauucaagccuggguucaaucccugccuaccccaugaagcuucccugacccuaauccaccaaacugaguggagcuggcccaccccaucgcccugggccaccucuacucaggacaccagagccuccccaaucccuucccgagggggugugugggguggugcaugugaccaggcagguuaggggcacccuuccacacuuugugcccguggggguccaugaccacucuccuggucccugguagcccagcuccagggcaggcacagagugagugaauggggugggguggccucagccaaguggcuuaccggaucauacacaggccgcagcaggccccacacgugcuccucgggcacugccaggcccagcuccucccggguuucccgcagggccgugugcaccacaucuuggucagccgggucgcacuugccgccugggaaacuaaacagacacaaggagucugguccuuggacucuuggggccacggagaggucgggguaucggcagugcggggggggccacuggcccaccgaagugucgccugccucugccccuaguuuacugggaggccccaggcaagccaugcgaccucuggaggccaguuuaccucccugagcaauggggauaaggaagagaggcccgggacagcgcaggauaagagggucugcagcaggggcaagaagauccuggggcucagauacccaaauucggccuaugguggccccagcaacacugacauuguccucaggauguucuuaauucccgccgggcggggcccgaaccucuccguagucgccggcagggggcggcguccgcccucuaagcgggaaacagcucaaaggggugucccggcccaggcgugcgcgcaaggacgcguacgaggggcccacgcggcgaggacguggcgccccggcaggugcaccggggccgacggacacggaucgcugaccucucgcugcagcccuugggcggagggacucuccccagacccauuuuacggaggcggaaaccgaggcucgaaggggcuaagugcccugccagaggucccugccagccccgggcuccuguagccuccggcaaagggcgaggaguucccggccgcuguaccugacgucgcccuugugccucccggucaggcggcuggaccgcagcguguacagcagcgccgggaccccacgcacugagcagagcggcacgagcaccgcggccgacgcgggccgcgcgcggagccgggccguggccccugccagcagccggcggcagcgcagcucgcccucggccgacaggcagucgggcagcaugucaaguccugcgcggccgggacacugagggcgcgggaucgggcgagggaagaggcggggcgaggcggggcggggcgcucagcccgggucccuccgaaagcugagagggagaaggggcagcccgcgcgacgcgucccgccuggggggcugcagagcggcagcggcgucggggggccucaguggggugggucuguucgugggcggggccuucccggagacggggccucggugggacugggucuguucggggg

SEQ ID NO: 18636 - RNA, 795 nt, Homo sapiens
caucuuggucagccgggucgcacuugccgccugggaaacuaaacagacacaaggagucugguccuuggacucuuggggccacggagaggucgggguaucggcagugcggggggggccacuggcccaccgaagugucgccugccucugccccuaguuuacugggaggccccaggcaagccaugcgaccucuggaggccaguuuaccucccugagcaauggggauaaggaagagaggcccgggacagcgcaggauaagagggucugcagcaggggcaagaagauccuggggcucagauacccaaauucggccuaugguggccccagcaacacugacauuguccucaggauguucuuaauucccgccgggcggggcccgaaccucuccguagucgccggcagggggcggcguccgcccucuaagcgggaaacagcucaaaggggugucccggcccaggcgugcgcgcaaggacgcguacgaggggcccacgcggcgaggacguggcgccccggcaggugcaccggggccgacggacacggaucgcugaccucucgcugcagcccuugggcggagggacucuccccagacccauuuuacggaggcggaaaccgaggcucgaaggggcuaagugcccugccagaggucccugccagccccgggcuccuguagccuccggcaaagggcgaggaguucccggccgcuguaccugacgucgcccuugugccucccggucaggcggcuggaccgcagcguguacagcagcgccgggaccccacgcacugagcagagcggcacga

SEQ ID NO: 18637 - RNA, 5718 nt, Homo sapiens
ucccccgaggaggcggggccgcuggcgaaguugaaggggcgcagcgauaccggugcgcggcgcuggcgucgggcgcgugacgucuuuccugcgcgccaccuagcgucucuaucgcgccaguuccucagccucagugcuaugaaggugacagcgugaggugacccaucuggcccgccgcgaugcuggcaacacggcggcugcucggcuggucgcuucccgcgcggguaucugugcguuucagcggcgacacggugaggcccagccuggcuggggccacggguguuuggggccgggugucgcggccgcgcccgugcacgagcagucccuggggucuguaguggccucuggagagcccuucuccccaggccaggcgggaaggcccccgcuccggccugguugaaguaggggaacgggucccaacgcggggccgacucccuugacccucugacuugcuggcuucccuuguuuuacaguccucggccuggcggaaguuuugcagguugugaagaccccuagucuuucauucucuccuugucacagccuuguagggcgugaaggggucauugccccauuuagggaugcgcaccuccugauuucccguccacugcucugcgcccugaaguggcugaaaagugcucuuaaaaggaugggaaucccgucgcccucagcuggugcgcucuccacugggucguggggcuccucauuucauccuaagugagccccuccaucaccuguguguuaaggaggcauuucuuucccaucaguaaacacauuucgccucuucggccgagguaggaauauaaaaggccccuggccuacccaaguuuugguccagcaggggagccaggccgggaaagggccaagcugccacacucggcuuguggggcuguguggugccgugaugcagcuguggguuuggccaccgacagaccugggcucaaauuggaccugcugcuuuugacugugagaccuuccauaagcuccuuuugcuccaagccucaguuuucuccucugugaaacagagaaaaucguuccuaucagaguucuuaugaggaugaaaugggauuuuggauguaaaaugcuuccauccaguaccugcuaaacaaaaugcuuacuaauggccgggcgcgguggcucacgccuguaaucccagcacuuugggaggcugaggcgggcggaucgcuugaggucaggaguucgagaccagccuggccaauauggugaaacccugucucuacuaaaagugcaaaaauuacccgggcgugguggugagugccuguaaucccagcuauccagaggcugaggcacaagaauuauuugaaccugggagguggaguuugcagugagcugagauuacgccacugcacuccagccuaggcaaaagagcaagagucugucucaaaaaaaaaaaaaugcuuacuaaguggcagugguaucuaugaugcuauagaugcuucccuagcccuagcccagccccuccuaaauagggagacccaagauucuguagcuucuggcccaaucccucauggccccagagcacucugggccuccugacccuuugucucccuagacagcacccaagaaaaccucauuuggcucgcugaaggaugaagaccggauuuucaccaaccuguacggccgccaugacuggaggugagacagugcccuuaguguguugggucccggagcaagguguccccuucauugccuucccuauucuguccaggcugaaagguucccugagucgaggugacugguacaagacaaaggagauccugcugaaggggcccgacuggauccugggcgagaucaagacaucggguuugaggggccguggaggcgcuggcuuccccacuggccucaaguggagcuucaugaauaagcccucagauggcaggugugugugugggggcggggcagauguggcugugggagagaccuuggggguggcugggguuucccugggccuuugggcucuuuccuuagaaacuuagcaugaaugaggugggcacauguucccaggccuuaaauggaugggacuuacucuguggacuuccacaggggagacuuauguagcagaaucaacacaugauuuugacucaggcagacuuaguucaaauccuagcucugccuccuaaucauagagguuugggcaauuucccagccuuugugaaccuuagcuuccuuuuuguaaauagguacagugauaucaugcaaggauuaaagagauaauguucauacagcuuuuggccuguaugcugguuggcacauaaagcaaaugauaaaugucaccugcuuuaccuccuuuugaugguagagcuugaggaaugcucuuugucaccaagaguagaaucuggcucucaggggcagacacaaggagagauguuuggaugagcugaaugaagaccuuucuuguggucauagccacccaaagacagaauaggcagugagcucccugucauugguggugagcaagcagagccccugggacauguugggagggcaguaaaggauuggcugucagaggagacaucuuugaggccucccuggguggagugggguggcauggaguugaagacccaguccugauggcccuguagccugucugaccugugggccccugcaggcccaaguaucugguggugaacgcagacgagggggagccgggcaccugcaaggaccgggagaucuuacgccaugauccucacaagcugcuggaaggcugccugguggggggccgggccaugggcgcccgcgcugccuauaucuacauccgaggggaauucuacaaugaggccuccaaucugcagguggguagggagagauguagacagaugagaagguguucagugugcacucacacaccccucacccagcacaguuguucugagguguuaguaccuggucugucagugguugaacugggggagugguggccaguccugcaugcaucccaaaugggacuuggcucccaaagccuccuuccagggcuccuaaugcugcugguguaaauuuuuuuuuuuugcuucaaaaauauaguauuuuuuauaaaacaaguagcaagaagaaaaaaccuaaguggaacuauguguuuagcaagagagcggaauaauuaugaauauaaacaauuccuauuuggagaaaauacauuauguucauugcuuggaacuaugaauaauacuuauaucuguaggaaauauagaaaaauaaaauagguuaaggcaauaaggauauaggcaauuacauuuuuauuuuaauuuuauaaggacuuuuauuuuuccuuuacagacuaggguaguuaggagaccugauaguagcuacuucguuuuuauuuuccuggcagcaaagcagcuuacuuauguguuccuucuugcuuaucuguuccagaucauagucaaguuuuccaauucguuuuacuaagcuagcaaaauuuuuuauaccaggagcauuaggagcuucaccgugggaggccuucaagggcuucaugacuccugaaguuauaggcugacuccugggcugggggugggcugggaaacucacaccuuuguccugcagguggccauccgagaggccuaugaggcaggucugauuggcaagaaugcuuguggcucuggcuaugauuuugacguguuuguggugcgcggggcuggggccuacaucuguggagaggagacagcgcucaucgaguccauugagggcaagcagggcaagccccgccugaagccccccuuccccgcagacguggguaaggccuggcguaacccugggucagacuguguccugugacacccgggaucuggcuaggcucccuuuggauuguucuuagggauuucugaguggcuucccggcuggggccagauagagaguaggcuggcaacaacacacaggcucccccagggccgccugcugucccuccuccugccucgguccccuccgcaccagugcugcucuguggcuccaccuucacagugccuguucugaggcuaagggcauggggugaacaaggcaaugggcaucucuggaguuugggguccagcagggauaagaaugauaaggggauauuagagcaggggcucugccaugggugcaggacccugggacacaccucccugccaggaaacuugccccacccccuagcagccaccaguucucuucccauuucccugaaggaguguuuggcugccccacaacuguggccaacguggagacaguggcagugucccccacaaucugccgccguggagguaccugguuugcuggcuuuggcagagaacgcaacucaggcaccaaacuauucaacaucucuggccaugucaaccacccuugcacuguggaggaggagaugucugugcccuugaaagaacugauugagaagcaugcugguaaggccuggggccagccagguggugggggggugcgcagugggggcagguguccacaaagagagccugggcgggagggcucaggagacggggcugggucuaggggcugacuaagggccugggcucaggacuaggcaggugugccggccccagcccugaccaugcaucccuuuggggaccgacuuggggccccagggggugucacgggcggcugggacaaccuccuugcugugaucccuggcggcucgucuaccccacugauccccaagucugugugugagacggugcugauggacuucgaugcgcuggugcaggcacagacaggccugggcacagcugcggugaucgucauggaccgcucgguaaggguucacacaccagcccuggucccugcccuccugguugcugucucccucccugggccucccagaaaacccucuugccagcacucaggucucaguuccugcagccugagauaaagcaagguggaagaggagggaggaaggcugcucugaggagaauaccccggagucugggcagcacagggggcccagggaggcuggaggaggccagaacgcugggugggcugggaagagcuucuggaacugggggaggggcugcugcuagggggcugaggcccaggcuucugucuggccgugggugccugcuaauugccccucgucacccagacggacaucgugaaagccaucgcccgccucauugaguucuauaagcacgagagcuguggccaguguaccccaugccgugagggugagcaucgggcagguugggggcuugcuugcuguggcuucauuuaaccuccuccccaccacguggccugcagcccucaagcgccgccccacauccuggcuggggagaucaucaggcccucucuuguggcuguggcugcagguguggacuggaugaacaaggugauggcacguuucgugaggggggaugcccggccggccgagaucgacucccugugggagaucagcaagcagauagaaggccauacgauuugugcucugggugacggggccgccuggccugugcagguauucaccacccuucugcguagcacggaggguggguggcaucaagggcccaggguguugggggauuuuuggacucuguuucacaugguccccccaccgaccccagggucugauccgccacuuucggccggagcucgaggagcggaugcagcgguuugcccagcagcaucaggcccggcaggcugccucuuagcccaccacccuggccugcuguccugcgucuauccauguggaaugcuggacaauaaagcgagugcugcccacccuccagcugccgc

SEQ ID NO: 18638 - RNA, 6520 nt, Homo sapiens
cauucugggaguugaagagcgggcagcuggguggggagugggcuggggucauggcaaggaagccugagaggccagcaggggcugcccggcccaccuccaccccuuuuccuugagaagcaagagguugaaggucagcaggaccagguggagguccuggcagaacgcagggaggugggcaaugcagagggacccuggggaggagagggggcuagcacagagggacccuggggaggagggagggaaggagggggcuagcacagagggacccuggggaggagggagggaaggagggggcagcacagagggacccuggggaggagggagggaggcagggaggugggcagcacagacggacccuagggcucugggcuggggagauggggaaggccuuuccagaauucuggagcucuccugggagcgggaugguggggagaauaggaagagcaaggaaggacagacagaaagaccaaugcaagaaaggaccuugcagcaacagagggaaggagccagcagagagaugggcugagugggucagagacggcagagacaccacuggauccagacugacagagauggcggcgagucagaggggauggagacggggcugcaggcaaaacagacacagaggcagagggggcacagaggggcaggcggugagauggaaacugagcaaggagguguguggggcaucaggugcgcgugagccagagagaugcaggcagaacacugcgggggaggaggccaaaggcaggcaggagggccgaccacuggggccacaaggaugaucagguggagccccgggcacagucugugaccagcaugaggggcuucaccaggcugacagggccacacgaggggccacggggagcuagggaggauacaagacucuggggacacggggcucucccaguuuauggaggaagggacagaaagaagaguagcagggacccaggccacaccuguggcugcccacaagaccacucucccgcaggacuggggaggccggacggagcagcgucccucagccaggaggagguaccaagcccucaucuccauggcccagccccagggcccagcagagggcagccucccaacgggggaccccagccccucugagggcacuccaggaaccagccaggccccuggcagcccagcagccacccggcgacgagagcuucuccgggagcucgaggcccaggugcaggcagccuacgggcagguaaugcgggcagggguaugaggggaccaggaacaaagagcagggaccccacaccccaacugggggccccggaggacagacccaggacuuaguccagggaggggaccaggaggcagaguccaaugggagacucucugaggucggcagggccgggguggcuucccuucccaaucuccacccucaccgagcccugucacugcccacagcacauaggcgguucccuucugcuccucauccaagggcggggcaccaguccaggcagggggagccaagugcaagcaauuggggcuaccccgaggugaggagcccagggcccagcugggguccuggcagggagaggcaggggcuuccugggcugagccaaguggcugccucuuucugggaggcugugugggaaggcccgcguguccauaccaaccggaaucugugccauucggagggcccagcccacccuggcacacugcacgccugccuuccuccuccugggacccaggcccugcuucugaagacauuaaaucuccccugauugggagagauuagaggcagggguugggggagggugcuggagaaggggcgucuggaagacccucaggaggcagucuggggaggcugugcucuccagggggccuugggcccaaguggcuccccucagcagcggagacgcucaaagauaaucccggauuaggacccaagccccaggcccaagucccccgccugcccacccgcccccgaucuuccccacaaaaccccaggaaaauccccggcaguacucccaggcucucaucgggagcagcugggggcuggcaggaguccucaggcagcagcauccgccgaggcccacccgggccacccccgggguuccaggccuggcaugguucagggcccauggggaacugugccaagcggcccuggcgccggggcccuaagguaggaggggucaggggagaaacccaggccaggaggcuggaauggacccugagggucagaugggaugggcagagcccuccgagggccgggcgggguugggggcugcccacugccccagguggagauuuuuuuccuggaagccacagccucuggccauccugaucuuggcucccaccgaccucugggucuccccugccaggcuccaggucccccagcugcccguccagcugccccaucccggcugcagguccccgcucucugcuagccagccuccaucuaggagacagagcugggcacaaggucccucucugccgcuggcuuucucaguggccuuggccaagucucuugccuuuucugguccucaguuugcccaacagaacaguuagaggauugacccuuucugccuaaagaguucacgggugaggguccucucucuaccccccagccccuucccuacugucccaugccgggcuccaaagacaggagcagcuggugagaggaguggggagggcuaucaggcccagagcucagcggccacugccccagcucacggccggcucugcugcaggaccccuugcaguggcucggcuccccaccaaggggcuccugccccagccccagcuccagccccaaggagcagggggaccccgcgccaggcguccagggcuacucggugcucaacagccugguggggccugccugcaucuuccugcggcccagcauugccgccacccaacucguauguacggccacccgcccgccagccugccugcccuugccccucucccaccagcucaccugcccuugccccucgcacuccagcccaccuacccuugccccucgcuuugccucuccuggagcuagggggaagaggauugaguggggacaucagagcaaagguacacagaucuggggugggggugcagagaggggagagagcaaugacucuagaaauggaagagagaucaacagugacauugaggcuggcgggaccaagucugagguucugcccaaaccccagauccaccaccagcaaagggagcccccugccccagaagagggugauggaguaggugaggacggcccaaggagugaccuaggccagaagcagggaagggggcacccgguuacccaggccagugaguaggauggggugggaaccagggccgagcaaucagacagacacaggcccugcgugugcguguuggauuguggggcuggguggggagccccgggaagcaagaaggaagggcacagucaucaguaggagcagggaauuccuaaccccucugugcccuucaggaccgggagcugcggcccgaggagauugaagguaaaggguuggagaaggaacugguucccugaaggggagguggcauggggggcaugggguggggacacaggguugggggggcaucgggugggggccucaguguuuccaggaggaagugggagcaagaaggcugcaggggaccaguuuagggaaauggggacaagacugagcagggaggggaugacagacccccacccagcugucauuccuuggucucacucaccaggcaggugacagggccccuuuuauauuuguucauucagcugacacuuccugggugcccacugugugccuggcccuggcugagcacugggaaacauggccagcuagacagauauggcccgugcccucuggagaccaacgucaauuagucagcuacaaguacaaauggugcaugugcucuccaggaaagggacaaaugggccgggggaggccacauguagagggauggcuuccuuuaguaggugacauaggaccaaagaggaaggggaagagugaggaaaucuccaagaggucagaauuuguuucccccacuuucuuucuuucuuccuuuuugaaaaauuucacugcuguauccccagugccuagagcagagcuuggcacauaguagaugcuccucaaauauuugcugaaagaacaaauaacaggaacagcacgugcaaaggccccgaggcagcaaagagaaucugauguucagaaggagggaugauuggaccaagggagaaggguaggcggguccaggccaggaucaggggguugugggggaaggacugaccccacccugccuggcagagcugcaggucgccuuccaggaguuugaccgagaccgggacggcuacauuggcugccgggagcugggugccugcaugcggacccugggcuacaugcccaccgagauggagcucaucgagaucucacaacaaaucaguaugugccucggacccauccccauccccaguccuccagaugcccccgcugggcccaugaagccaagcaguccagguacacaggugacugcacaggcuguccccagagcccaugaccuuggucauucucaaggcaagcucucugccucuggagaaucucaccagcuucuaggaggugggcacagcaaggacugugauccucauucugcagaugaggcaacugaauggcuaagugacuugucuaaggucacacagcaaguuccuuggagccaggacuugaacccaaccgaagaguucaggaaaauuaaggaaaguuccaagaaguuuuuugguuuuuuuguuuguuuguuuuuuguuuuuuguuuuuuguuuagauggggucuuuuucugucacccaggagugacaauggcgcuaucucggcucacugcaacaucugccuccuggguucaagcaauucuccugccucagccuccugaguagcugggauuacaggcaccugccaccaugcccagcuaauuuuuguauuuuuaguggagacgggguuucaccauguuagucaggcuggucucgaacuccugaccucaggugauccacccgccucagccucccaaagugcuggcauuacaggcgugaaccaccgugcccggcccaauaaguuuugagagugguuuuccuuucacuuuuggccaaaucugugccuuguuuggagggcgauucccauugggaaauacagaugacccaggcuucuggcgcagagggaggaaaggauccauucacgaagggaaggcagagggcagaggagggagggccagggaggggcaggggucucugaugcccugggucuguaauggacgggacccccagguggcggaaagguggacuuugaagacuucguggagcugaugggccccaagcugcuggcagagacggcagacaugaucgguguccgggagcuacgggacgccuuccgggaggugcggccacuggggcugagggcgggcagggcugcgugucugccgugagugaggggcugcgcgugugaaugacugucagugaccagacgccacaaccaacgccgccacaguucgacaccaauggggacggccgcaucagcgugggcgagcuccgggcggcccucaaggcccugcugggggagcgccucagccagcgggagguggacgagauccuccaggacguggaccucaauggggacggucuggucgacuucgaagguacccccugccgcacauagcaacacacgcccuggaaggguccuagcagauaagaaaccgcacagcaagagucaccacugggcaccagacccugugccacgcacucccauguccucuccuaguuaauuaucauggagaauccgagaggaaggaauuguuauccccauaggcaagagaagaaaguccauucucaggaaagccuaggcacuuagcaaaaaagcaaguagauggagucaagauuugaaucugggcagccugauccagaacccagcucuuccucuaugcugcauucccauaaagggguaaaaugauuaaauaauaauagaagccaaggaaaauuacuauguggaaauguauugccauaaguaggccucaaaguugcuccugagcuuccuagcugucaaagcaaaaaggaaaacaaguuccauuacaaggguuuguuuguuuuucccccauaagacaaagccuccucuucccggcucugaggccuauucccuaucagauccagaggaugcccuugaagacccuccccucaaccacacucccacccgccccaaggccugcagaugauccucacuccuagcgcaguccagagaacagacccaaaaccuuggcuucguccuggcagaguuugugcgaaugaugucucggugagccuguacagaagcuggaggcagcauaaaggacucaaggaccacagccucugcccaccagcauguuccuugaagcccaucgccucuagcggggacccuccuuuccuccccaucccaccugugugcagugcccuugccugccuucacccccaccaccacuucuccaauaaagccgccuggccuugucucugucucucugacaauaaaauaucuccaagccuggggagau

SEQ ID NO: 18639 - RNA, 2214 nt, Homo sapiens
cugagagcacaacuccaaaucaucuuuuauuaauauaaaaagggcauauuuagcaaaagacacacagauaaaagagucacuauggcucaggacacaaggcagggaggugccaggccugugccccugcugggggagaaggaggcucgggacaaagugggagaagugcugggaagggcugagcgguaggggccacaaaaguuccggugggcaacacugucggcaggucaugggugggacucauggggaccucgcugcuaacucuuguuguggggggguguccuuagugcugccaccuggagggccacuccuugguuccuggaggggacccaccaagggacacaggacaggaagcccaggaugguuagugcaacucgggaugaaggccagggagaagcgggugcucugcaguggccggauagguccagacgcugaggccgaggcgcuuccuguuacgugcgggcguuccgcucugucucugccaggcacucucugacuagggcccgggcauggaugauaccugggggugggguggggucucagcaacccuccacagccccacccacugcccuccagaggaggaccccugccuccccacucccuuuccacuuucggcaaaagaaauucaaaucuaaugacggcuagaugaaauuagagguuugguuaauccucaagguugcccuguugaaauacaaauucccaugcucuucccuggaaauggacucaauuucaauucgauucaaaacaccucucugguaguaauacuggacauccucuaggcuuggcucagguggccuccagauguccuuccuucccucaugaaggauaguccagugucgguuuccugagcagggcggccuggccucacuuaccucucuucaggcgcuccauggcgcucuugcugccagcauagguaggccggaucucuuugcccaucuccucuaugacugacagcagguccguguaggugcucugggagcccugggcgccggguggcuucaucgccuaugucaaaagagaacagggcagugagcucaggcaccuggcggggagggggacuccaguccgcauccauaagcaaggcuuuggccccacucaccugcacguagcccauggaaggcgguccaaagucguuaaacagcggucugaaaggagcgccggcuccuggcacugagcccgacggcgacgggacgcuuccugcagcaacaggcgcgaguaagaggucagcgcggggcagggacgccgccucccagcuuuuccaagcccaggaccggguucgcccgauucccuccaaaggaugcuucauuccaugcugaucaacuucagggacaaaucccucccacugcgcuccaccuacaagcccuuacgugaccacgcccacuucacaggccagcaaacugaggcucagcgaggguaggcggcaggcccaguauugcagaacucaggccgucuucucuucgagaccucgaccgcccggcaggcgagcagggguggagcuggauccucaccuguagggaccggggugcccggcccaggggugcuggagccaggggugcugcugggagcaggggcgauggguuuguaggacauccccaacuccugggcgcggcggacgccagccggccgcuccucggggguuggcugcggggccgcucagccgcgcucugauuggcaagcgggcugcacgccccugguaaauagaggucuggccggaagggcgagcgggcacgaaugcucccucacucccgauuggugcgcgaagaugucacucgagccuccuuauuggccgagaccugccccagcaggucgcaaccgccgccgauuggccuccgccuuccggaccucgcaccugucugcuccggauugggcgguggccaccgcccuccgcaauuggcgaguucgcggcccgggccggcgcgcucucaauccgauuaguccccaggcccuagaggcggggccuugggaaccgggacccggggcugggcugccgguucgcgccgaggggucuucccgggcgcgggcgcuacccucgcgccucacucgcgcugcuucagacgucugcuccgcucugcccaguuucggcccagcagggguugcugucgcagcugccgucgccgcugccaccggugccuugcgcgcuucuccgcucugggggccgaaggacgcagggcuuugacgucccgagcccugcgccccaccccgugcgcuuuuacguca

SEQ ID NO: 18640 - RNA, 6177 nt, Homo sapiens
gggcggggcaugcgggggcggggcagcggcgacgcugggugugugggcgcagauggcggcggcgcacggcgccugagcgggccggggccaugagcgccgcccggccccaguucagcauugaugaugccuucgagcugucccuggaggacgggggcccugggcccgaguccagcggggucgcgcgcuuugggccgcugcacuucgagcgucgggcccgguucgagguggcugacgaggacaagcagucccggcugcgcuaccaggugaaccgcccggcccaccuaacccccugcccccggccggacgggaccccaggccgggccccaaaggccucaacucggggaagcaucugccuagaggccccagcugaagcgcgagaccgcccccccgccccgcggacgugacucuugauccagagcccugcccaggcccucccgguucccauaccgggccccagccagccgggaagagcccagugcccgggcccgggagcucaucccucagcuccagcuggggaacccaaccggauuccccacucauccuggcuacucgcaccuggcccccgcuggguugggggagcuccucuguaucugaaccagaccuugccccacacgcaggagcauccccugugccccaggccagcuaagcugaugggaacccgcacgccuuucucuauucugaaagcccucucccuaaucccaccaccaccccuaagagcuggagcuccucucacaugaccaguccuugcccacccuuuggcucccacuaaaccagaaaaacccauuuucccagaaaaccuccaccaacccuaggcugcuuuucuuggagaccuggaccagaacccugugccuugaaccugggaacucugggccuggccuuuccuggcaccccaauucccaagcucccauucuaggccacugaaugagagcuccacccuaacccaaaguugggagcucuccuuucccugggaucuaugcaggcuccugcuccccaaagcccuggcauccacccaccuccuaccugguuucugugaaucaccaaacccguucugcggggagggcagagggccaggugaacagcugccaggcggccaggcaaaugguuguguaggccugcuuuucucuucccgggagggagugaggaagggccccagcccagcaaccccccugagaccuguguucugcaacagaaccuggagaacgaugaggauggagcccaggccucuccggagccggaugggggagucggcaccagguuagggccagguggggacccaacccuguaccccagccccagcuccuauccccagggacccugcucagucacccaccccacuucacucacucucuuccaucccguccuauugauuccuagccugacccucacuuuccucacagggucuccuacacuguagggucacccuacccuagugcccagcuguacucaccucuuucagaaacccccagucuggucuggcccccaccuucauacaggucaccuguccuacagaauccccuagcucauccccagccccugaauucaugcucacccaccgaggccucucagggcccacuauccugcaaggggccagccccagucccugcaccaugcccugcacuucaucaggacuccugucccaaagcaaccccguccuugccucccugccccucacugggcgccuguccuggcagggauuccagccgaacuuccauccgcagcucccagugguccuucagcaccaucagcagcagcacccagcgcuccuacaacaccugcugcaggugagccugcccgccuaagcccccagccgagcagcccuggcuccacccccacagccuccugcacccccucccuccaccuccuucacauucacccugcucuccugccacccagcuggacccaacacccuuugauccagaagaaccgccgaguggugcuggccuccuuccugcuccugcugcuggggcugggugaguggcccugaggguuggggucaagaggggccccgugggaggcucugcccuccuuuuguacaggcucugccucccccuugacacugagccucccagcauccugaggaggcagcuggcugccaucaucacacucccauuuuacaggugaggagacagaggccuugugaccugggcacacagccaggaaaucacacauagcugaaaauggaaccuggcuuaucacugcaaagacuuuuccuuuuuuaaaaaauuuaaccuguuuaaauccauuagaggacagaagaguagcagcuaccauuuauucugugucuacucugggcaaggugcagggcaguuuuauuuucccaucuuacagaaguccuacaagugagguggugcccagaagccacguguaggggcucagggaugccgagugcccagccagugcagagccgcagggcaccuggcacuuccccuugucuggcaucuaagcacugacaagcaccccucuccuacccauugcucagaugggggaacuuuugguccagagcaggcagaucucacaccagguguucuuuggcucccaggcaccucguucuuugggguagaggaggcagaguccccagaaaggauccaggguuggggucacgagugauccauaagaagggacuaacuguggcugcuacccuggcucaucucuccgcuucuccaggaaggccaaggcuccccagccagccaggccccuggcacagagucuggccucugcucaggguguuugagugugggggagggggcugccacuucccagcaccgcuguacacuggcccugguagugcugccaaguucuuucauuuuuccccucaacccagcaaggcaagccuggggcuaccagagcgccuuagagggccuuuguagggugcagggagugaguuucagcccccaucauacccuauaccccuuuauuuuuauuuauuuauuuuuugaggaggagucuugcucugucgcccaggcaggaguguaguggcgcaaucucggcucacugcaaccucugccuccuggguucaagggauuuucaugccuuagccuccagaguagcugggauuacaggcgcgcgccaccacaccuggcuaauuuuuuguauuuuuuuaguagagaugggguuucaccauguuggccucaggugauccacccaccucagcuucccaaaguguugggauuacaggcgugagccaccacgcccagcccuuuuuauuuuuuagagacagggucuuguucuguugcccaagcuggagagcugugguaugaucacugcagccucaaacucuuggacucaagccauccucccagcugagccucccuaguagcugggacuacaggcauguaccaccaugcucagcuaauuuuuuuuuuuuuaaaauaauaauagagacaaggucucacuauguugcccaggcuggucuugaacuccugaacucaagugauccuccugccucagccucccaaagugcuaggauuacagccaugagucaccacgccugggcugggcuaauuuuuuuuuaaccuuuuauagagauggggaucuugguauguugcccaggcuggcuucaaacuccuggccucaagcgaucuuccugccuuggcucccugaagcacugggauuacaggcaugagccaccacaccuggcccacccuuuuugaaguagucugggcaaugcacaaagcaguccaugguggccccccagucccccaggcuuacuaccccccuuguugcagagcccaaaguccagcuccucauucccccaucacucuucuaacuggggacccaggacuccugcacugcccuguucuuacccccuauaucccaaucaccuguacuguuagcuuucagguucuuauugguuccuccacuaaggacgggccaugagggcagggaccuuaucugcccuucagggcggaauucccaguaccaggcacgcaguagguguuccauaaauguuugcugaaugacuaaaagcccaccccaaggaacaaagaaaaaucucuccuuucacacacuucccagggccugcucagugccuugcucuggaaacagagcuuggugagcuuccuggggagggucucugccuagggcaccuucagcucagguggugggugagccgggcugggggugggagcccccgcccucaccacugcuccugcccccacccccgcggcuccgucugugugcagugcugauccuggucggcgugggacuggaggcgacccccucuccaggugagcgacccucccgcccccacaggcagaggacaccccugucuuguguccacggguccacggcaagcccucccaccucccggcaguacacggcuccuuuucagcugggagugaggcuugcccgggcagucagcggcagcccggaaggccucgaagccuccgcccccucgcccugaccgggcucuggucccucccgcaggugucuccagcgccaucuucuucgugccgggcuuccuguuguuggugccuggaggugcgagcgggcaccggggcggaaggggcgggggcuguggggcggcacugggggcgguguugcggggaggggcggggcuucugcgcugacaggccccgccccgcagucuaucacgugaucuucaucuacugcgcggucaagggccaccggggcuuccaguucuucuaccugcccuacuucgagaagugaucgcggcgcagcguggaccccuugcgcccaugggggcgccccucuugcccuguuccguuccccucaucucaagggaagaggcccuccaggacccucgaaaccccagccccuagggaguuugcucaggaaguucggggcaugcaggccuggcccugggaaagccgcccgucgccugcucugugccuuaacuuauucucgggccgugcggcugcuagguugcuguuauuuugugcuaauaaaagaguaauuaauuccaccagaggcaauugcucuccuccuguccugccacugcuagcccagcccaccagccugaccacagccccccucccaaggacugacccugacgcugaagggcuucgagcaccaccgaacgcguggcagcccugaugcugaggcuugcccaagggcacggggcauguuaggggcagagcugggcguaggacuccugccuugccagccaggagccggccggaacagccugccccacccccagcccuuggaugacucaaccagcccgucucugucugguggcccuggccgagggcacgcagagaugacgcaggccugggaccuggaggcugguauccuaguuccagccuggcucuggggcccugggcugccacagccagcccugaaugugggccaugucaaggcaauggcccagcccccuccacccacugcccuccuucccagucccagagguugggagaaccugggggcagagggcauaggaagccgcgccugacagacacccucaguggucaaagacuuagaaaugcagaacguuagaaacaaaccaucucagaauuuuggaacaucagcauuucagaaucuuacgaaacaagaaacagaaucuuugagaaaccugaaaucugagaucauaguagcuaccaguuaucaauuuguugaaagaccccaggauggccgggcacgguggcucaagccuguaauccuagcacuuugagaggccaaggugggaggaucgcuugagcccaggaguucgcgaccaaccuggacaacauggcgagaacccaucucuauuuaaaaaaaaaaaaagaaaagaaaauauacuaggcccugcgcuaagcacugaacacggguuauaucuuguaaucuucacuaccuccgucccauuuuacagauaaggacugacucacccaaggacagccagcaggugguagguagaauuaggaacguagcccagggcucuucccaugacacugucggggagggagaaggaaaccggcacugagcuggucuccccuaccggccaaccaagaggcuggcugagugagcaaggguugggaggcccuguuggugcaccugcccguacugucuaucucccccaccaaaacacgggucccacaaaccacugucugcagcacccaacacagcggggccuucaggauucugaguuagaggaauggacacccagacucuugcucucgcucccaccuuuccaggccccgcagacuucccacccucaucccccauucaaggcacuuaggg

SEQ ID NO: 18641 - RNA, 6177 nt, Homo sapiens
cccuaagugccuugaaugggggaugagggugggaagucugcggggccuggaaaggugggagcgagagcaagagucuggguguccauuccucuaacucagaauccugaaggccccgcuguguugggugcugcagacagugguuugugggacccguguuuuggugggggagauagacaguacgggcaggugcaccaacagggccucccaacccuugcucacucagccagccucuugguuggccgguaggggagaccagcucagugccgguuuccuucucccuccccgacagugucaugggaagagcccugggcuacguuccuaauucuaccuaccaccugcuggcuguccuugggugagucaguccuuaucuguaaaaugggacggagguagugaagauuacaagauauaacccguguucagugcuuagcgcagggccuaguauauuuucuuuucuuuuuuuuuuuuuaaauagagauggguucucgccauguuguccagguuggucgcgaacuccugggcucaagcgauccucccaccuuggccucucaaagugcuaggauuacaggcuugagccaccgugcccggccauccuggggucuuucaacaaauugauaacugguagcuacuaugaucucagauuucagguuucucaaagauucuguuucuuguuucguaagauucugaaaugcugauguuccaaaauucugagaugguuuguuucuaacguucugcauuucuaagucuuugaccacugagggugucugucaggcgcggcuuccuaugcccucugcccccagguucucccaaccucugggacugggaaggagggcaguggguggagggggcugggccauugccuugacauggcccacauucagggcuggcuguggcagcccagggccccagagccaggcuggaacuaggauaccagccuccaggucccaggccugcgucaucucugcgugcccucggccagggccaccagacagagacgggcugguugagucauccaagggcuggggguggggcaggcuguuccggccggcuccuggcuggcaaggcaggaguccuacgcccagcucugccccuaacaugccccgugcccuugggcaagccucagcaucagggcugccacgcguucgguggugcucgaagcccuucagcgucagggucaguccuugggaggggggcuguggucaggcuggugggcugggcuagcaguggcaggacaggaggagagcaauugccucugguggaauuaauuacucuuuuauuagcacaaaauaacagcaaccuagcagccgcacggcccgagaauaaguuaaggcacagagcaggcgacgggcggcuuucccagggccaggccugcaugccccgaacuuccugagcaaacucccuaggggcugggguuucgaggguccuggagggccucuucccuugagaugaggggaacggaacagggcaagaggggcgcccccaugggcgcaagggguccacgcugcgccgcgaucacuucucgaaguagggcagguagaagaacuggaagccccgguggcccuugaccgcgcaguagaugaagaucacgugauagacugcggggcggggccugucagcgcagaagccccgccccuccccgcaacaccgcccccagugccgccccacagcccccgccccuuccgccccggugcccgcucgcaccuccaggcaccaacaacaggaagcccggcacgaagaagauggcgcuggagacaccugcgggagggaccagagcccggucagggcgagggggcggaggcuucgaggccuuccgggcugccgcugacugcccgggcaagccucacucccagcugaaaaggagccguguacugccgggaggugggagggcuugccguggacccguggacacaagacagggguguccucugccugugggggcgggagggucgcucaccuggagagggggucgccuccagucccacgccgaccaggaucagcacugcacacagacggagccgcgggggugggggcaggagcaguggugagggcgggggcucccacccccagcccggcucacccaccaccugagcugaaggugcccuaggcagagacccuccccaggaagcucaccaagcucuguuuccagagcaaggcacugagcaggcccugggaagugugugaaaggagagauuuuucuuuguuccuuggggugggcuuuuagucauucagcaaacauuuauggaacaccuacugcgugccugguacugggaauuccgcccugaagggcagauaaggucccugcccucauggcccguccuuaguggaggaaccaauaagaaccugaaagcuaacaguacaggugauugggauauaggggguaagaacagggcagugcaggaguccuggguccccaguuagaagagugaugggggaaugaggagcuggacuuugggcucugcaacaagggggguaguaagccugggggacuggggggccaccauggacugcuuugugcauugcccagacuacuucaaaaagggugggccaggugugguggcucaugccuguaaucccagugcuucagggagccaaggcaggaagaucgcuugaggccaggaguuugaagccagccugggcaacauaccaagauccccaucucuauaaaagguuaaaaaaaaauuagcccagcccaggcguggugacucauggcuguaauccuagcacuuugggaggcugaggcaggaggaucacuugaguucaggaguucaagaccagccugggcaacauagugagaccuugucucuauuauuauuuuaaaaaaaaaaaaauuagcugagcauggugguacaugccuguagucccagcuacuagggaggcucagcugggaggauggcuugaguccaagaguuugaggcugcagugaucauaccacagcucuccagcuugggcaacagaacaagacccugucucuaaaaaauaaaaagggcugggcgugguggcucacgccuguaaucccaacacuuugggaagcugagguggguggaucaccugaggccaacauggugaaaccccaucucuacuaaaaaaauacaaaaaauuagccaggugugguggcgcgcgccuguaaucccagcuacucuggaggcuaaggcaugaaaaucccuugaacccaggaggcagagguugcagugagccgagauugcgccacuacacuccugccugggcgacagagcaagacuccuccucaaaaaauaaauaaauaaaaauaaagggguauaggguaugaugggggcugaaacucacucccugcacccuacaaaggcccucuaaggcgcucugguagccccaggcuugccuugcuggguugaggggaaaaaugaaagaacuuggcagcacuaccagggccaguguacagcggugcugggaaguggcagcccccucccccacacucaaacacccugagcagaggccagacucugugccaggggccuggcuggcuggggagccuuggccuuccuggagaagcggagagaugagccaggguagcagccacaguuagucccuucuuauggaucacucgugaccccaacccuggauccuuucuggggacucugccuccucuaccccaaagaacgaggugccugggagccaaagaacaccuggugugagaucugccugcucuggaccaaaaguucccccaucugagcaauggguaggagaggggugcuugucagugcuuagaugccagacaaggggaagugccaggugcccugcggcucugcacuggcugggcacucggcaucccugagccccuacacguggcuucugggcaccaccucacuuguaggacuucuguaagaugggaaaauaaaacugcccugcaccuugcccagaguagacacagaauaaaugguagcugcuacucuucuguccucuaauggauuuaaacagguuaaauuuuuuaaaaaaggaaaagucuuugcagugauaagccagguuccauuuucagcuaugugugauuuccuggcugugugcccaggucacaaggccucugucuccucaccuguaaaaugggagugugaugauggcagccagcugccuccucaggaugcugggaggcucagugucaagggggaggcagagccuguacaaaaggagggcagagccucccacggggccccucuugaccccaacccucagggccacucacccagccccagcagcaggagcaggaaggaggccagcaccacucggcgguucuucuggaucaaaggguguuggguccagcuggguggcaggagagcagggugaaugugaaggagguggagggagggggugcaggaggcuguggggguggagccagggcugcucggcugggggcuuaggcgggcaggcucaccugcagcagguguuguaggagcgcugggugcugcugcugauggugcugaaggaccacugggagcugcggauggaaguucggcuggaaucccugccaggacaggcgcccagugaggggcagggaggcaaggacgggguugcuuugggacaggaguccugaugaagugcagggcauggugcagggacuggggcuggccccuugcaggauagugggcccugagaggccucggugggugagcaugaauucaggggcuggggaugagcuaggggauucuguaggacaggugaccuguaugaaggugggggccagaccagacuggggguuucugaaagaggugaguacagcugggcacuaggguagggugacccuacaguguaggagacccugugaggaaagugagggucaggcuaggaaucaauaggacgggauggaagagagugagugaaguggggugggugacugagcagggucccuggggauaggagcuggggcugggguacaggguuggguccccaccuggcccuaaccuggugccgacucccccauccggcuccggagaggccugggcuccauccucaucguucuccagguucuguugcagaacacaggucucagggggguugcugggcuggggcccuuccucacucccucccgggaagagaaaagcaggccuacacaaccauuugccuggccgccuggcagcuguucaccuggcccucugcccuccccgcagaacggguuuggugauucacagaaaccagguaggagguggguggaugccagggcuuuggggagcaggagccugcauagaucccagggaaaggagagcucccaacuuuggguuaggguggagcucucauucaguggccuagaaugggagcuugggaauuggggugccaggaaaggccaggcccagaguucccagguucaaggcacaggguucugguccaggucuccaagaaaagcagccuaggguugguggagguuuucugggaaaauggguuuuucugguuuagugggagccaaagggugggcaaggacuggucaugugagaggagcuccagcucuuaggggugguggugggauuagggagagggcuuucagaauagagaaaggcgugcggguucccaucagcuuagcuggccuggggcacaggggaugcuccugcguguggggcaaggucugguucagauacagaggagcucccccaacccagcgggggccaggugcgaguagccaggaugaguggggaauccgguuggguuccccagcuggagcugagggaugagcucccgggcccgggcacugggcucuucccggcuggcuggggcccgguaugggaaccgggagggccugggcagggcucuggaucaagagucacguccgcggggcgggggggcggucucgcgcuucagcuggggccucuaggcagaugcuuccccgaguugaggccuuuggggcccggccuggggucccguccggccgggggcaggggguuaggugggccgggcgguucaccugguagcgcagccgggacugcuuguccucgucagccaccucgaaccgggcccgacgcucgaagugcagcggcccaaagcgcgcgaccccgcuggacucgggcccagggcccccguccuccagggacagcucgaaggcaucaucaaugcugaacuggggccgggcggcgcucauggccccggcccgcucaggcgccgugcgccgccgccaucugcgcccacacacccagcgucgccgcugccccgcccccgcaugccccgccc

SEQ ID NO: 18642 - RNA, 7990 nt, Homo sapiens
cugucacuuccugaauccugcuuccugcuucccagaggccgggauccggagccgcccgaagccggugccgcagcccccugcgcccccggugcccccggugagcgcggcagggccggggcuaggggcgcgggcugggggcugggcggggcugcaggggccgggcugagggggcugaggggggaucgcgggucccaggagccuuucgccuccccucuaccccacucagucccacuccccuuggccgcccagccucuccucuccugggcggaggucccuggaaguugggcuccugguucacccuggaccccgauucgaggccgcucuggguugcuucgcggcccacagcugcgucccgaccccgucccuuccugggggccaugccggggcucccuggacauucccugggacucagaacugggcacucacucggccccacaguagagagacuuuuccugcuuccucucuccuucuuccccauuaccuagccuccaaaucucugggagcaggaaggaggcugcucccgacuggcugggaccuacaguagagcugagagcucuccaaccccggcaccucccaccuccugcccccgacacacaccagagccagggaggggcccugcguccugcaaagccccucaggacucagcaguggucagggccggagcauuuaccucucagaucacugccugcggggugacaggcggccaggcucugcaccugugaccccauucuguaacuggguaaaccgagacccaggaggguuacgguggccuggcccccgguugcauccucccggcucaccuucagcagccuggggagggcuggaguuguugggaugggccggacugacccaggccucucugucccgcagacauguccuuccgcaaagugguccggcagagcaaauuccggcauguguucgggcagccggucaagaacgaccagugcuaugaggacauucgcgugucccguguuaccugggacagcaccuucugcgccgucaaccccaaguuccuggcggugauuguggaggccaguggagggggugccuuucuggugcucccccuaagcaagguggguccugucaggguugggggaagaggaggcaccucggccaccccuacugggccuuucugcacaccuugaaucccucaucuugccguuucucacacugcugggcagguguuauaacccagauuuaucgccccaaguguuagcacagauggaaaguagccuguugccauagaggcaggguuagaggcagcaaacauuuccugcucaccuggcaaguggggcacagucacaucugggccaccugugagccgggacgugcaugucauucccacuccauggaggggaagaccaaggcuucgggagggauggagcccacugacugcccccucgugcccacagacgggccgcauugacaaggccuacccgacggugugugggcacacgggaccuguccuggacaucgacugguguccucacaacgacgaagucauagccagcggcucggaggacugcacggucauggugaggcacaggacuggcugggccagggucguggguguggccgaagggggccagcaauaggaccagcagaggacugagcucgguggcccugucccuaccacagguguggcagaucccagagaacgggcugaccuccccgcugacagagccgguggugguacuggaggggcacaccaagcgagugggcaucaucgccuggcaccccacggcccgaaacgugcugcucagugcaggucugcaccgccccccguuuugugcuccccccccccacggaccccuccauacaucccagcagccccuccagggcccacaugacaaaugggaaagcugaggcccucagaguuggagagacccgucugucccaggguggugggcagagugggccucagccuggugagcuaauggccuccugccacccacccggcccgagcugacaacccucaccugccaggcugcgacaacgugguacucaucuggaaugugggcacagcggaggagcuguaccgccuggacagccugcacccugaccucaucuacaaugucagcuggaaccacaauggcagccuguuuugcucagcaugcaaggacaagagcgugcgcaucaucgacccccgucggggcacccugguggcaguacguggcucuggagggcaaggauggcuguggauaggcccaggaccuugagcagggcgcugcacugaccagccuguccccccgacaggagcgggagaaggcucaugagggggcccggcccaugcgggccaucuuccuggcagauggcaagguguucaccacaggcuucagccgaaugagcgagcggcagcuggcgcucugggacccagugaguggccagccugagggggcaaacuugagacuugggccccacccugggccaggcaggcaggguucacccuggggaggccugugguuccuagcuucucugccuggaacuugaggcucucagggccuaggacucugucagacuuuccucuccugcccccugcucgcccgacugccccaccacucccccauggccucccacugccucugugucuuugcccauguuguucaugccaacggaagggcccuucucucccuugcuugccuguaccacccacugccugcacagggcuccccgcuccuccagaaagccuccuccuccagcaagccuccuggccccagcccucucugcuucugcauagugaccuccagggcaccuugagcaggggcuggugccgcuggcaccccagcuccccacagugagguauguuucagcacuugcuuaguggccugggcauagucuuaaggccuggaggaggcuggaaaagagggacccugggaauaaagugaagccaggagggccaggugggggucgucaugugggaaaaggcauagagauggcagagggcccaccugcauuuaggggcagugcuggcuggccuuagugaggccagcuaaggcccguccugguuugggauuagggggugaggagguucugcuuggccugacugccugcaaugugccaggaaaaccucgaggaacccauggcccugcaggaacuggacucgagcaacggggcccugcugcccuucuacgaccccgacaccaguguggucuacgucugcggcaagguggggcugggcagggcuggcgaggggcagggaagaggcgugcccaggugcugagcccccuccccacacagggugacuccagcauccgguacuuugagaucacagaggagccucccuacauccacuuccugaacacguucaccagcaaggagccgcagcgggguaugggcagcaugcccaagcggggccuggaggucagcaagugcgagaucgcccgguaagagggcuaccgaggccacucggggauaggggcaucuaaggugagaggucaggucauuggaggcugcuugggagcaggaaaccuugcgccagggaggcccggcgggccaugagaacugucacgaggcagcccgugugggggucuagccaccuuaggggucggccugcggagguccuggggugaggacuggaaguggaggaugccaggagagcuggcgguggguggggggggcggugaggguuccacccguggcuccuccuugcauccccagguucuacaaacugcaugagcgcaagugugagcccaucgucaugacugugccaagaaaggugaggccgcccgucccucggcucacuuggcccuuucuccagcaagcgggccaugcaguugugaccagggcgaggccugugaauggaacaugaccuaguaugguuugugggcagugagcuggacagaugccagcuugcccuuguaccagccagcuguugggcugugccagucagggggcaaguggggaugagacagagggugagcaggggcccugcucuggaugagccacaggagaaggacaccaggcagucagggagggaguggcagccacacagaucuuccugaaggaggcaggacccauaacacagcugggguggcgccauccacugggggcaggccaggcgaagggcacaguggugggaauggagagaggaacaaggagucuggcugcaguggggaaucccaugaagaggggaccgggccacauguggcuuggccucagaugccaagagccucggacacgcuuccaugauucucuggccagcauuugccgacugcucuuucaacaugccaggcacauuuuggggaguggagcugagcugauagggccugcuccaggagcucacaguccaugggccccagaaucccauaaagccacauaguggccccugugccuugcaggggaaggugaugacaggggccuugcucagaagggugggaaagcuuccgagggagcuguugaugguguccagaaaggaaguuaaaggccagauuugagcuuuccaggccgugggagaauggguuaacagagugcaagccuggaggccaggggagggaugaggggacccugauggggccuccuaacugauccugaccuccccggcccccugcccagucggaccucuuccaggaugaucuguaccccgacacagccgggcccgaggcagcccuggaggcugaggagugggugagcgggcgggaugccgacccgauccucaucucacugcgggaggccuacgugcccagcaagcagcgggaccugaagaucagccggcgcaacguguugucugacagccggcccgccauggccccgggcuccucccaccuaggggcccccgccuccaccaccacugcugcugaugccacccccagcggcagccuggccagagccgggguaugcacgcgcaggcagggguggugcugggagccccagguguggcccuggccugcugugugggcuucagccauucgcugucccucucugggguagugguggguuugggagggcuauggcuuagcagccccugaccaccgcccccuaccccugcuucauguccccacaggaggcugggaagcuggaggaggugaugcaggagcugcgggcccugagggcgcuggucaaggagcagggcgaccgcaucugccgccuggaggagcagcugggccgcauggagaacggggaugcguagggccacagccacacgccaccuucaucuccuccgccgcccccuucccacucagcuucugccagcgggucgcaccgggcuagcuggcugcccagagccucugaggcagcgcaggggucaguucccacccccacccgucccaggcccaggccgaagccagcgcccagcuuuccucacuguuccuguggaggaugucuacgcccaggcgagcuccucgaccucugagggaccaucuccccgaccacugcccagcccucugcucccuccccagaggaggcgggagggugggcucuauauuuucauuccaaauaaaauucucuuucuaaaagccaggcugaccugcugcugcaaggguggggcugagaagucuggaaaccuggagacagaggaugucacaggagucacacaugugcagaaggucugggggcagugagcagccccacaggcauugcuccccuggauugucaggcagggaaacugaggcagaagaccugagaacacaugcaaggcugcauccagcuucaaguuggugcugcuucuuccuuggaggacaggcccggcagcccagccuccuccagagagacuggggagggucugguguggaccagggguccugcagcagggaggggcaggugggguaugugggcaggaagcggaagccugggccacccuucacugcagacgagcacugagcucacuucucgcucgacacagccagagcuggaggugggugcccggcacggaggggccugcggaccaaugguaagccucggagccccccggguucuugggaugggggccacaggcggucggggcuagaaugucugggccuguggagcuaaggagggccccacauuggccccagggaagaggugagaccuaagaggaguauggcagaggcugaaccuuucucucaccugagcugggcucccugggacuccaggccuggcccccagcaccccauaccggaccaggccccugucaggagcccugggaaggcccuuaccuggucuuccugugagcgggaacuugcauuccuggagccugggcggacagccugggguggugggggaggcuggcugcaccucagcaccccucccccgacaccccccaccuagccuguuccgaccgcagacuuccucuggcagcugcgcccgccucccccagccccccccagcccccggcccugcacgccuguggcccucagggacugggaguggaacggaaacccugccgcuggggcagccccgugguggggagggaggaagaggggccucacggacccccguuuggggaccuggccaagcagaagaugagcaguugccucugggugcauccaggccccuccaucccccaucccaggccucagggagagccagcccugacaccagcuagcaaccuccuucccucccucccaucuccucucccacccacccaggcagccuagacacauuuaauccauacuuauugagcaccuacuaacaugcuugacccaaaaagcccccguuuccuagcagcuuauugugggggguagauaagacaauagacauaaaaaaugaguacaguuaucuccugcguuaggugacauggaaggaaaaaggcacugagugcuggggggugcuggggugggcugcagugauagacaucaggguagagguuaaggucagguucagccucacuggggugaaguuugagcacggugagcaggccaugcagcccgggggaggggaggaugggaggagguggagcuuuccgggcagagggaacagccagugcgaaggccccaggcagguggcuuaaugcagcuguugggggaggugagugguagggaggaggcuggagggaugggggcugaucucacagggccagagccugguugaccaaauaaggccuuggccuuuucugcuuggcugucccaagaggaucccaaagagaaaaaaacgaaaguggucuuggucacccagccugccccacaccaggccccaccccaggugcugagcccucugagccccugccugucucccacaggcucugcccugcaccuuagggcucgggaugcugcuggcccugccaggggccuugggcucggguggcagcgcggaggacagcgugggcuccagcucugucaccguuguccugcugcugcugcugcuccuacugcuggccacuggccuagcacuggccuggcgccgccucagccgugacucagggggcuacuaccacccggcccgccuaggugccgcgcuguggggccgcacgcggcgccugcucugggccagccccccaggucgcuggcugcaggcccgagcugagcugggguccacagacaaugaccuugagcgacaggaggaugagcaggacacagacuaugaccacgucgcggaugguggccugcaggcugacccuggggaaggcgagcagcaauguggagaggcguccagcccagagcagguccccgugcgggcugaggaagccagagacagugacacggagggcgaccugguccucggcuccccaggaccagcgagcgcagggggcagugcugaggcccugcugagugaccugcacgccuuugcuggcagcgcagccugggaugacagcgccagggcagcugggggccagggccuccaugucaccgcacuguagaggccggucuuggugucccaucccugucacagccgcucacuccccgugccucugcuucccaagaugccauggcuggacuggacccccagcccacaugaccaugccucagacugucacccccuaccaguucccaaguccauguguaccccgcucaccacgggaacggccccccccaaccacaggcaucaggcaaccauuugaaauaaaacuccuucagccugu

SEQ ID NO: 18643 - RNA, 7990 nt, Homo sapiens
acaggcugaaggaguuuuauuucaaaugguugccugaugccugugguuggggggggccguucccguggugagcgggguacacauggacuugggaacugguagggggugacagucugaggcauggucaugugggcuggggguccaguccagccauggcaucuugggaagcagaggcacggggagugagcggcugugacagggaugggacaccaagaccggccucuacagugcggugacauggaggcccuggcccccagcugcccuggcgcugucaucccaggcugcgcugccagcaaaggcgugcaggucacucagcagggccucagcacugcccccugcgcucgcugguccuggggagccgaggaccaggucgcccuccgugucacugucucuggcuuccucagcccgcacggggaccugcucugggcuggacgccucuccacauugcugcucgccuuccccagggucagccugcaggccaccauccgcgacguggucauagucuguguccugcucauccuccugucgcucaaggucauugucuguggaccccagcucagcucgggccugcagccagcgaccuggggggcuggcccagagcaggcgccgcgugcggccccacagcgcggcaccuaggcgggccgggugguaguagcccccugagucacggcugaggcggcgccaggccagugcuaggccaguggccagcaguaggagcagcagcagcagcaggacaacggugacagagcuggagcccacgcuguccuccgcgcugccacccgagcccaaggccccuggcagggccagcagcaucccgagcccuaaggugcagggcagagccugugggagacaggcaggggcucagagggcucagcaccugggguggggccugguguggggcaggcugggugaccaagaccacuuucguuuuuuucucuuugggauccucuugggacagccaagcagaaaaggccaaggccuuauuuggucaaccaggcucuggcccugugagaucagcccccaucccuccagccuccucccuaccacucaccucccccaacagcugcauuaagccaccugccuggggccuucgcacuggcuguucccucugcccggaaagcuccaccuccucccauccuccccucccccgggcugcauggccugcucaccgugcucaaacuucaccccagugaggcugaaccugaccuuaaccucuacccugaugucuaucacugcagcccaccccagcaccccccagcacucagugccuuuuuccuuccaugucaccuaacgcaggagauaacuguacucauuuuuuaugucuauugucuuaucuaccccccacaauaagcugcuaggaaacgggggcuuuuugggucaagcauguuaguaggugcucaauaaguauggauuaaaugugucuaggcugccugggugggugggagaggagaugggagggagggaaggagguugcuagcuggugucagggcuggcucucccugaggccugggaugggggauggaggggccuggaugcacccagaggcaacugcucaucuucugcuuggccagguccccaaacggggguccgugaggccccucuuccucccuccccaccacggggcugccccagcggcaggguuuccguuccacucccagucccugagggccacaggcgugcagggccgggggcuggggggggcugggggaggcgggcgcagcugccagaggaagucugcggucggaacaggcuagguggggggugucgggggaggggugcugaggugcagccagccucccccaccaccccaggcuguccgcccaggcuccaggaaugcaaguucccgcucacaggaagaccagguaagggccuucccagggcuccugacaggggccugguccgguauggggugcugggggccaggccuggagucccagggagcccagcucaggugagagaaagguucagccucugccauacuccucuuaggucucaccucuucccuggggccaauguggggcccuccuuagcuccacaggcccagacauucuagccccgaccgccuguggcccccaucccaagaacccggggggcuccgaggcuuaccauugguccgcaggccccuccgugccgggcacccaccuccagcucuggcugugucgagcgagaagugagcucagugcucgucugcagugaaggguggcccaggcuuccgcuuccugcccacauaccccaccugccccucccugcugcaggaccccugguccacaccagacccuccccagucucucuggaggaggcugggcugccgggccuguccuccaaggaagaagcagcaccaacuugaagcuggaugcagccuugcauguguucucaggucuucugccucaguuucccugccugacaauccaggggagcaaugccuguggggcugcucacugcccccagaccuucugcacaugugugacuccugugacauccucugucuccagguuuccagacuucucagccccacccuugcagcagcaggucagccuggcuuuuagaaagagaauuuuauuuggaaugaaaauauagagcccacccucccgccuccucuggggagggagcagagggcugggcaguggucggggagauggucccucagaggucgaggagcucgccugggcguagacauccuccacaggaacagugaggaaagcugggcgcuggcuucggccugggccugggacgggugggggugggaacugaccccugcgcugccucagaggcucugggcagccagcuagcccggugcgacccgcuggcagaagcugagugggaagggggcggcggaggagaugaagguggcguguggcuguggcccuacgcauccccguucuccaugcggcccagcugcuccuccaggcggcagaugcggucgcccugcuccuugaccagcgcccucagggcccgcagcuccugcaucaccuccuccagcuucccagccuccuguggggacaugaagcagggguagggggcgguggucaggggcugcuaagccauagcccucccaaacccaccacuaccccagagagggacagcgaauggcugaagcccacacagcaggccagggccacaccuggggcucccagcaccaccccugccugcgcgugcauaccccggcucuggccaggcugccgcuggggguggcaucagcagcaguggugguggaggcgggggccccuaggugggaggagcccggggccauggcgggccggcugucagacaacacguugcgccggcugaucuucaggucccgcugcuugcugggcacguaggccucccgcagugagaugaggaucgggucggcaucccgcccgcucacccacuccucagccuccagggcugccucgggcccggcugugucgggguacagaucauccuggaagagguccgacugggcagggggccggggaggucaggaucaguuaggaggccccaucaggguccccucaucccuccccuggccuccaggcuugcacucuguuaacccauucucccacggccuggaaagcucaaaucuggccuuuaacuuccuuucuggacaccaucaacagcucccucggaagcuuucccacccuucugagcaaggccccugucaucaccuuccccugcaaggcacaggggccacuauguggcuuuaugggauucuggggcccauggacugugagcuccuggagcaggcccuaucagcucagcuccacuccccaaaaugugccuggcauguugaaagagcagucggcaaaugcuggccagagaaucauggaagcguguccgaggcucuuggcaucugaggccaagccacauguggcccgguccccucuucaugggauuccccacugcagccagacuccuuguuccucucuccauucccaccacugugcccuucgccuggccugcccccaguggauggcgccaccccagcuguguuauggguccugccuccuucaggaagaucuguguggcugccacucccucccugacugccugguguccuucuccuguggcucauccagagcagggccccugcucacccucugucucauccccacuugcccccugacuggcacagcccaacagcuggcugguacaagggcaagcuggcaucuguccagcucacugcccacaaaccauacuaggucauguuccauucacaggccucgcccuggucacaacugcauggcccgcuugcuggagaaagggccaagugagccgagggacgggcggccucaccuuucuuggcacagucaugacgaugggcucacacuugcgcucaugcaguuuguagaaccuggggaugcaaggaggagccacggguggaacccucaccgccccccccacccaccgccagcucuccuggcauccuccacuuccaguccucaccccaggaccuccgcaggccgaccccuaagguggcuagacccccacacgggcugccucgugacaguucucauggcccgccgggccucccuggcgcaagguuuccugcucccaagcagccuccaaugaccugaccucucaccuuagaugccccuauccccgaguggccucgguagcccucuuaccgggcgaucucgcacuugcugaccuccaggccccgcuugggcaugcugcccauaccccgcugcggcuccuugcuggugaacguguucaggaaguggauguagggaggcuccucugugaucucaaaguaccggaugcuggagucacccuguguggggagggggcucagcaccugggcacgccucuucccugccccucgccagcccugcccagccccaccuugccgcagacguagaccacacuggugucggggucguagaagggcagcagggccccguugcucgaguccaguuccugcagggccauggguuccucgagguuuuccuggcacauugcaggcagucaggccaagcagaaccuccucacccccuaaucccaaaccaggacgggccuuagcuggccucacuaaggccagccagcacugccccuaaaugcaggugggcccucugccaucucuaugccuuuucccacaugacgacccccaccuggcccuccuggcuucacuuuauucccagggucccucuuuuccagccuccuccaggccuuaagacuaugcccaggccacuaagcaagugcugaaacauaccucacuguggggagcuggggugccagcggcaccagccccugcucaaggugcccuggaggucacuaugcagaagcagagagggcuggggccaggaggcuugcuggaggaggaggcuuucuggaggagcggggagcccugugcaggcagugggugguacaggcaagcaagggagagaagggcccuuccguuggcaugaacaacaugggcaaagacacagaggcagugggaggccaugggggagugguggggcagucgggcgagcagggggcaggagaggaaagucugacagaguccuaggcccugagagccucaaguuccaggcagagaagcuaggaaccacaggccuccccagggugaacccugccugccuggcccaggguggggcccaagucucaaguuugcccccucaggcuggccacucacugggucccagagcgccagcugccgcucgcucauucggcugaagccuguggugaacaccuugccaucugccaggaagauggcccgcaugggccgggcccccucaugagccuucucccgcuccugucggggggacaggcuggucagugcagcgcccugcucaagguccugggccuauccacagccauccuugcccuccagagccacguacugccaccagggugccccgacgggggucgaugaugcgcacgcucuuguccuugcaugcugagcaaaacaggcugccauugugguuccagcugacauuguagaugaggucagggugcaggcuguccaggcgguacagcuccuccgcugugcccacauuccagaugaguaccacguugucgcagccuggcaggugaggguugucagcucgggccggguggguggcaggaggccauuagcucaccaggcugaggcccacucugcccaccacccugggacagacgggucucuccaacucugagggccucagcuuucccauuugucaugugggcccuggaggggcugcugggauguauggagggguccguggggggggggagcacaaaacggggggcggugcagaccugcacugagcagcacguuucgggccguggggugccaggcgaugaugcccacucgcuuggugugccccuccaguaccaccaccggcucugucagcggggaggucagcccguucucugggaucugccacaccugugguagggacagggccaccgagcucaguccucugcugguccuauugcuggcccccuucggccacacccacgacccuggcccagccaguccugugccucaccaugaccgugcaguccuccgagccgcuggcuaugacuucgucguugugaggacaccagucgauguccaggacaggucccgugugcccacacaccgucggguaggccuugucaaugcggcccgucugugggcacgagggggcagucagugggcuccaucccucccgaagccuuggucuuccccuccauggagugggaaugacaugcacgucccggcucacagguggcccagaugugacugugccccacuugccaggugagcaggaaauguuugcugccucuaacccugccucuauggcaacaggcuacuuuccaucugugcuaacacuuggggcgauaaaucuggguuauaacaccugcccagcagugugagaaacggcaagaugagggauucaaggugugcagaaaggcccaguagggguggccgaggugccuccucuucccccaacccugacaggacccaccuugcuuagggggagcaccagaaaggcacccccuccacuggccuccacaaucaccgccaggaacuugggguugacggcgcagaaggugcugucccagguaacacgggacacgcgaauguccucauagcacuggucguucuugaccggcugcccgaacacaugccggaauuugcucugccggaccacuuugcggaaggacaugucugcgggacagagaggccugggucaguccggcccaucccaacaacuccagcccuccccaggcugcugaaggugagccgggaggaugcaaccgggggccaggccaccguaacccuccugggucucgguuuacccaguuacagaauggggucacaggugcagagccuggccgccugucaccccgcaggcagugaucugagagguaaaugcuccggcccugaccacugcugaguccugaggggcuuugcaggacgcagggccccucccuggcucuggugugugucgggggcaggaggugggaggugccgggguuggagagcucucagcucuacuguaggucccagccagucgggagcagccuccuuccugcucccagagauuuggaggcuagguaauggggaagaaggagagaggaagcaggaaaagucucucuacuguggggccgagugagugcccaguucugagucccagggaauguccagggagccccggcauggcccccaggaagggacggggucgggacgcagcugugggccgcgaagcaacccagagcggccucgaaucgggguccagggugaaccaggagcccaacuuccagggaccuccgcccaggagaggagaggcugggcggccaaggggagugggacugagugggguagaggggaggcgaaaggcuccugggacccgcgauccccccucagcccccucagcccggccccugcagccccgcccagcccccagcccgcgccccuagccccggcccugccgcgcucaccgggggcaccgggggcgcagggggcugcggcaccggcuucgggcggcuccggaucccggccucugggaagcaggaagcaggauucaggaagugacag

SEQ ID NO: 18644 - RNA, 10973 nt, Homo sapiens
caccggcgcgcgcagcugccgucgcggagagaugauguuuagguccgggacugucagucagugcgcggccagguacgggccgacgggcccgcggggccggcgccgccauggcggccguguuugauuuggauuuggagacggaggaaggcagcgagggcgagggcgagccagagcucagccccgcggugagugcccugcccuggcgcgacuggauccuggagccgauccugucacccagccgaggccggagcggcggcuccgcacgcccagagcgggcuccgacucuuugcagacccagauccuucucagaucccggucucuauuaaguucugaucccacccucaccccgaccucucuuccagaaccccagccuuuucucccgauucucccuuuccugccuucgguuucuucccaauucuuacccauccccuacuagcugccaucccugacacccuucucuccugggccacgcaguccaaccugaacgggagcggggagguauccuggcaccuuccuuggcucuuaccccucgguuucucacaggacgcauguccccuugccgaguugagggcagcuggccuagagugagugagggucguguugggggaggggggaauggaguggggaaggggaacuggggagcacuggagccuuguccucauuaacuccuuguguccguaggccugugggacacuaugaagagguggagcugacugagaccagcgugaacguuggcccagagcgcaucgggccccacugcuuugagcugcugcgugugcugggcaaggggggcuauggcaagguaggggcgggcgcacccuccuccuggccucacagccuccaucuggaggcagcaaaggguucucaaaacaaauuagacuugugaaucagcagggccucuaaugggauucagagccagaaacauaaaggagggaaggccaaauccucuccaaucggacuugaaaucuucacugccccacccuuggcagggccuaggccuccugaucccaaagccagagcuucaggguggggcuucuugaagauaggauguggagagggaaguugauccugucuccccugcccuacagguguuccaggugcgaaaggugcaaggcaccaacuugggcaaaauauaugccaugaaaguccuaaggaaggugagucacucguucagccaacgaauacuguguggcugccauucccaacaugcuguaccaggcuuugggaagacagcagggaacacaguggaggaggaucccugacuuuggcguuugcugguuuauugucuguugugauguguauugucuugcaguaauucucaaugggggcaauuuugacucccagcagacauuugacaacagugucuggacacuauuuuauuuuauuuuuuuuuaagacggagucuugcucugucacccaggcuggagugcagugacgcgauuuuggcucacugccaccucugucucccagguucaagcgauucucgugccuuagacuccggaguagcugggauuacaggcgcuugccaccacacccagcuaauuuuuguacuuuuuuguagaggugggguuucgccuggcuggucucuaacuccuaaucucaggugaucugcccgccuuggccuccaacgugcugggagcugggauuacaggcaugagccaccgucccuagcuuuuuuuuuuuuuuggauggagucuugcuuuguuccccagacuggagugcaguagugcacucucugcucacugcaaccucugccucccggguucagguaauucucuuaccucagccuccugaguaguugggacuacaggcuugugccaccacaccuggcuaaucuuuguauuucuauuuguuuaccuacuuauuuugagacggagucucacucugucacucaggcuggagugcaguggugcgaucucggcucacuggcaaccuccaccucccagggugaagugauucuccugccucagccuccugaguagcugggauuacaggcgugaaccaccacuccuggcuaauuuuuuuuuuuuguauuuuuaguagagauggguuuuugucauguuggucaggcuggucuugaacuccugaccucaggcuauccgcucaccuuggccucccaaagugcugggauuacagccaugaaccaccgugccuggccuaguuuuuguacuuuuuaguggaggcaggguuucaccauguuggucaggcuggucucgaacuccugaccucaggugauucgccugccucaaccucccaaagugcugggauuacaggugugauccacugcgccuggcauggacacauuuuugauugucaaggcaagaggggaguguuacuggcacccgguggguggagaccagggaugcugcugaacaucccacgaugcgcagggcagccucccacaacaaagaaugaccuggucccaggugucaguagugccgagguugagaaacccuguguuagaggauaaacccaucccugaaaaugaugguggcugacagcagcagaauuauggagaaauacaaugcagugacagaggaugcagcaguuaacaaacagauggauggucugaggagcucugguugcccccauuuuuuuuuuuuuuuuuuuuuugagauagugucucgcucugucacccaggcuggagugcaguggcgugaucucagcucacugcaaccucugccccuggguucaagcgauucuccugccucagccuccugagcugggauuacaggcguguaccaucauacccagcuaauuuuucuauuuuuaguagagaugggguuucaccauguuggccaggcuggucucaaauuccugaccucagguaauccgccugccuuggccuccuagagugcugggauuacaggugugagccacugugcccagccuggaugccucaguuucuaaccaauuccuguaucuccaggccaaaauugugcgcaaugccaaggacacagcacacacacgggcugagcggaacauucuagagucagugaagcaccccuuuauuguggaacuggccuaugccuuccagacugguggcaaacucuaccucauccuugagugccucagugguaugagugcgggcccaggcaggggugcugggggucgcgggggggcagcgagccagcaaaggaagcucuggggggaagcucuugagagaugagucuguggggguuggcuagggggcccccacucuguccuacccauccauccauccauccgugcauccgucccaucauucauucauucagcaaacgucuguccagcaccuacugugucccucacguguguuggggguggaugggcauggugcgaauuuggauagaaguccagaggaugguugagucucuuccuacuccccucccugucuuguucuucucucccgugugcccugcauccugucagguccccagcccaacugguucauucucuguaguguccuccuccauccguccacucucaggggccuggugggguggccagagcacuuuucuaacugggcugaggccucccgcucaccugcuuucuagugucuccucugccgacugcugaggucauagagccuggggcugcucccagcccuucuauucagaguccugcggcuggcugcccacaucaagccuugccccuaggccggcuguccccugcaggcugugagcagucuugaccugccuuucccucguuugggccagaugaacccugcgagcuucugccuccaugcucugcauucgcuccguccaucucagcauccccuuaaagucccagcaaaccgcgcuuucucuguucuguucuguugggauucacucugucuucccugucuucucugcgagaucuuuugggcuaagcucuuggagcuguggccugggccuggcguauuagagccguuguguacaugucugucuccccaguagacugagcguccugagggcaguggcugggucucuucauccuguccccagcuucacccagcacagggccaggcaccgaguaggcgucgguagauguuugcugaauugaauugaauccccacggcagcucugugaggcagguagggcgggaauuaugagccccucuuuccccaagaagaaauaaagacucagaaagcacaaaggggcuuggacccagcacguggcugcugacguguuuguguggcagguggcgagcucuucacgcaucuggagcgagagggcaucuuccuggaagauacggccugguggguguuaauccuccgcuuuccugaggcugccaggucccugcucuacucccgccuucacccugucuuguuucugcagcuucuaccuggcugagaucacgcuggcccugggccaucuccacucccagggcaucaucuaccgggaccucaagcccgagaacaucaugcucagcagccagggugcgcaugugugugcgggcagcugcaggcggggucugcaaucuguggggagggcugaggaccucugugggugggguggggcccuggucacgccucuccaacacccuuccucaggccacaucaaacugaccgacuuuggacucugcaaggagucuauccaugagggcgccgucacucacaccuucugcggcaccauugaguacauguaaguggcaccuggcuggcccaggggucgggaggacagcccgaaggggcacggccugacugacaguuccaccuggaccccagggccccugagauucuggugcgcaguggccacaaccgggcuguggacugguggagccugggggcccugauguacgacaugcucacuggaucggcaaguccagcccccggggaggaggaggggcaggggcagaggugggaguagccccccuccuggggcaagggcagggccuggugggaggcccacaaggcuccucucaccuuccuccuccuccagccgcccuucaccgcagagaaccggaagaaaaccauggauaagaucaucaggggcaagcuggcacugccccccuaccucaccccagaugcccgggaccuugucaaaaaggugcagcucccuucucucuucuccggggcccugccagccauucugcacguguuccugagucucucugggcuguggggaagccagggccaccccggccugugcaguuugccucugggaaugaaaggagccccucccuugaagucagggauugagcccaggucucagcccugucacagaccagcugcugcccuggcccaguccuuaggcugaguccuaaccagugacacgcuugugaugagcuggccacacuuccgucaaaggcgagcaucggagguguuagggggaggccggacagccacauggggaguuggcgccucaccaacgcgcccuggggcaaugccagggcccaggagccucugcaaagccuuuguggagaagguggcuccauugaccaaaccuugaaagcccugaggguauccauaggugggagccacacccaaaagcauucucucccaugucaccugaccccuacuccagcuagcccugggacccggggacacaugagcaguacuugcccaggcccucacccucucuccuggucccgcaguuucugaaacggaaucccagccagcggauuggggguggcccaggggaugcugcugaugugcagguggguuugggaccaccaccagggguagggcugagucuccaagggugccgggaaugggggcagggccccagggcagagggagugaccggggggcaagcagggugagcuguuaguggguuuggugcauucucuaccuacagagacaucccuuuuuccggcacaugaauugggacgaccuucuggccuggcguguggaccccccuuucaggcccugucuggugagcagcagggcugguggccaguggccgguggcggguggcaaguggagaaccugcaucuuggugcccucugaccccuccccacucuggucggcccacagcagucagaggaggacgugagccaguuugauacccgcuucacacggcagacgccgguggacaguccugaugacacagcccucagcgagagugccaaccaggccuuccuggugagugcgggggccugaggccugugggaccagggcacggaucgugacuaaggauggcaggcacugagugucgcauggcccugccuccgccccccagggcuucacauacguggcgccgucuguccuggacagcaucaaggagggcuucuccuuccagcccaagcugcgcucacccaggcgccucaacaguagcccccgggcccccgucagguacugagggacguggggguguguggcuggguuagggacgcuggcaggcaggaugccagcuccagccuugggugccuuggccacgucugucggccaguguuggcuucgguugcugugucuaucauggggaccucaguuccuacaccccuuguggccaggcugccuggaugggaguuuguggagcccgcggccugugugccugggcaggugggaaaggcugccuucccugacugagugcugggagccucuggcagggccuaggaggcucuuauucugccuugguuuccccugcagcccccucaaguucuccccuuuugagggguuucggcccagccccagccugccggagcccacggagcuaccucuaccuccacuccugccaccgccgccgcccucgaccaccgccccucuccccauccguccccccucagggaccaagaaguccaagaggggccgugggcguccagggcgcuaggaagccgggugggggugaggguagcccuugagcccugucccugcggcugugagagcagcaggacccugggccaguuccagagaccugggggugugucuggggguggggugugagugcguaugaaagugugugucugcuggggcagcugugccccugaaucaugggcacggagggccgcccgccacgccccgcgcucaacugcucccguggaagauuaaagggcugaaucauggugcugaccuggcucuuugugcugcaugccuaggggcaggguuggguuggauugugccaggaggagccccugguccaggagggaggggucucuguaggaccacagggccacaggcugaaggaguuuuauuucaaaugguugccugaugccugugguuggggggggccguucccguggugagcgggguacacauggacuugggaacugguagggggugacagucugaggcauggucaugugggcuggggguccaguccagccauggcaucuugggaagcagaggcacggggagugagcggcugugacagggaugggacaccaagaccggccucuacagugcggugacauggaggcccuggcccccagcugcccuggcgcugucaucccaggcugcgcugccagcaaaggcgugcaggucacucagcagggccucagcacugcccccugcgcucgcugguccuggggagccgaggaccaggucgcccuccgugucacugucucuggcuuccucagcccgcacggggaccugcucugggcuggacgccucuccacauugcugcucgccuuccccagggucagccugcaggccaccauccgcgacguggucauagucuguguccugcucauccuccugucgcucaaggucauugucuguggaccccagcucagcucgggccugcagccagcgaccuggggggcuggcccagagcaggcgccgcgugcggccccacagcgcggcaccuaggcgggccgggugguaguagcccccugagucacggcugaggcggcgccaggccagugcuaggccaguggccagcaguaggagcagcagcagcagcaggacaacggugacagagcuggagcccacgcuguccuccgcgcugccacccgagcccaaggccccuggcagggccagcagcaucccgagcccuaaggugcagggcagagccugugggagacaggcaggggcucagagggcucagcaccugggguggggccugguguggggcaggcugggugaccaagaccacuuucguuuuuuucucuuugggauccucuugggacagccaagcagaaaaggccaaggccuuauuuggucaaccaggcucuggcccugugagaucagcccccaucccuccagccuccucccuaccacucaccucccccaacagcugcauuaagccaccugccuggggccuucgcacuggcuguucccucugcccggaaagcuccaccuccucccauccuccccucccccgggcugcauggccugcucaccgugcucaaacuucaccccagugaggcugaaccugaccuuaaccucuacccugaugucuaucacugcagcccaccccagcaccccccagcacucagugccuuuuuccuuccaugucaccuaacgcaggagauaacuguacucauuuuuuaugucuauugucuuaucuaccccccacaauaagcugcuaggaaacgggggcuuuuugggucaagcauguuaguaggugcucaauaaguauggauuaaaugugucuaggcugccugggugggugggagaggagaugggagggagggaaggagguugcuagcuggugucagggcuggcucucccugaggccugggaugggggauggaggggccuggaugcacccagaggcaacugcucaucuucugcuuggccagguccccaaacggggguccgugaggccccucuuccucccuccccaccacggggcugccccagcggcaggguuuccguuccacucccagucccugagggccacaggcgugcagggccgggggcuggggggggcugggggaggcgggcgcagcugccagaggaagucugcggucggaacaggcuagguggggggugucgggggaggggugcugaggugcagccagccucccccaccaccccaggcuguccgcccaggcuccaggaaugcaaguucccgcucacaggaagaccagguaagggccuucccagggcuccugacaggggccugguccgguauggggugcugggggccaggccuggagucccagggagcccagcucaggugagagaaagguucagccucugccauacuccucuuaggucucaccucuucccuggggccaauguggggcccuccuuagcuccacaggcccagacauucuagccccgaccgccuguggcccccaucccaagaacccggggggcuccgaggcuuaccauugguccgcaggccccuccgugccgggcacccaccuccagcucuggcugugucgagcgagaagugagcucagugcucgucugcagugaaggguggcccaggcuuccgcuuccugcccacauaccccaccugccccucccugcugcaggaccccugguccacaccagacccuccccagucucucuggaggaggcugggcugccgggccuguccuccaaggaagaagcagcaccaacuugaagcuggaugcagccuugcauguguucucaggucuucugccucaguuucccugccugacaauccaggggagcaaugccuguggggcugcucacugcccccagaccuucugcacaugugugacuccugugacauccucugucuccagguuuccagacuucucagccccacccuugcagcagcaggucagccuggcuuuuagaaagagaauuuuauuuggaaugaaaauauagagcccacccucccgccuccucuggggagggagcagagggcugggcaguggucggggagauggucccucagaggucgaggagcucgccugggcguagacauccuccacaggaacagugaggaaagcugggcgcuggcuucggccugggccugggacgggugggggugggaacugaccccugcgcugccucagaggcucugggcagccagcuagcccggugcgacccgcuggcagaagcugagugggaagggggcggcggaggagaugaagguggcguguggcuguggcccuacgcauccccguucuccaugcggcccagcugcuccuccaggcggcagaugcggucgcccugcuccuugaccagcgcccucagggcccgcagcuccugcaucaccuccuccagcuucccagccuccuguggggacaugaagcagggguagggggcgguggucaggggcugcuaagccauagcccucccaaacccaccacuaccccagagagggacagcgaauggcugaagcccacacagcaggccagggccacaccuggggcucccagcaccaccccugccugcgcgugcauaccccggcucuggccaggcugccgcuggggguggcaucagcagcaguggugguggaggcgggggccccuaggugggaggagcccggggccauggcgggccggcugucagacaacacguugcgccggcugaucuucaggucccgcugcuugcugggcacguaggccucccgcagugagaugaggaucgggucggcaucccgcccgcucacccacuccucagccuccagggcugccucgggcccggcugugucgggguacagaucauccuggaagagguccgacugggcagggggccggggaggucaggaucaguuaggaggccccaucaggguccccucaucccuccccuggccuccaggcuugcacucuguuaacccauucucccacggccuggaaagcucaaaucuggccuuuaacuuccuuucuggacaccaucaacagcucccucggaagcuuucccacccuucugagcaaggccccugucaucaccuuccccugcaaggcacaggggccacuauguggcuuuaugggauucuggggcccauggacugugagcuccuggagcaggcccuaucagcucagcuccacuccccaaaaugugccuggcauguugaaagagcagucggcaaaugcuggccagagaaucauggaagcguguccgaggcucuuggcaucugaggccaagccacauguggcccgguccccucuucaugggauuccccacugcagccagacuccuuguu

SEQ ID NO: 18645 - RNA, 731 nt, Homo sapiens
cgggggcggacuggggcgggcggaaggagagccaggccggaaggaggcugccggagggcgggaggcaggagcgggccaggagcugcugggcuggagcggcggcgccgccauguccgacagcgagaagcucaaccuggacucgaucaucgggcgccugcuggaagguuggucggggcgggggaggcccgcguccgccgcgcccuggcccccugcccggcccggaaguggcgcgcgggcgggcccccggggccagcuuagacugggcggggacgggcagcgagguuccguggccgcagcugcccccccgcggacgcgccugagagguccggggccagcuccgacgcgcggagcagcucccccccucucccgggcugggggcgcacggguugccugggcucuuggggcgagggagaaacccgggaagcccgguccaggaagggguccugcgcugugagguuuuugguggcagcccccugcgcacgacagucgccucccgaggcgcugaggguagcugggggcuuccccugggaggcuugaggccgcggucccgggaggcucagcagcaacagcugccugugggcaaggaggggccgaggaggccuaggcgcccccggagguauccauggggccacccgugucgcccacccuccuccugucaggguccaggguccugacaccccauugcgccccagugcagggcucgcggccuggcaagaauguacagcugacag

SEQ ID NO: 18646 - RNA, 6771 nt, Homo sapiens
aagaaaggagccgcuaggcccuguggcucagccccaugagccugaccaacacugucucuuuuagauccucaagcccgccgacaagaacaaggggaaguacgggcaguucaguggccugaacccuggaggccgacccaucaccccaccccgcaauuccgccaaagccaagaaauagcccccgcacaccacccugugccccagaugauggauugauuguacagaaaucaugcugccaugcugggggggggucaccccgaccccucaggcccaccugucacggggaacauggagccuugguguauuuuucuuuucuuuuuuuaaugaaucaauagcagcguccagucccccagggcugcuuccugccugcaccugcggugacugugagcaggauccuggggccgaggcugcagcucagggcaacggcaggccaggucgugggucuccagccgugcuuggccucagggcuggcagccggauccuggggcaacccaucuggucucuugaauaaaggucaaagcuggauucucgccauggccuccgucucacaucuaagacacugccuggcagcucuucugcacagagccgcuugggagucucggcaccgggccccagccagggcaacccuagccacacacucggguccaaggcucuuagaauuccaagucagcgccaaagaguaucaggaaagcaaggaaaacuugucagcuccacgggggucccagaugcaugcccaggacuucaggaaggaacaggucaugauuggcagagaagcuggaucaccaggggccagcagcaccuacuaugacauuuuccuuaggaaggugagccugagggagacagguuuccagccuuggccagcuggaguauagccugaggcucaaugagaaauaagagguaggaacgucaguaguucagggccaagucuggaaaguccugauuggcuggggguuguggggagauaacggcccaggcccgaccgcugugggacagcuuuacagugacagccagcuggggccugcgagaggcagugaaacagcucagcuccagcaagcccaccuuucugauccccagggcugagagacccaguucugccacuggcuggggcuucgucuaguccaaggccucuggguacaggcuucagguucuugguucagccuucacccucacugucuuccgccagcacagggcuggggcccuggggggagcguacaggggccaggauggagccgaagaacagugagcggaacuggaaagagaacaagugaguucuggaggcugcucccuucccuaccucccaccccugccuccaccuccagucccuaccuucuugggugggggagucccaggcacuguacugggcucagccucaucuuccuccucggaguggggaccggggcucuuggggggcugggggccaggugaaagggaaauggagggcagcacccgcgagcccucauugccuauagugguuuccauggcgaucauguaagagucaaugucgucauuggcaaagucguccggguggggugugcuguaggcagaaucggaguaucagggaggggacugggggagcagaggcagggccccaccuuggagggcucgaagggagcucuggggcccccgaccacuggagaucucuugguuuuaugacuuccugauuuggcuggagaggagaggaugcagggguuaaguggugacuuccuggagggggugggccaggaaucucuuugaucagaauucagguaggggccugagggaggcaucccgggggcuaccuuagcucagcuaggagggaggagcagcaagucuuaugaacugggccacauggagcccaagcccccaccuucccaggggacaggagcuggaaagcacaggagcccagggacaggcugggcugggggccagccccaacuuccugugcugaaagugcacugggccauccuccccagcccaccugcccuuccagccaccugcuucccccagcccaggcagcuccugccucccagcagcccuuucccuccuuggccugggaggaggcucagaggggcggccucagccagagaaggaagcuggcagggccuuggggaugcuucccugggugggaggggucucugaguacagcuaaccgagaaggcugagucugcagggcuggcagcugugagcacuauaggguuaggggcuggggccugauagaaagagaaggggcgggagagaacacauugcggggaggugcagaagcuaggaguugcagucucaggcuggagugcacagacauggagagaggaggaguuggggggaggugcccucaccugugagccuggagcugaggcacuggcuggugacgcucuggggagcccagguccugggagugcgagucggugucugagaguguggccaagacaaaguggccguccagcaaagaguccuugauggugaagauggcgggccugggcaggggagggggcccaagcuaggucaucccauucagcuccugccaucccagagcccuucccugucccaaggcugggaacuaccugccuggagcaucaaaaugaaugcuaagauucaaguuugcugacucugcaaagcucaggagccccugggaggaaagagguagcaggugaggccccgggcugggcugagcugggcagggaggacaggacggcgagcgccugggaggaaccucacccggaauuccuugaggcagaaagugauggccaccccuuccugggccugcagcugcuggaaauccuccucuccaaggcacaucucagucaccauggcuuuggcagugcugucuguuggggaagaacaggaguaaccugggccccgccccucucccaccugccacucugcugucccaggccacguccagcccccucaccugccuccuccucgugguagcugcgcaggaugacccugcggccacggccaaugcccagcgucacuucagccagugcaggagagaagggcagaacagccucccccagaacccugugaacaggguggagcauuacccgaaaugccuggcccugcccagggcuuugcucucggaggaccugaggugggggugacacaugcacacgcacggaugugcgcaggccuagcgcaccguggaugaggcccagagaagguggcagggaggggacugguugcagugguugcucaaaccuggcaggcggcaccugaccaugcagaccagggagagggcccagaggcaggacguggcacucaggccacccuacaaacccggccuucagaaagagcccugaaauccuuauccucuaaggauacccauugacauacagaugaaaucacaucuggaaauuguuucaagucaaguggggacgggagcugcgucugcuuuuacauauauuugaaauuauucaugagacagagugcuugcuucggcagcacauacacuaaaacugaagcaugcaaaagaugagcaaggccccugcgcaaggauuuaaaaaaaaacaguggcucaugccuguaaucccagcacuuugggaggccgaagcaguggaucacuugaguucaggaguucgagaccagcuuggccaacauggugaaaccucgucucuacuaaacauauauaaauuagccgggcgugguggugcaugccuguaaucccagcuacucgggaggcugaggcaggagaaucgcuugaacccgggaggcagagauugcagugagccaagauugcaccacugcacuccagccugggugacagagcgagacucuaucucaaaacaaaacgagagaaacaauugcucauuuuuaaaaaaagagacugagugugguggcugacgccuguaaucccaguacuuugggaggcugagacgggcagaucaccugaggucgggaguucaagaccagccugaccaacauggagaaacccugucucuacuaaaaauacaaaaaauuagccgggcaugguggcgcaugccuguaaucccagcuacucgggaggcugaggcaggagaaucacuuuuaucgggaggcggagguuguggugagccgagaucgugccauugccugggcaacaagagcgaaacucugucucaaaaaaaaaaaaaaaagacaccacccuaaaugcagaccaaggaauuggcccccgucucucacuacccaaaagagcucugagcagugcuggcucaaaagaaccuggggaaacagaugucaggacccaaagggaucuucagucacccugagaaaugagcaggaccuugggccacuugaaugcaagcagugaccagcauggagcagggggagagcccacuccucucugagcugguccucgccagggacguuugcuucaacuggaguccccauuucccuggccccagacagcccccagugcucggacugcccagaacagcuccaccccauagcugauuauucagccucccuccagccuccugcccuggccuuggggacuccucgauccugggcagucaggaaaagaggcugccguugaauggggaacaccucuggaaggaugcccaggccggagaaggggucugagccucugagccacagguuaugggcagaccuucaagguuacucaagccagacaagagauuugguggcaggccagaaaugugcucccuagaggaggaguuggaauggguuugagcagccagaaagucaagucagaccuuugggauggagaaugcaggcuccuaacaguaaggagaauggagcaaggaggcgccugccccuccuccaugccaccgucugccuuuaaagagccagguaaggaccugagcacauagcgggccaugggaugucuuugagguucacagaaacucuguagggaaaaugaaagagguaccuucuaaaaucaaccccuuggggccccaaagaaggaagagagagacccggggcugagcugagggcaggggugugcucaccgugcuggggcgcggagcaugugggggcacgaggcugggucgaagacggccugcagggacucacaguccuggaaggacagguugugagucuuccgcaccccuggaugggcgauagggucucagugggccucgccgaccucccugcugaggcaccccuuggcuggccggcugcccacucaccgaacuugcaaugcagcuggaccaccaggcggcugcuccggccauucagggagaugcagcauuuuuccaccgucuucuccagcaucgccagugagcggaagacagacaggaaagacugcaugggauaagacaccucagccuagcaucacaucucugcaacaagcucuccugucccaugcaggcccacacccaucaugggcccagcauguaacucugggaaaagggcucccacgucaccucgggcacuggcauccuucuaggccucauucaugcucuuccuuaugcuuggaaugccuugaaagaccugcuuaccuuuuuuuuuuuuuuuuuugagauggagucucgcucugucacccaggcuggagugcaguggugcgaucucagcucacugcaaccuccaccucccggauucaagcaauucuccugccucagccucccgaguagcugggauuacaggcgcgugccaccacgcccagcuaauuuuuguauuuuuaguagagacgggguuucgccauguuggccaggcuggucucgaacuccugaccucgugauccgccugccucggccucccaaagugcugggauuacaggcgugagccaccgcgcccggccaaaagacgugcuuaccuuucuugacgaacuugagcgucaccacccucucagguccccgcugugaugcuuuuaccauggcccucccuguguuuugcauggauugggcuugcacgugucucucuccccacuuagcaucuacugaguaccccagggcagaggcacagcugguggagauuccugggguggaguagugccacugcugagggaagggccucaccuucaucaggaucuuacagcgcagcagguccugaccagggguggcugccugguauugcuggaagaagagcggggcaaagagaaagcaggcauaggcagagcgggaggaguucaccguccggagggagagcugggccacgaagagcagggagagggacguggucagggggcagccacagacccagcccucuggcugcuucugcucacacacuugcccuaucguccucccgcuccgccaccaccugcugaaaaacccuccuuuccccauggaagccuucagagucggccccggcgcugcugccgcagaggaggggucgcacacccaggccuuccccgaguuucucuaagugcacgucacccccugggagcucgcaggacagcuuuccucaauucacacaccggccugggaagaugacagccgccagacuaagaaacugaaacuuugccgacaaaucugccagcggucaucccgccuagugggggcgagacucuaguccggguuacccgcucccggcuggagucccacccgccccccacacccuagccccucaccccguccuccaaggguuccagguagagcucguccccgaugcgggacagggaguggacggccuugccgagcacugcggggagaagagcggaaggggguuaggcuggcggcuccgcggcugcugcaccgccgcugccaggccgaccugcacucacccuucacguugccgcccgugaccaggcacuucaugcugccccagcgcuccgccagcggccaacacugcccagcucuccgcgaccuccggguccggggucccuucccgcgcaccgccccugccggccccgcccccgccucc

SEQ ID NO: 18647 - RNA, 3371 nt, Homo sapiens
ugcuccuggcucccccggcacgccucggccuuccgugccccuggagaucggggcguuccgcgggccgcgcaccggauugcgaaggucagagaggacgcagcuguggggcgcgaggucccugugcaguggaccgagugcuggacucggagucggagugugggggcgagcucucuggggucacccacuuaguagaguucccgggcgucugccgggggauacagggugcaagcaagaccaucgcacccacucugggccugagacucggacuccagcagcaauccccaacucuagaaagaagucaaagcagcuugcuugcagcagccgggagugggagguggcugcuccuuccggcuucgaggauccuuuaaggaaaaacggcaguuucuccaggcagaaagggguagaacggugccccuggcagagggaagaacaagaguaaaugcucagcggugugggcuccgcccccuggagaggggaguaggucugugagucucagagaggcguaggggccgccagaugaugaggggcaccgcugggacgcucuggaaacguuuuacgaggguagaucgugguuaugugccuuuuuuuguuuguuuguuuuuugagacauauucuugcucugucacccaggcuggagugcaguggcgcgaacacggcucacugccgccuggaacuccugggcucaagggauccucccaucucagucuccugaguaucugggaccacaggcacacccaccacgcccggcccuuuuuuuuuuuuuuuuuuuuuggguagagacggagucuugccauguugcccaggccggucucaacugugggguucaagcugucuuuccgccuuggccucucaaaguggagugagcuacugcaccggccuguuuuuuguuuuuugugugugugugugggguuuuuuuguuuguuuguuuugagauagagccucgcucugucgcccaggcuggaguacaguggcacgaucacgccucccagguucaagcgauucuccugcuucagccucccaaguagcugggauuacaggcgccugccacaacgccuggcuaauuuuuguacuuuuaguagagacggguuucaccauguuggccaggcuggucucgaacuccugaccucaagugauccgcccgccucggucucccaaagugcugggauuacaggcaugggccaccgcgcccagccccgggucuguauuuuuaaaagaccccagacuggccggguacgguggcuuacgccuguaauccuaccacuuugggaggccgaggcgggcggaucacgaggucaagagauccagaccauucuggccaacauggugaaaccccgucucuacuaaaaguacaaaaaguagccgggcauguugucacgcgccuguagucccagcuacucuggaggcugaggcaggagaauugcuugaacccggaggcggagguugcagugagccgagaucgcgccacugcacucuagccuggcaacagagugagacuccaucucaaaaaaaaaaaccagacugugugccagguggggaugcaucagcuggaagguauuccccuuccccugggcuuccggguccacguguguaaaauguaagggaguccuggagaaacucacugaccccuacucuccccacaguaccaaggcucugguaguucuuggaagggcccagggcaucccuguauuccugcagggccugcccgugccuugccccucagguccugugguagugcagaagauauauuuaucucugccacccuugcucuccagacccacuuucaaaugaguugaauugauacauaauaauuguacacauuuggauacaugcauacacuuuguuucucccucuccuucccuucugcuccccucgucaccagcccuugccccuuccguggagccuugggggaggagguuacucuucccuuccccuucccgggggauccauggaaauagugccccugucccugggcauccggcucaguaugcuggagucauccuugaccucaugcucgcccucaccccuacacagucuuucaguuaaguccugaccacucugcuucccaaacagguggcaacuuaacagguggcaacuuugcccuccucuuccaucuccaaggccuaggccaccauccucucaccuggaugacuguaacagcucucaguggucuccugccuccacccugcccccuccaggccacucuccauacagcagcaaagugacccuccuaaaauguccauugugucaugccucucccguguuugcacacuccagugguugccauaaaauccaaacucugcccugaaccugcaggagccgccgccacccauuucuccaccuguggccuccccuugaucaccugcacagccaugccaacccugugggcucccugaacccuccacuuccuuuuccaccuggggauuuuagcacauccuuagcuguccccaccacuuggcaucgucuuaccccuucuaacguggcggugcuucucuuccuccaggcucagugccgucuuuucugcccccaccagcaucccauuacacucuagcuagacccuguuuuagccacagcacuuaucacguuauuucaugcguguguuugccuguuuaacaucugucuuccucacuagugugucugccucacaagggcaggaaccaugucugguuuuugguuuuuuguuuuuucugaagacagagucuugcucugucgcccaggcuggagggcaguggcgcgaucucggcucacuguaaccuccgccucugggguucaagcaauucuugugccucagccucccaaguaccugggaauacaggugugugccaccacgcccggcuaauucuuguauuuuuauuagagaugggguuuugccauguuggccaggcuggucucaaacuccugaccucaacugaucugcccgucucagccuuccaaagugcugggauuacaggcgugagccacugcacccggccuuggcuuuguuuuguuuguucuguuuuguuuuguuuguuaagauggguucuugcuuugucacccaggcuggaguguaguggcacgaucauagaucacugcagccucaacuucccaggcucaagcgauccuuccaccucaaccucccgaguaacuagggcuacuggcgcaugccacuacagccagcuaauuuuuuaaauguuuguuagagacaaggucuccuucuguugcccaggcuggaguugaacuccugggcucaggcgauccuccugccuuagccucccaaagugcuaggauuacaggcgugagccaccacacccagcauccaugucuguuuuguuuguugcuguauguaccucacacagggucuggcacucaguaaauaaugaauaaauagguguuac

SEQ ID NO: 18648 - RNA, 9145 nt, Homo sapiens
cuucaucgucacauugaaaauaaccaaauaugaaaauguguuuuauuucucaguacaaagccagauacuguaaggcuaugaaaaacugacuagccagaggccagaaaggacaaaaagaagacuaucucuggccuggugcccugugaucuggcguggugucacaggaggucuggggacagcagcaaagaccuggaccgguggagguggaugagggaagcgaucugccagcccuuccagccucccgcggcuggggccugaggauccugccugccuuugggggccacugguugccuggccuggcugguuccaggaaugaacugggagaggacaggaggugcagggagggggcgggggugggaggcgugacccuuuuugcacgggaagcucuguuuucauuccgugccacaggugagugugcagggcuagaguugagaaugaaacuagggugcuguugcccccaaagguaccuucagucccucuaccacaucccaguuagaaagucuugagcccuuggacaggcagacaugggccugggacuuaaggcuguaggaggugaggcuguagugacaggggugggaggugaggccguagugacaggggugggaggugaggcuguagugacggguauggggcggagcugagaggaaugugugcggcaacagacgugaggguguuucuccaaggaguuguggauccucuucagugucaggggagcgugggcaugugugagggcucaggccucgcccuccucuccacugucaugcacgcuggccugucucaccaccuuccggaaccugggcguagaggaaaugcagggcucucccugccccugccccugccccugcuccugcuccuggaaggccuggguccgguuggccaccacggcacugcccuggaggguaaccacugacuggcgggacuucagggcaggcugaggcccccuguccaccugcuggccucccuugguccuugcaagcugugggaagggcugcagaggcucuucaugugaagacucgugggaagagaagaccuggacaggugugaggauacggaagccaugggaggccuuucuggggcaggggugcccaagcacagagccgggaagaucuggggcaggggugccaagcacagagccaggaggaggcgagggccggaauguuuguggcacgcacgccaaaagccaagcuguccacagccacgcuuccucgggagggaggacaacaccccagcccugcugccccgcuccuugaacccuaccugcuuguagcuuccuucuggcccccagaagcccuccucagcucccuggagacccaggccucccugcccuccuccccuccuaugcuuucucugccuuugcguaggcagccggcaggugaaacccgugccggcaccagccccugagcugggcuggguggaugcgugcguccggugcugggugaggaccucuugccuuuagcaacgcccacacccgcccaucaacccaccacgccucccuauccuuccccacccacaccuccuccaggaagccucucccaaauguuccugcccucaguggaugcuccuuccuccaagucagccauuuggccuugagucccagacagggccuggcucccaggcuuaggcuugugcccgcagcacugagcaucaagggugcugacuuaggcaggacuugggcggcgugagugcgcagacuccuccccaccccauccuuugaggugcugcuccucagaccagggaggggcuucagagauuaauuuagccuccccaccaugggguuagagaucgcccccagggccugcaggggccuguggagcucauggccuggggaggcagcccugccccugagacagcuaguccuguggucaggcuggaaccugcccgcgaucgaggcuggggcuggcucacccaggagccuuggaaacaggcacugcuuccugcccugcccccgugaccccucuccagccugugccuacagugccuccgccugcccucacuggaucucagcugcucucaggggcccaggacguggcugguccccaucuucagggguauucaugggacaggcuggagacgccgggugcuaagagauacugggcugacugugaaggaggcugggaccaggcccccuggguccucccaggacacccugcaugggcgggccagacuuagcccggguacgcccugcucaggucuacagucaaacgcccauccuggucuuuccccaucucccuccuuauggcccccaccccugcaagcugagcucccccagccccagccucaccucuggcaugucacuggucucugaggugcucuccagcuccaaggagggcuccagaagacugauggaccucaugaccccucggagguuuauacguggccguggcccaggcucuucuuucggggcugccuggcucucuuccaugccuacaaccuucuccuccccaccacccucagguucuggcggaagaggugggaaugguguagagacuucaggggcugggugcuccucuggggagaccccacccacuuucugcucccagacauggcucuggcggcugugaggagguggcccugagucagcucugagugacccagcagccacccccagcaaacccaccuacucacccccugccacucgcucccaucccauaccuggccgucaggaugcccugguagaucugcagcuggcgcaggaagccaggguuggggcgggcgaugggccggagcuccugcacguggcgcagggccugcuccaggcugcauucguacugcuucauggcauaggccagcacuguggccgcugagcggcugacgcccaucuugcaguggaccagcacgugggugcccugugcucuguggaagcaggccagguucagcacccuccccucaccaugaaggaucccgccuccugcaggggagggcaggugaagggcucacaaccaacugagaguagagaaggagggaaggacacugagggcuggaaggaauggcacagcugauggcagagugggcaggaggagggcaccggaggccgcuugaagccacaguggggcaggcagcaaagccaggagaccgaccuugcagccucaaugaagcggugcgucuccuuccagugcggcagcagcugggccgacuccucaucccagaggcgcacauugugguaggugaagcgcucaggguagaaguugucaaucucccgggccauguucaagaugugggugacccugucccagagggcccaaggccaggcugaugugggcagagguaccaggcccacuggcaaucggaccuggcagccccugggccucgcuuuagcucugaguuucaagucagauggaggcagcagugacagugggaggagaagugacccagcugucaccuggcugcgaccuuagaccaaucaucuugcccugcugggcuuguuuccccaucugguccagacagcugggccaacugcaacuccagcccuucaguuauucucagaaaugaguuagagaacagcuuuugagcuaagcugagagugggugggucugcagcaguggguggcaggggcuacagcaggucccagaagcccauggugggcagaugacagguaccugucagagcaggcagccagguccccacggggagaagggcaguuccuucuucccugagacagggcaagguggagaaaaggcuuuuucucucuuucuuuuuucuuauuuuuuagagacagggucucucucuguugcccaggcuggagugcaguggcgugaucacggcucacugcggccucaaucuccagggcucaagcgauccuccugccucagccucccaaguagcugggcccacaggcgcauucaagaggagccuuuuucugcuuguccaaggcaguuacagcaguaugcgcugcugcuucucgucuuggcguggcugaggcccuuuguuucuguccuuguuucacaguguggaugggggaggagagugggcgggggcuggccagcaggucuccuguccccaccugggagcccacaccagggcaacagccccaggacagaguuagaagcagagcuagcagcugcugagggugguccagggguuuuugaagcuggcuaccacccaaugcggggaggccaggagaagggaagaugggguggguggcccgaggggcucauagcccuaccuguuccucugcagcuccuccagguuugcugcguuccacucugagcccugggagagagggaacagcacauuucuccucuccuccagccucugcuccuggccugccgcccucacagcugccagcgguccccauggcccaggccuggcugaagcucaccagguagaggugggggaagaugcgggaggcucggucccgcugugccaccagcagcagcaucugguugucgaugaagucacgguacugcuggagggggagccccaggcgcagcuccagagccuggcggaucugcaggcagagcccagggcaagagaggcuggggcucuccuagugcccaaccugccaccuucccucugggaccucugaggacagcacccuaucccaucuagauggauuagggccaaggccaaggcauccaggaauggcucaggacuggagacaggcaagguggggagggcucccaggaaaggcaagcuugcagccccugcuagaggggacucaguccccgggcccccugcccaccucuuuggaagugacacucuccaggucacugacauccaacacuuuccacagcucagcacggaucgccugcuccaucugcuccuguucugaggaccugggagcagagccccucagucaaggggcccuuuccccucuccaccaugccccccacugcauuauccugccuuccccuccacccagucccuccccuccacacacugacccgccaggcucggcgcugggaggccgcagagacuccaggucggccauagccguccacucauugaggcagcucuguucggaguucagucucuccugguaguggcuggcccaggugagggcacugccacccgguacaaggccgcugccuagagcugccucacaugcuuggugcaauaccuggaguguggcccugagacaggaggagaggcugggucacacuguucccuugcugcccuuccccaggcccugcagccuccuucgaaggagaggcuggccugaguccaggcagucucuguccuuaccacauggucuggauggagaugggcuugaagauccggcuuugcccaccagacgucacgcugaagccccugcaggagaccaggcacaggugaggccagacuccaggcucugcgacagagaacccauccuuuugcuggauacgggaagccgagacccaggagucaggugccuugcucaggaucacggugaaucugacguggagcugggagcaggccccagagucccagccuaaaguucuacuguacccuggugcccaggccccgucacauccgucacacucaguuauuccacccuccagcccccaccuccaguugccauugcuuacccgucuccaucuaaguacaccugggugucacuccagaggggcaagaccaggcccagggugcagcugggggagcuggcaggggacagagggaaagccauuguccccccugucccucaccucuuugccccuccuuuccucucccugcucgaaccugcugucagggaaauccacgcccaggaggaccgucucauccuggcucagaccuucuccuucucguguagaaacuaccagcagguagcggagccggggaggccggggugccuccagcugggcugccuggggggagaugaggaacccagggucacaguggccccaaggacccugcuccccaccuagacaccccaggcccagaacagugcugacccugcuccuuccucucccauccccccucuucccagauguaaaaucaguggguaaagagggacuguguggaaaaaagcggggaaugggacugacauagguugcacauuuuuuguuucugcugaggaaggagguuguuuuuguuuuuguuuugagauagggucucacucugucgcccaggcuggaguacaguggcaccaucacagcucacuguagccccgaacuccgaggcucacaugauccucccaccuuagccucccaaguugcugggacaucaggcccaugccaccaugcccagauaauuuuuaaguuuuuuguugagaugagaucuucccuauguuucuugggcuggucuugaacuccuggacucaggcaauccucccuucucagccucccaaagugcugggauuacaggcgugagccacugugcccagcaagaaggagguuuuuucuuuuuuuuuuuuugcaauggagucuugcucugucacccaggcuggagugcaguggcgcaaucucagcucacuacaaacuccaucucccggguucacgccauucuccugccucagccucccgaguagcugggacuacaggcacccgccaccacgccuggcuaauuuuuuguguuuuuaguagacacgggguuucaccguguuagccaggauggucucgaucuccugaccucgugaucugcccgccucggccucccaaagugcugggauuacaggcaugagccaccgcgcccggccaguuuuuuuuuguuguuuuuuuuuuacccugucacuugcaaaugcuaucauuucauuugagaaauguuuaucaccaaagaaauauuaaggacaaaaucucacgauaggggaugauacuucuguuguaaauucaguuuuaccaaagauucacugcaucuuguuugccacgucuugcugaggacggcgagcugucuccacaaguauuugagcaugagcgcuccagcuccaccuggacucccuuccuccguggggcuggaguccuccuccccucugccugggucccucuagcacacccucccccaguguguguccagcaagccugccuugugcacugguccauuuagggacagcucacaucaucaggaaagucuucuacugguugaggagaaacaugccucuggaauucccaccccuuggaccuaauuuggcccuauuggcucacacaggacaaaccuccccuguucuuucccuuccagagaccugcagccaugaccucgcccugucaaaauaucucugcccaggccgggcgcgguggcucacgccuguaaucccagcacuuagggaggccgaggcaggcggaucacgaggucaggagauugagaccacccuggcuaacacggugaaaccgcaucucuacuaaaaauacaaaaaaaauuagccaggcauaguggcgggugccuguagucccagcuccucgggaggcugaggcaggagaauggugugaacccgggagguggaacuugcagugagccgagaucacgccacugcacuccagccugggcaacagagcgagacuccaucucaaaaaaaaaacaaacaaaaaacaaaacaucucugccugaaacagcagggucacugggauauggguaaccccaacacuccccaggcugcccccugcccucacaccauugcuccccaagcagacacauacacagggcuccauucugcccucaggcgugucucuuccccccaccccccggagcuccacaugggcccucaccaggcggaugucauccugcggccucagcagcuguaccaugaggugcaggugcugccucugcuccuccugcuucuggggacucugggauccuugcccgaagucugucugguccccguggagcuccuccucacucggggccuucucuguuggcucagaacuggccucugcugcaucaucauuguccccuccauccugcagucccaggacagccccacggagcaccgcaaagcucugccuggcagggcagugggcaacugucauggcuccucauuccccuuaggguaggggcucucaaagucuagcaugcaucacauucaccugcagcccuugucuacacggauucaugggcccccacgcggucgauaggucuagaguggaggccugagcaucugcauuucuaaccccucggccccuuggcaauauugcugagaaccagucuugggggcuuccaagcucucagccccucuacucuagcucaucuguggggagagggggcugcuccuuuuccccucccaccuguuuaacucaagugcugcugggaacauggucggggacccaggaguccucaggcccaucaugcccuccugccguucggcccguggccaccaccugagccaaagcccagggcaguggaugaggaagccccagcugaccagggggagggugaaggcaaaggccgcccuaccgcgagcccaccagccggccccaccgggaacgcugccccacaaauuuggcagugggcuucgcugcgcguccuccggggagcuuucugucccugcagcuggagcccaggacggccguggccaggcccggggcagacggaagugucugcgugggggagguggcgcucaccuucgcuggagucgacuccuucgcuggaccgccugguccugcggagagagcagccccagggcagggugagggcggggagggcuguccccuccccucucucaggaauucuagaguugggggaggccagaaaaggcgccagaugccaaucgucuucccaccccaguccacgccccaccgggaggccccguggagccccggcccaaggccaggucggcugggugggcgccgaguguggcggggggcgcgcucagaucggggccuccgcagcccgggcggcgcgcagggcucuggauugugccccggcgccaguaccagagacccucgaggcccccagcgcccuccagcccgagccccggggcccccuccucauguccccguucgagaggagcccgcuggcgggcaggacgcgcucccaagccggggcagcaacugcgugggcggcaccacggccggaccacacucacccagggccccacgggcguggaggcgccgcugcccgggggcgaacggcucacugugaccagggccauggagccaggccgcgagcaccugggcuggcaccgggcacggccccuucccucaaccccgcggacaguccuggacccgcaggaccaggaaggacggacggcgccacccgggccuggcaccuccucgggggcggcccuuaaagggccagacac

SEQ ID NO: 18649 - RNA, 4042 nt, Homo sapiens
gccugcccggaggccaagcccucucggccccaccccgcagcagcccugccaggggcgccgccccagccccccccacggccgaaccccgugccgguuggggacccuccacgugacucggugaugcagaacgguuaugaccuucagcgugugucugugaacgcaagggucccagcaacagugcggguuugcgcucggcccugcccgugggugcagggacgugugggugugugggcauguguggguguguuggggagggugcccagcgacaugugacaaagacgcccgucuccgggagauggugaaggggcccgcgagcaggcgcuuugucuggcugucugcagagugagguucgcgccgcggcggcgggcgcccgugcggugcaggaugccggggcgccaggauggccgggggcgcgcgcgccugugccagggugagugcgcugcggcagcgccgggggacagcgcggagggcccgcgccggcccgggccucgggcgugacugggcgccacccgugggcgcugcagcggccgcguguccccgugaccucaggagccggcccgggcccggguggauccccgcgcgccccuccccguccgcccuccacgugcguguccgcggcgcgcgcgcccgccggcgcgcacccgcucgccugucgccgccgccaccgcuaaccgcgccgggaaaaggugccgggaaccgagcgagccggggccgcgggcccgagcgccaugggcccgagggugggcggcgggcggccggucauccccgggccucguccccgcgggagagcggccaggagucggcgggggccggccgggcucgcagggaggccggcccgcgcccccugagcgacggacaccaggugagggggccgccgggcgcagcgcgggggccggccagggaggggccacggacuccacgggagguucggggggcgccuucucuggcgggggaggguauggcggggaguggggaggcggcuggcgauuccuggggacgccugggaaaggaaguuccgggacccucccugcucucgguccuccuccgcuuccugccucaugccucaccuuguccccagcgccuggacucccccuuaacugcuugggaaaugugaccuuugcucuggggggccuggcccugcaggccccaaccuucccucaucucuggcggcccucuugggccucugacccagccccuccccgggccaggcucacagaagcuggcuucugggacuguccugggcccaagugggcaccugcgccagccccaccugugccugggcuguggccccuuccuacagggcgcucaccauggccccgccgcuccugcugcugcugcuggccaguggagcggccgccugcccgcugcccugcgucugccagaaccuguccgagucgcucagcacccucugugcccaccgaggccugcuguuugugccgcccaacguggaccggcgcacaguggagcugcggcuggcugacaacuucauccaggcccuggggcccccugacuuccgcaacaugacgggacugguggaccugacacugucucgcaaugccaucacccgcauuggggcccgcgccuuuggggaccucgagagccugcguucccuccaccuugacggcaacaggcugguggagcugggcaccgggagccuccggggccccgucaaucugcagcaccucauccucagcggcaaccagcugggccgcaucgcgccgggagccuucgacgacuuccuagagagccuggaggaccuggaccuguccuacaacaaccuccggcaggugcccugggccggcaucggcgccaugccugcccugcacacccucaaccuggaccauaaccuuauugacgcacugcccccaggcgccuucgcccagcucggucagcucucccgccuggaccucaccuccaaccgccuggccacgcuggcuccggacccgcuuuucucucgugggcgugaugcagaggccucucccgccccccuggugcugagcuuuagcgggaacccccugcacugcaacugugagcugcuguggcugcggcggcuggcgcggccggacgaccuggaaacgugcgccuccccgcccggccuggccggccgcuacuucugggcagugcccgagggcgaguucuccugugagccgccccucauugcccgccacacgcagcgccucugggugcuggaaggccagcgggccacgcugcggugccgggcccugggugaccccgcgccuaccaugcacugggucgguccugacgaccgguugguuggcaacuccucccgagcccgggcuuuccccaacgggaccuuagagauuggggugaccggcgcuggggacgcugggggcuacaccugcaucgccaccaacccugcuggugaggccacagcccgaguagaacugcgggugcuggccuugccccauggugggaacagcagugccgaggggggccgccccgggcccucggacaucgccgccuccgcucgcacugcugccgagggugaggggacgcuggagucugagccagccgugcaggugacggaggugaccgccaccucagggcuggugagcuggggucccgggcggccagccgacccaguguggauguuccaaauccaguacaacagcagcgaagaugagacccucaucuaccggugaggaugcgugccccacacccggcugcacucccggcgcccuuccuccgcccucugcuccccacaaggcuuugcuuccaccccuccucucucuggggcugacacccccuccccgaccauggcugcuggacucuuggaggagcaguggccuggccuggccuggcugccugagggggcuggagcucaaggggcggcagaaggaccccaccccgagaugucccaggugucacugagcugugcaggccuccccggcagcagguggcgguugggucugucugaagcacauggcccgcgcccgcguguuauuucugccucugcuggugccauccccccaccccauuccccucgcuugccugcguccugugccagugcacacacccaucuccuggccacacucuccagccuguucaccuuccugagugaacccaagagcccgaguggccccagggggagggguguuuggagcugggagcacgggaguggggaggugaggauggggcuagaccccagccccgggcucugaccaccugcccuugccugcaggauugucccagccuccagccaccacuuccugcugaagcaccucguccccggcgcugacuaugaccucugccugcuggccuugucaccggccgcugggcccucugaccucacggccaccaggcugcugggcugugcccauuucuccacgcugccggccucgccccugugccacgcccugcaggcccacgugcugggcgggacccugaccguggccguggggggugugcugguggcugccuuacuggucuucacuguggccuugcugguucggggccggggggccggaaauggccgccucccccucaagcucagccacguccagucccagaccaauggaggccccagccccacacccaaggcccacccgccgcggagccccccgccccggccgcagcgcagcugcucucuggaccugggagaugccgggugcuacgguuaugccaggcgccugggaggagcuugggcccgacggagccacucugugcauggggggcugcucggggcagggugccgggggguaggaggcagcgccgagcggcuggaagagaguguggugugauggacgggcagcuuccugugugcuccaagggaugagccucguggggcagagggcccggggccgccgccuggccugggagucccucccugguuuuuauucucaguaccucaggcuccccuguguacuuggaggggcagggagcccuuuccucgguucuggccuccagaccaggguaagggcaggccccuccaacaggugcucacagccaccgaggcaggggcugcagccacccacugggagucuuguuuuuauuuauaauaaaauuguuggggacaccucag

SEQ ID NO: 18650 - RNA, 14679 nt, Homo sapiens
cgugcugcguggucauuuguaugcagccucgggauuggucacucggcucccgcgaggggaaggggagggaagcagcgcgcacucgcgcgugcgugagcuggcgcgcgagaaagggcccggucgcguccaggcucgagcggccgucgccauuuuguaagguucucucugacgugggagccgccgucgcugccgccacccggaggugcgagggggucgugugugugugauguggggagcucgggggcgggucgggccgggccuccggcagacugcacggcccggauuuggguuucucauuuugcagcgggaggucugggaagacaacgggaggaggcggggccgggucuccggaaggaggcggggcaggggucgggucgagucuuuguuggggcgaagaagcuggagggugggccgcugggggcgaggugguugguccccgguuugggggaaaggggacuuuuuucuuuuuagaguaucuugaaaggcgcuagugcgcgcaggagagguacacagauuucccuccaaaaccuuguuaccaggcgcacugcgauugaugccccuugccuuugcuugggcuuuucucuucccucauuuuaagacaugaagcagcuaauucugguauuucauugcgcuccacuucacggagaugauagacugggcuaugcaugcugacccucgaccuccuguuugcaugucacgcauagcucgcacuucucgagaacaaaccgcccuucuucuauugaggaagaauaaugaaugucuguacgagggucuugaaggugcaagaacuuuggaggauuagacgaaaaugcugcagugcaccgaaauuucccaccacaccccugacuuuugaagucuuguguuucucucccaggcucuugucaggauggugaagcuguucaucggaaaccuuccccgggaggcuacagagcaggagauucgcucacucuucgagcaguaugggaaggugcuggaaugugacaucauuaagaauuacggcuuugugcacauagaagacaagacggcagcugaggaugccauacgcaaccugcaccauuacaagcuucauggggugaacaucaacguggaagccagcaagaauaagagcaaagcuucaaccaaguuacacguggguaacaucagccccacuuguaccaaccaagagcuucgagccaaguuugaggaguaugguccggucaucgaaugugacaucgugaaagauuaugccuucguacacauggagcgggcagaggaugcaguggaggccaucaggggccuugacaacacagaguuucaaggugaacugcucugggccuggguaguagcgccgaguggggucuagcucaaaacaggcaagaacacaagacuauagaacuugcuggguggucucuuccauucuguuuuagcuggaaauaauagauuauguuuaccgcucuuaagcauaauuuaccccuggggaagcaaacacuuccccuuuucagguuugcuaagauguugcucaccgacugcauagaaucacaaacuguggguuacuuuacccugcgggauucuugcauugauucgagugcuguuggaaguguaaucugcuuggggaaacgaguaccucaugagagaagggaggauaaagguccguggcuuaccugcuucuuuggugaugaucaggaagccuuauauuugaggguuuaagugcuuaagauuuauauucuuuacugcuuuggguggauacuggugggaaagaagaaaaaagacaucuagaggaagcccuauauuauaaaucuggguggcaagucuggaucugcgggaguaucuuuuuguugaucaaaguugugcagucucuucaagcagagucaaaaaaacaugccauggaguguucugcuccaccuguucauuucacccucagaaaaggaaauuucuaaauauaucagacucaaugggaaugauggucccgcuucugaagaaauuucaguacaagcaucguagagcauaucauacuauuuauaccgauaauaaagguacauauguugucauuaauaccacaagagguugucagaagacucuagaacugugcuaauaugguaaccacaugcggcuuaguaaauugaaauuaacagauuagauaaaauuuaaaauucaguuuuucaaguguauaccagacacguuucaagcacucaguagucaugaggccuguggcuaccguauuaauagagacacagaacauuuccaucaucauagaacauucuuuuggauagcacuguucuacaaguguuuuguuaacaguaucgucuuggaccucauguucauagccacuuuugugguuccuaagucaacaccuuuuuugcccugagugucauuaaagggguuguuaagaaguacuuuugggucuucuauuaaaacuaaaaaacaaaaugagaaaaauaaugggagaagaggaaaaguugaccagagaaggguaagaaaguuugcauaguggagauggguagaggagcaccaucaaguaucuccagcuucagccagugaugccuuggccuuuagcugcucuuuaaagcauagggcaaagguugcagauacuuccuaccauuaacuagugugugaccuuggacaaguguuuuaacauuucucugcuucauuuuccucacuaagauuguccccacuuauggaguuaaugaucccuacuguaccucccucacaggauuguaguggggcuagaaugaagaaaucgaugugaaaguguuuugauaguaaaagcucuuuaugaugacaggugauugcucuuugcaaccaugaguguuucuauucugguuagaaaauuauugaaagugugauagcgaagcuuuccuuauugguuugcuuuucuuacauuuguuuuucuuuuucuuauuuuggaauguuguugcauuuucagcuuuuaaaaguaucuuaauuauuuucauuugaugggggaaaucaucaugauggacaguggagacuggggaaggaggguuuucuccugacagguaaugagcaaaauguaaaagaauguaaaguuggguacaaacugcagagguauucuaguaaugucauacagaaugcccuuaccuuuuaaauauauuuaauacaggcagggugcggugccucacaccuguaaucccaccacuuugggaggccaaggcggguggaucaccugaggucaggaguucgagaccagccuggccaacauggugaaaucccaucucuacuaaaaauacaagaaaacuagcaaggcgugguagugugugccuguaaucccagcuacucgggaggcugagacaggagaaucgcuugaaccugggagguagagguugcaguaaaccgagauugugccacuguauuccagucugggcaacagcgagacuccuucucaaaaaagaaaaaaaaaaaaccauauauauauuuaauacaacugaauaaaaggaaaaggacaggccgggugcuguggcucacgccuguaaucccagcacuuugggaggccaaggcggggggaucacgaggucagagauugaguccauccugcucaacauggugaaaccccgucucuacuaaaaauacaaaaaaaaaauuagccggccaugguggcaggcgccuuguaguccccacuacucgggaagcugaggcaggagaauagcgugaacccaggaggcagagcuugcagugagccgagaucaugccacuguacuccagccugggggacagagcaagacuccaucucaaaaaaaaaaaagaaagaaaagaaaaagaaaagcuaccugaaguuaauaaaaaaaaaaaaaaaagaaaaaaaaaucaguuaauuggggggaguuggcuuaggaugaauauguguuuuaauaaggcagguauaauuacuuuaggauguaucugaauaaugcaguggauccauaagauuuuuaaaaacaucacuuccuuagaaagugcaaacacuaaaaugaauuggaaaagaaaaauccuguauuugguuuucauguucuuaacuuggcuccucuggagauagcacucuccuccuaguuauagagacguuuuuauaacuagcucugguuuuuuuucucccagaugacaagagcaagcuuagcacuggauaguaaguuguaguuuuacagaaaauacagucuggauaccaguuugacacguuucaauuuaaguuauuuucaguugucuacuaaugaagguggccucuuaaaagggccacuugagcccgggugagguggcucacuccuguaaucccagcacucuggaaggccgaggcggggguggaucaccuaaggucaggaguucaagacuagccuggucaacauggugaaacccugucucuacuaaaaauacaaaaauuagcuagguaugguggcacacaccuguaaucccggcuacucaggaggcugaggcaggagaaucacuugaacccagaggcggagguugcagugagucaagaccgugccaccgcacucuagccugggcagcagagcaagacuuagucucaaaaaugaaccaacaaaaaagugccacuugaacaucuuuugaaccuuuauuucuauauguuaauggcugccauugaggcuuuuugcauuguaugacuucuaaaaggaaguagcggaaucugaguuuacuuuacucuuucaggaucuguuuccuuuuuacagccagcagugaacucaacuuauuuccuuagacacauaguuuguauuggaagaccuaaagaagcuauucccaaauaacaaucaggcagcuuaauugggaagaaugugugagaguucaggugucuuuuuuuuuuuucccuauauguaaacaagcauuaagucagaauacuacucuguauuagcuacauccccagucuuuucuggaucauggcacuugauaggcgcucagaaauuaagaccccaaguuucccacuucucagcauuuuaaugcucuuuucuguuacagcuuucaaaauaaaacacuuauagggcugguuuucuggaaaauguuggcaacaaacuucaguaacuuuuggaagucccaggaaauuuuaagcuuuuggccuacuuuguccaaguguaguagaguagaagaauuaaucuuucauuuuucuuugcccugguuccuuaagguauaauaauagagaggcauagucuuuuucaauuacuauaaaaacuuuaggguauuuaaauuuaaaggcuaggcuggaugugguggcucaugccuguaaucccagcccuuugggaggccgagacaggcggaucaccugaggucaggaguucgagaccagccuggccaacauggugaaaccucgucuccacuaaaaauagaagaaauuagccaggugugguagcgugcgccugcagucccagcuacucgggaggcugaggcaggagaauugcuugagcccaggaggcagaaguugcagugagccgagacugcgccacugcacuccagccugggcgacagagcaagaaucugucccccccccccaaaaaaauuaauaaaaauaaauuaaaaggcuaauuauaaccguuggaaggacugguuguuuugguuuuuuuguggguuuuuuuuuuuuuuuuuuuuuuuagacagucuugcucuauugccuaggcuguagugcaguggcacaaucucagcucacugcagccuccgccucccggguucaagugauucuugugccucagcuucccaaguagcugggacugcaggcaugugccaccaugcccagcuaauguuuuguauuuuuuuaguagagaggggguuucaccauguuggccaggcuggucucgaacuucuggccucaggugauuggcucaccucagccucccaaagugcugggauuacagauaugagcuaccacacccagcuuggagaaacuguuugaaaaaauuuuuuuaaacucgucaccccuauuauagauuuuuuuaguucuagguuaaaaaauugggccgggugcaguggucacgccuguaaucccagcacuuugagggggcugaggcggguggaucacgaagucaggaguucaagacuagccuggccaagauggugaaaccccaucucugcuaaaaauacaaaaauugcuuuaaaaccacaccaaugguggcaggugccuguaaucucagcuacucgggaggcugaggcagggaauugcuugaacccgcgagguggagguugcagugagccgagauuucgccacugcacuccagccugggcgacagagcaaaacuacgucucaaaaaucaaacaaacgcaacaaaaaaauugauaccugcauccuuuucacaacuacacagagguagauuuuaccacagauaaacuugauuucccacccucuaaauaaaagcaggaaugaagauuggauuuaguuaaaaaacaucaagguaaaauugcuggguuuuguuucuccaaaaaauggacccagaaucuauaaaaguaaagugcaaauuuaauugaauuuuuuuguuaaaaauguuacuuuuaggucucuggauuggcuccuuuuuagacugucauggucacucugacuucacaauuggaguauacuuugugucugucacauagcuuaaugucaccauguauauuugaaagccaagucauuuauaaucuuuuagucuaaauuauagggaacuaugcauuugagauauaaauuguggcagaaaucuguguuucuguucaaagcacaguuagcauuguggccccuaacaucuaacaauuaggagcauuuaaaucucugaaaacaaugggauggcaaaaugcuuuuagagauuuagugccauuuuggguaucugcugacucuauuggugauaguggaugcggccugucuccuagcaguuggagguauaaagccugagcacuuuuguuucugcuagaaacuggagugauaggacucuuugacauugggcagaaggaauuugacuaaagugauauugccacacuaacccgcuccccucucagggucagugcauggcacuguucuggcugccguccucaauagggcuauuuccaacaggaugguggagcacaaggcuuccucucgcauagcugcauccagaagaaggucuguuaaagagagagcaacuugcugauugcagaggggggauuuguucucagcaguccuuaagaguaaugagaagcccuguucuuuuuaucuguacugacugcguuuuccauuuuuuuuuuuuuuuugagauggagucucacacuguugcccaggcaggauugcagugguaugaucuccacucacugcaaccuccaccucccagguucaagcgauucuucugccucagccucccgugcauuuucuuuuggcuacaauuuggaaagcacugacuugaucuccaggagagucuugugcaaccugggacuaaauaaugccaggaauacuccuuuucuuuaacugcuuuuaaagacuucagaugcuuucaucaguaaggguccauggguuuggugguucacaaucccugggcaaagauuguuuucuucucuuagcuguuccucagugcuggucauuuccuggaagccaaaauggauguggcccauuuguguggguuccuagaggucucuaggcaaaugcugcauuuuucuaacuaguaguuaaucccuauaaaaauuguaaguuacauggcaggaugaaaugacagucauuucauuacaugucaagacacugucccuaagaaagcaguacuguuucaagaucuaauucuucuuguugagagaccuuggucagguagcuuuccacaguagccuugggggggucggggguggguggugggcuaaacugaaaucugaaaggucuuauaacucccagagauacuagagaugaagcagaugacaagccagguaugguuuguguacccaucauuggagccuucuggugacaucugcaaaaauagcuagaggaaacaagauggacggacuauugaugugguuuuuaagcaguaguaaauacucaggccuuaauccuuagucagucagugagagaugggcaagaugccguccaaaucuggcuuaacugagguuuuguugguugauuuuggaaguauuggcagaauuugaaucauuacaaguaauaacaaucuuagugagaaguggaaacuuuuccaauuguuguguauaaggggaaaaaggaaaguuguggagacagaaacaggagggagucuggucuauuccuggccuaaguagaaaguauugacuggucucugaggaaucaaauuuucuagcucucaucuguauuaaacuucaacuacuggcagggcgcaauggcgcaugccuguaaucccaacacuuugggaggccaaggcgggcggaucacccaaggucgggaguuugagaccagccugaccaacauggagaaacccugucucuacuaaaaauacaaaauuagccaggcauggcagcgcaugccuguaaucccagcuacucgggaggcugaggcaggagaauugcuugaauccgggagguggagguugcggugagcugagauugugccacugcacuccagccugggcaacaggagggaaacuccgucucaaaaaaaaaaacaaaaaaacuucaacuacuuuuuaaaggagguugcugaaauagggucacaggugugugcgucuaugugucuuaugacaacuaauuuacuuucauuuggggaggagaggaaaaagaaugucaagugaguuaaaauaaaucuucuuacaucuguucccucaaggcaaaagaaugcaugugcaguuguccacaagccggcuucggacugccccugguaugggagaccagaguggcugcuaucggugugggaaagaagggcacugguccaaagagugcccaguagaucguacgggucguguggcagacuuuacugagcaguauaaugaacaauauggagcaguucgaacaccuuacaccaugggcuacggggaauccauguauuacaacgaugcauauggagcacucgacuacuauaagcgauaccggguccgcucuuaugaggcaguagcagcggcggcagcggcuucugcauacaacuacgcagagcagaccaugucccaucugccucaaguccaaagcacaacugugaccagccaccucaacucuacuucuguugaucccuaugacagacaccuauugccaaacucuggcgcugcugccacuucagcugcuauggcugcugcugcagccaccacuuccuccuacuauggaagggacaggagcccacugcgucgugcugcagccaugcuccccacaguuggagagggcuacgguuaugggccagagagugaauuaucucaggcuuccgcagcuacacggaauucucuguaugacauggcccgguaugaacgggagcaguauguggaccgagcccgguacucagccuuuuaaaaacuggaggugagagaugggugggaaugguuaaaagauuccauuuaguucccuugaaagagacccaugcuucauaaaaguggcuagagccaccugugcucuccggacaguauccaaaaggugcaaauuacauguuagucuucaauauuucucuagcuuaggccacaaguuccauuuggccugucaagguguuaguguaugacuccaaccaacuuguuccuucugagagaacaacaaauucaguuuguuagugagaacauucuuuaaucaguuguaagcauauuuggguuacagaaaaacauuugagagaucuaacauuuguuaugugcccucuguauaucaucuacacgauaagacugaaauauuuuauucuuuuacagagaagggaacuaaagcucagagagguuaaguacuuugcccaaagucauuugauaaaugaaagguagaaccagaauucaaauuuggaccugucugauaccaaaacccauacucgcucuacuacagaaguacuguagugguaagcugaaggguacagguucagggguuaguaaugaauaucacagugagaauuuuaacuauuacuuuaggcuuauaguuugcuaauaaaauugcuaccugaaggcagaggcaguggcucacuccuguaauccuaacacugggaggcugaggcgggaggaucacuugagcccaggaguucaagaccagccuaggcaacauagcaagacccugucucuacaaagaaaauuaaauuagcagggugugauggggagcaccugugaucccagcuacucagaaugcugagguuggaaggauugcuugagcccaggaguuaaaagaggcugcagugagcuaugaucacaccacuguauuccagccugggcaacagagugagacugucucuccuuuauuuaaaaaaaaaaaaaaaccuacuucuugggucauuguccuuugucaaaggaaacucuucuaauaucauaccuacaugccagaggaaguccuauaaauuuuaaauguuuacuuccaagacauuuacuugaaaguugaauguuuugauguucugucccaugggguccuuauuguaaucuagaccaucuuguucuagaugggcacuuaagcccuguuucuucauagucuguuaugcugucauuuggaccuggaugcuuccuguuucuuccagcaauuuuuguuuguguuuuuuguuguugaagagaggaacauuuaaggaguuagauaaacugguaauuuucagauguguagaaaauugcauagguggugaaagccaaugccauaggcucugaaauuuuacuauuuccuacaucaggaaauguguaccaaaagugcuaaaaugccaagaauaauuuugaguaucuaaagauagauaaaucuuuucaucugaguggaaauggcauuaugacuuuauauucucaugguuuuccuuguaccuugaaauugagcaucacuugaauuggagccccagaagcaagguuaaagugaguuacuacugaguuucugguguuccuaacuuaucccuuugguauauauguagaagauaacaaagcagcuguguacaguggcuugugccuguagucccaacuauucaggaagcugaggcuggaggaucccuugagcccaggagugagagacugcaguuagccacugcacuccagccugggcaagaguggcuccucucucucuuaaaaaaaaaaaaaaaaauuaaaaagcaaagccacagcaauuugcucuuuuaugugaauugagaagcaaauguuaugaaccuguaauaaguuguacccuauaugcaugucagcaagacuugagaucucuugagaccaccaugcagcuagucuguguuuaugugugaagcaaaugaucuuaaaauuuauaguuugccauuaauuuuuacuuuuaaugcagcuggaucuagcauggggugggacaugcuuccgaaguaagcugguauaaaucuaucagauaaccugucucuuauguuucaaaguuaaauauuaaauucauauauuguggucuucaaaagguauugcuaggacauuuuaaaaugaauuuugacugcaagcagugguuguucaacuaaccucuuuuuagcgaugacuuuuaaagaaacuuaccuuccaggugugaaccucaaauggacugaauaacccugaguugguugcagucccaggagccugauguuaaugaggcugccaggaugaaauacuccagaacuguuggggauccaaauucgggucucacccuagcagaacugauccaagaacgucacaacuuuugaagucgauuggcacagaucaagaccaagauuuggcccuuugucuguaauaaguagaggaacuuggugugaguuaacuuuuuuuuucccccagccauuggugucuggaguucccaucaucaauagaaggauuagagaauucuaggaaugauuucuuuugauuuggcaagggagauuuggucaauuaggggaacuacuggaacuguggcucucacucugugacagugugacauguagguguguuggaauugggugaaugacuggcugcuccuugauauccuaccccuugugaccaucauuucugaaagcuuguuuacugugaaagauuaaaacaaaacacauuuagaauagugcaauucgccauauaugacaucucagcaucuucugcuuuuccuggacuccaaaauuaaauugcaguucuugaaaauguauguaugcccuuuguuacagcaacaguagccuucugucacagggguuaucuugccuaaaagauggauaagaaagauguauuuaucaccaacacauucuucagcuagauugcaucuuguccuauauauauagccauaaguggauuccuauauauagcuauugauagacuccuagguaauuacaugggauaugaguuagauccagucugacuugguuuuguuuuguucuuuuuuuuccccccggaauacaggacaggacccagggcgcuuguacgcggagccaggcugcucuccaggcauuguguaagccucuuguguugugcucucuuucagguaggauaauugcggacugaacccucgggcugcggucauauaugagaacuugcuccgcgcgguccccuuugccgggauguuuccauugcuucauguuucaguaaacaaaaggaguuugugaccaacuauguuuucuuucuuaauucuucuaaguugacuuuucuuuccuccugaaacuagucucuguagccuuucacucuguuccuuauauucucagccucugagcagcccuagguaaggauuaugcuggcauccccuuuuuccugugcaguggaaccccucuuaucuugcuuucccuaggaguugaauccuucucccugccuaccugcagcaucuccuuucccuuuaaaaugaccauguaguggcaagcagccuuuuacucuucuguuagcucuggacucuuaacacuuaaguuacucuucugaaauugcuaggaccauuggggguuuuguuguuuuguuuguuuuuuauguccgaccugugaucgugguacagcauuagcugaaauuuacccuuguuuuacuccacuccucccuuuuuuaaaaaaauuuuuugacaaauaaauguuucuaacacuuaaauaucuuuuuauguuugucuuuuuauucucucccaguucuuaagcuacaaaguucaaacuaauagaugucagaaauuuagauauagaaggaaggauuuaagcccaggcaugguggcuuacaccuguaaucuuagcacuuugggagguugaggugggcaggucacuuaagcccacugaaguucaagaccagccugagcaacauguugaaacccugucucuaccaaaaauaaaaaaucaguuggccagcugggcgugauggcucacgccuguaaucccagcacuuugggaggccaagguggguagaucaccugaggucagguagaccagccugaccaauaucgugaaaccccaucucuacuaaaauacaaaaauuagcugggcgugguggcaggcgccuguaaucccagcuacucaggaggcugaggcaggagaaucacuugaacccaggaggcagagguugcaguuagccaagauugcaccauugcacuccagccuggacaacaagagcgaaacuccaucucaaaagaaacaaaaacaacaaaauuaguuggccaggcgcgauagcucacgccuguaaucucagcacuuugggagaccgaggcaggcagaucaccugaggucaggaguuugagacuagccuggccaacauggcgaaacccugucccuacuaaaaauacaaaaauuagccaggcgugguggcgagugccuguagucccagcacuugggaggcugaggcaggagaauugcuugaucccaggaggcagagguugcagggagccgagauggcaccacuguacucccaucucaaaaaaaaaaaaaaaaaaaaacagcugggcaugguggugcaugccuguaaucucagcuacucaagaggcugaagugggagacucuugagcccaggagguugaggcugcagugagcugugaucaugccacugcacuccauucugggcaacaggaggcccugucuccaaaacaacaaaaaaggauuuagguuagugcuguggcuucaguaauaggugguaggaaguuagccagauucuugagacacugcuaaauuugcuacagcugguggugaggcuacuuuucucuaaccagagcugcucuuaaaccaguuuaaaggcuaacagacucagauuaguagugcuaggaguaagcccugcaucagaaaaaggcugagccagauucucuccaaggaccuaucacauuaacuaaauuugacuucauaguuuucuggcucauauuuacaaaacaaaaagaaaacauauauacacacacacacacacacacacacacauauacacacacauuuuugccuaguuaccaccccucuccaguguuucuccuuuuuuaauuuuuaaaaaacaauuaggccaggcacaguggcucaugccuguaaucccagcacuuugggaggccaaggcacacgaaucacgaggucaggagaucaagacuaaaauacaaaaaauuagcuggaugugguggcgggcgccuguagucccagcuacucgggaggcugaggcaggagaauggcgugaaccaaggaggcagagguugcacugagccgagaucacgccacugcacuccagccugggugacagagcgagacuccaucucaaaaaaauaaaaaauuaaauucacuuaugagcuauuaaaagaggucugucuucccaaggugcuaauauucugcuaggauuaggcuuuggcuaaaau

SEQ ID NO: 18651 - RNA, 14679 nt, Homo sapiens
auuuuagccaaagccuaauccuagcagaauauuagcaccuugggaagacagaccucuuuuaauagcucauaagugaauuuaauuuuuuauuuuuuugagauggagucucgcucugucacccaggcuggagugcaguggcgugaucucggcucagugcaaccucugccuccuugguucacgccauucuccugccucagccucccgaguagcugggacuacaggcgcccgccaccacauccagcuaauuuuuuguauuuuagucuugaucuccugaccucgugauucgugugccuuggccucccaaagugcugggauuacaggcaugagccacugugccuggccuaauuguuuuuuaaaaauuaaaaaaggagaaacacuggagaggggugguaacuaggcaaaaauguguguguauauguguguguguguguguguguguguguauauauguuuucuuuuuguuuuguaaauaugagccagaaaacuaugaagucaaauuuaguuaaugugauagguccuuggagagaaucuggcucagccuuuuucugaugcagggcuuacuccuagcacuacuaaucugagucuguuagccuuuaaacugguuuaagagcagcucugguuagagaaaaguagccucaccaccagcuguagcaaauuuagcagugucucaagaaucuggcuaacuuccuaccaccuauuacugaagccacagcacuaaccuaaauccuuuuuuguuguuuuggagacagggccuccuguugcccagaauggagugcaguggcaugaucacagcucacugcagccucaaccuccugggcucaagagucucccacuucagccucuugaguagcugagauuacaggcaugcaccaccaugcccagcuguuuuuuuuuuuuuuuuuuuuugagaugggaguacaguggugccaucucggcucccugcaaccucugccuccugggaucaagcaauucuccugccucagccucccaagugcugggacuacaggcacucgccaccacgccuggcuaauuuuuguauuuuuaguagggacaggguuucgccauguuggccaggcuagucucaaacuccugaccucaggugaucugccugccucggucucccaaagugcugagauuacaggcgugagcuaucgcgccuggccaacuaauuuuguuguuuuuguuucuuuugagauggaguuucgcucuuguuguccaggcuggagugcaauggugcaaucuuggcuaacugcaaccucugccuccuggguucaagugauucuccugccucagccuccugaguagcugggauuacaggcgccugccaccacgcccagcuaauuuuuguauuuuaguagagaugggguuucacgauauuggucaggcuggucuaccugaccucaggugaucuacccaccuuggccucccaaagugcugggauuacaggcgugagccaucacgcccagcuggccaacugauuuuuuauuuuugguagagacaggguuucaacauguugcucaggcuggucuugaacuucagugggcuuaagugaccugcccaccucaaccucccaaagugcuaagauuacagguguaagccaccaugccugggcuuaaauccuuccuucuauaucuaaauuucugacaucuauuaguuugaacuuuguagcuuaagaacugggagagaauaaaaagacaaacauaaaaagauauuuaaguguuagaaacauuuauuugucaaaaaauuuuuuuaaaaaagggaggaguggaguaaaacaaggguaaauuucagcuaaugcuguaccacgaucacaggucggacauaaaaaacaaacaaaacaacaaaacccccaaugguccuagcaauuucagaagaguaacuuaaguguuaagaguccagagcuaacagaagaguaaaaggcugcuugccacuacauggucauuuuaaagggaaaggagaugcugcagguaggcagggagaaggauucaacuccuagggaaagcaagauaagagggguuccacugcacaggaaaaaggggaugccagcauaauccuuaccuagggcugcucagaggcugagaauauaaggaacagagugaaaggcuacagagacuaguuucaggaggaaagaaaagucaacuuagaagaauuaagaaagaaaacauaguuggucacaaacuccuuuuguuuacugaaacaugaagcaauggaaacaucccggcaaaggggaccgcgcggagcaaguucucauauaugaccgcagcccgaggguucaguccgcaauuauccuaccugaaagagagcacaacacaagaggcuuacacaaugccuggagagcagccuggcuccgcguacaagcgcccuggguccuguccuguauuccggggggaaaaaaaagaacaaaacaaaaccaagucagacuggaucuaacucauaucccauguaauuaccuaggagucuaucaauagcuauauauaggaauccacuuauggcuauauauauaggacaagaugcaaucuagcugaagaauguguuggugauaaauacaucuuucuuauccaucuuuuaggcaagauaaccccugugacagaaggcuacuguugcuguaacaaagggcauacauacauuuucaagaacugcaauuuaauuuuggaguccaggaaaagcagaagaugcugagaugucauauauggcgaauugcacuauucuaaauguguuuuguuuuaaucuuucacaguaaacaagcuuucagaaaugauggucacaagggguaggauaucaaggagcagccagucauucacccaauuccaacacaccuacaugucacacugucacagagugagagccacaguuccaguaguuccccuaauugaccaaaucucccuugccaaaucaaaagaaaucauuccuagaauucucuaauccuucuauugaugaugggaacuccagacaccaauggcugggggaaaaaaaaaguuaacucacaccaaguuccucuacuuauuacagacaaagggccaaaucuuggucuugaucugugccaaucgacuucaaaaguugugacguucuuggaucaguucugcuagggugagacccgaauuuggauccccaacaguucuggaguauuucauccuggcagccucauuaacaucaggcuccugggacugcaaccaacucaggguuauucaguccauuugagguucacaccuggaagguaaguuucuuuaaaagucaucgcuaaaaagagguuaguugaacaaccacugcuugcagucaaaauucauuuuaaaauguccuagcaauaccuuuugaagaccacaauauaugaauuuaauauuuaacuuugaaacauaagagacagguuaucugauagauuuauaccagcuuacuucggaagcaugucccaccccaugcuagauccagcugcauuaaaaguaaaaauuaauggcaaacuauaaauuuuaagaucauuugcuucacacauaaacacagacuagcugcaugguggucucaagagaucucaagucuugcugacaugcauauaggguacaacuuauuacagguucauaacauuugcuucucaauucacauaaaagagcaaauugcuguggcuuugcuuuuuaauuuuuuuuuuuuuuuuuaagagagagaggagccacucuugcccaggcuggagugcaguggcuaacugcagucucucacuccugggcucaagggauccuccagccucagcuuccugaauaguugggacuacaggcacaagccacuguacacagcugcuuuguuaucuucuacauauauaccaaagggauaaguuaggaacaccagaaacucaguaguaacucacuuuaaccuugcuucuggggcuccaauucaagugaugcucaauuucaagguacaaggaaaaccaugagaauauaaagucauaaugccauuuccacucagaugaaaagauuuaucuaucuuuagauacucaaaauuauucuuggcauuuuagcacuuuugguacacauuuccugauguaggaaauaguaaaauuucagagccuauggcauuggcuuucaccaccuaugcaauuuucuacacaucugaaaauuaccaguuuaucuaacuccuuaaauguuccucucuucaacaacaaaaaacacaaacaaaaauugcuggaagaaacaggaagcauccagguccaaaugacagcauaacagacuaugaagaaacagggcuuaagugcccaucuagaacaagauggucuagauuacaauaaggaccccaugggacagaacaucaaaacauucaacuuucaaguaaaugucuuggaaguaaacauuuaaaauuuauaggacuuccucuggcauguagguaugauauuagaagaguuuccuuugacaaaggacaaugacccaagaaguagguuuuuuuuuuuuuuuaaauaaaggagagacagucucacucuguugcccaggcuggaauacaguggugugaucauagcucacugcagccucuuuuaacuccugggcucaagcaauccuuccaaccucagcauucugaguagcugggaucacaggugcuccccaucacacccugcuaauuuaauuuucuuuguagagacagggucuugcuauguugccuaggcuggucuugaacuccugggcucaagugauccucccgccucagccucccaguguuaggauuacaggagugagccacugccucugccuucagguagcaauuuuauuagcaaacuauaagccuaaaguaauaguuaaaauucucacugugauauucauuacuaaccccugaaccuguacccuucagcuuaccacuacaguacuucuguaguagagcgaguauggguuuugguaucagacagguccaaauuugaauucugguucuaccuuucauuuaucaaaugacuuugggcaaaguacuuaaccucucugagcuuuaguucccuucucuguaaaagaauaaaauauuucagucuuaucguguagaugauauacagagggcacauaacaaauguuagaucucucaaauguuuuucuguaacccaaauaugcuuacaacugauuaaagaauguucucacuaacaaacugaauuuguuguucucucagaaggaacaaguugguuggagucauacacuaacaccuugacaggccaaauggaacuuguggccuaagcuagagaaauauugaagacuaacauguaauuugcaccuuuuggauacuguccggagagcacagguggcucuagccacuuuuaugaagcaugggucucuuucaagggaacuaaauggaaucuuuuaaccauucccacccaucucucaccuccaguuuuuaaaaggcugaguaccgggcucgguccacauacugcucccguucauaccgggccaugucauacagagaauuccguguagcugcggaagccugagauaauucacucucuggcccauaaccguagcccucuccaacuguggggagcauggcugcagcacgacgcagugggcuccugucccuuccauaguaggaggaagugguggcugcagcagcagccauagcagcugaaguggcagcagcgccagaguuuggcaauaggugucugucauagggaucaacagaaguagaguugagguggcuggucacaguugugcuuuggacuugaggcagaugggacauggucugcucugcguaguuguaugcagaagccgcugccgccgcugcuacugccucauaagagcggacccgguaucgcuuauaguagucgagugcuccauaugcaucguuguaauacauggauuccccguagcccaugguguaagguguucgaacugcuccauauuguucauuauacugcucaguaaagucugccacacgacccguacgaucuacugggcacucuuuggaccagugcccuucuuucccacaccgauagcagccacucuggucucccauaccaggggcaguccgaagccggcuuguggacaacugcacaugcauucuuuugccuugagggaacagauguaagaagauuuauuuuaacucacuugacauucuuuuuccucuccuccccaaaugaaaguaaauuaguugucauaagacacauagacgcacacaccugugacccuauuucagcaaccuccuuuaaaaaguaguugaaguuuuuuuguuuuuuuuuuugagacggaguuucccuccuguugcccaggcuggagugcaguggcacaaucucagcucaccgcaaccuccaccucccggauucaagcaauucuccugccucagccucccgaguagcugggauuacaggcaugcgcugccaugccuggcuaauuuuguauuuuuaguagagacaggguuucuccauguuggucaggcuggucucaaacucccgaccuugggugauccgcccgccuuggccucccaaaguguugggauuacaggcaugcgccauugcgcccugccaguaguugaaguuuaauacagaugagagcuagaaaauuugauuccucagagaccagucaauacuuucuacuuaggccaggaauagaccagacucccuccuguuucugucuccacaacuuuccuuuuuccccuuauacacaacaauuggaaaaguuuccacuucucacuaagauuguuauuacuuguaaugauucaaauucugccaauacuuccaaaaucaaccaacaaaaccucaguuaagccagauuuggacggcaucuugcccaucucucacugacugacuaaggauuaaggccugaguauuuacuacugcuuaaaaaccacaucaauaguccguccaucuuguuuccucuagcuauuuuugcagaugucaccagaaggcuccaaugauggguacacaaaccauaccuggcuugucaucugcuucaucucuaguaucucugggaguuauaagaccuuucagauuucaguuuagcccaccacccacccccgacccccccaaggcuacuguggaaagcuaccugaccaaggucucucaacaagaagaauuagaucuugaaacaguacugcuuucuuagggacagugucuugacauguaaugaaaugacugucauuucauccugccauguaacuuacaauuuuuauagggauuaacuacuaguuagaaaaaugcagcauuugccuagagaccucuaggaacccacacaaaugggccacauccauuuuggcuuccaggaaaugaccagcacugaggaacagcuaagagaagaaaacaaucuuugcccagggauugugaaccaccaaacccauggacccuuacugaugaaagcaucugaagucuuuaaaagcaguuaaagaaaaggaguauuccuggcauuauuuagucccagguugcacaagacucuccuggagaucaagucagugcuuuccaaauuguagccaaaagaaaaugcacgggaggcugaggcagaagaaucgcuugaaccugggagguggagguugcagugaguggagaucauaccacugcaauccugccugggcaacagugugagacuccaucucaaaaaaaaaaaaaaaauggaaaacgcagucaguacagauaaaaagaacagggcuucucauuacucuuaaggacugcugagaacaaauccccccucugcaaucagcaaguugcucucucuuuaacagaccuucuucuggaugcagcuaugcgagaggaagccuugugcuccaccauccuguuggaaauagcccuauugaggacggcagccagaacagugccaugcacugacccugagaggggagcggguuaguguggcaauaucacuuuagucaaauuccuucugcccaaugucaaagaguccuaucacuccaguuucuagcagaaacaaaagugcucaggcuuuauaccuccaacugcuaggagacaggccgcauccacuaucaccaauagagucagcagauacccaaaauggcacuaaaucucuaaaagcauuuugccaucccauuguuuucagagauuuaaaugcuccuaauuguuagauguuaggggccacaaugcuaacugugcuuugaacagaaacacagauuucugccacaauuuauaucucaaaugcauaguucccuauaauuuagacuaaaagauuauaaaugacuuggcuuucaaauauacauggugacauuaagcuaugugacagacacaaaguauacuccaauugugaagucagagugaccaugacagucuaaaaaggagccaauccagagaccuaaaaguaacauuuuuaacaaaaaaauucaauuaaauuugcacuuuacuuuuauagauucuggguccauuuuuuggagaaacaaaacccagcaauuuuaccuugauguuuuuuaacuaaauccaaucuucauuccugcuuuuauuuagagggugggaaaucaaguuuaucugugguaaaaucuaccucuguguaguugugaaaaggaugcagguaucaauuuuuuuguugcguuuguuugauuuuugagacguaguuuugcucugucgcccaggcuggagugcaguggcgaaaucucggcucacugcaaccuccaccucgcggguucaagcaauucccugccucagccucccgaguagcugagauuacaggcaccugccaccauuggugugguuuuaaagcaauuuuuguauuuuuagcagagaugggguuucaccaucuuggccaggcuagucuugaacuccugacuucgugauccacccgccucagcccccucaaagugcugggauuacaggcgugaccacugcacccggcccaauuuuuuaaccuagaacuaaaaaaaucuauaauaggggugacgaguuuaaaaaaauuuuuucaaacaguuucuccaagcugggugugguagcucauaucuguaaucccagcacuuugggaggcugaggugagccaaucaccugaggccagaaguucgagaccagccuggccaacauggugaaacccccucucuacuaaaaaaauacaaaacauuagcugggcaugguggcacaugccugcagucccagcuacuugggaagcugaggcacaagaaucacuugaacccgggaggcggaggcugcagugagcugagauugugccacugcacuacagccuaggcaauagagcaagacugucuaaaaaaaaaaaaaaaaaaaaaaacccacaaaaaaaccaaaacaaccaguccuuccaacgguuauaauuagccuuuuaauuuauuuuuauuaauuuuuuugggggggggggacagauucuugcucugucgcccaggcuggagugcaguggcgcagucucggcucacugcaacuucugccuccugggcucaagcaauucuccugccucagccucccgaguagcugggacugcaggcgcacgcuaccacaccuggcuaauuucuucuauuuuuaguggagacgagguuucaccauguuggccaggcuggucucgaacuccugaccucaggugauccgccugucucggccucccaaagggcugggauuacaggcaugagccaccacauccagccuagccuuuaaauuuaaauacccuaaaguuuuuauaguaauugaaaaagacuaugccucucuauuauuauaccuuaaggaaccagggcaaagaaaaaugaaagauuaauucuucuacucuacuacacuuggacaaaguaggccaaaagcuuaaaauuuccugggacuuccaaaaguuacugaaguuuguugccaacauuuuccagaaaaccagcccuauaaguguuuuauuuugaaagcuguaacagaaaagagcauuaaaaugcugagaagugggaaacuuggggucuuaauuucugagcgccuaucaagugccaugauccagaaaagacuggggauguagcuaauacagaguaguauucugacuuaaugcuuguuuacauauagggaaaaaaaaaaaagacaccugaacucucacacauucuucccaauuaagcugccugauuguuauuugggaauagcuucuuuaggucuuccaauacaaacuaugugucuaaggaaauaaguugaguucacugcuggcuguaaaaaggaaacagauccugaaagaguaaaguaaacucagauuccgcuacuuccuuuuagaagucauacaaugcaaaaagccucaauggcagccauuaacauauagaaauaaagguucaaaagauguucaaguggcacuuuuuuguugguucauuuuugagacuaagucuugcucugcugcccaggcuagagugcgguggcacggucuugacucacugcaaccuccgccucuggguucaagugauucuccugccucagccuccugaguagccgggauuacaggugugugccaccauaccuagcuaauuuuuguauuuuuaguagagacaggguuucaccauguugaccaggcuagucuugaacuccugaccuuaggugauccacccccgccucggccuuccagagugcugggauuacaggagugagccaccucacccgggcucaaguggcccuuuuaagaggccaccuucauuaguagacaacugaaaauaacuuaaauugaaacgugucaaacugguauccagacuguauuuucuguaaaacuacaacuuacuauccagugcuaagcuugcucuugucaucugggagaaaaaaaaccagagcuaguuauaaaaacgucucuauaacuaggaggagagugcuaucuccagaggagccaaguuaagaacaugaaaaccaaauacaggauuuuucuuuuccaauucauuuuaguguuugcacuuucuaaggaagugauguuuuuaaaaaucuuauggauccacugcauuauucagauacauccuaaaguaauuauaccugccuuauuaaaacacauauucauccuaagccaacuccccccaauuaacugauuuuuuuuucuuuuuuuuuuuuuuuuauuaacuucagguagcuuuucuuuuucuuuucuuucuuuuuuuuuuuugagauggagucuugcucugucccccaggcuggaguacaguggcaugaucucggcucacugcaagcucugccuccuggguucacgcuauucuccugccucagcuucccgaguaguggggacuacaaggcgccugccaccauggccggcuaauuuuuuuuuuguauuuuuaguagagacgggguuucaccauguugagcaggauggacucaaucucugaccucgugauccccccgccuuggccucccaaagugcugggauuacaggcgugagccacagcacccggccuguccuuuuccuuuuauucaguuguauuaaauauauauaugguuuuuuuuuuuucuuuuuugagaaggagucucgcuguugcccagacuggaauacaguggcacaaucucgguuuacugcaaccucuaccucccagguucaagcgauucuccugucucagccucccgaguagcugggauuacaggcacacacuaccacgccuugcuaguuuucuuguauuuuuaguagagaugggauuucaccauguuggccaggcuggucucgaacuccugaccucaggugauccacccgccuuggccucccaaaguggugggauuacaggugugaggcaccgcacccugccuguauuaaauauauuuaaaagguaagggcauucuguaugacauuacuagaauaccucugcaguuuguacccaacuuuacauucuuuuacauuuugcucauuaccugucaggagaaaacccuccuuccccagucuccacuguccaucaugaugauuucccccaucaaaugaaaauaauuaagauacuuuuaaaagcugaaaaugcaacaacauuccaaaauaagaaaaagaaaaacaaauguaagaaaagcaaaccaauaaggaaagcuucgcuaucacacuuucaauaauuuucuaaccagaauagaaacacucaugguugcaaagagcaaucaccugucaucauaaagagcuuuuacuaucaaaacacuuucacaucgauuucuucauucuagccccacuacaauccugugagggagguacaguagggaucauuaacuccauaaguggggacaaucuuagugaggaaaaugaagcagagaaauguuaaaacacuuguccaaggucacacacuaguuaaugguaggaaguaucugcaaccuuugcccuaugcuuuaaagagcagcuaaaggccaaggcaucacuggcugaagcuggagauacuugauggugcuccucuacccaucuccacuaugcaaacuuucuuacccuucucuggucaacuuuuccucuucucccauuauuuuucucauuuuguuuuuuaguuuuaauagaagacccaaaaguacuucuuaacaaccccuuuaaugacacucagggcaaaaaagguguugacuuaggaaccacaaaaguggcuaugaacaugagguccaagacgauacuguuaacaaaacacuuguagaacagugcuauccaaaagaauguucuaugaugauggaaauguucugugucucuauuaauacgguagccacaggccucaugacuacugagugcuugaaacgugucugguauacacuugaaaaacugaauuuuaaauuuuaucuaaucuguuaauuucaauuuacuaagccgcaugugguuaccauauuagcacaguucuagagucuucugacaaccucuugugguauuaaugacaacauauguaccuuuauuaucgguauaaauaguaugauaugcucuacgaugcuuguacugaaauuucuucagaagcgggaccaucauucccauugagucugauauauuuagaaauuuccuuuucugagggugaaaugaacagguggagcagaacacuccauggcauguuuuuuugacucugcuugaagagacugcacaacuuugaucaacaaaaagauacucccgcagauccagacuugccacccagauuuauaauauagggcuuccucuagaugucuuuuuucuucuuucccaccaguauccacccaaagcaguaaagaauauaaaucuuaagcacuuaaacccucaaauauaaggcuuccugaucaucaccaaagaagcagguaagccacggaccuuuauccucccuucucucaugagguacucguuuccccaagcagauuacacuuccaacagcacucgaaucaaugcaagaaucccgcaggguaaaguaacccacaguuugugauucuaugcagucggugagcaacaucuuagcaaaccugaaaaggggaaguguuugcuuccccagggguaaauuaugcuuaagagcgguaaacauaaucuauuauuuccagcuaaaacagaauggaagagaccacccagcaaguucuauagucuuguguucuugccuguuuugagcuagaccccacucggcgcuacuacccaggcccagagcaguucaccuugaaacucuguguugucaaggccccugauggccuccacugcauccucugcccgcuccauguguacgaaggcauaaucuuucacgaugucacauucgaugaccggaccauacuccucaaacuuggcucgaagcucuugguugguacaaguggggcugauguuacccacguguaacuugguugaagcuuugcucuuauucuugcuggcuuccacguugauguucaccccaugaagcuuguaauggugcagguugcguauggcauccucagcugccgucuugucuucuaugugcacaaagccguaauucuuaaugaugucacauuccagcaccuucccauacugcucgaagagugagcgaaucuccugcucuguagccucccggggaagguuuccgaugaacagcuucaccauccugacaagagccugggagagaaacacaagacuucaaaagucagggguguggugggaaauuucggugcacugcagcauuuucgucuaauccuccaaaguucuugcaccuucaagacccucguacagacauucauuauucuuccucaauagaagaagggcgguuuguucucgagaagugcgagcuaugcgugacaugcaaacaggaggucgagggucagcaugcauagcccagucuaucaucuccgugaaguggagcgcaaugaaauaccagaauuagcugcuucaugucuuaaaaugagggaagagaaaagcccaagcaaaggcaaggggcaucaaucgcagugcgccugguaacaagguuuuggagggaaaucuguguaccucuccugcgcgcacuagcgccuuucaagauacucuaaaaagaaaaaaguccccuuucccccaaaccggggaccaaccaccucgcccccagcggcccacccuccagcuucuucgccccaacaaagacucgacccgaccccugccccgccuccuuccggagacccggccccgccuccucccguugucuucccagaccucccgcugcaaaaugagaaacccaaauccgggccgugcagucugccggaggcccggcccgacccgcccccgagcuccccacaucacacacacacgacccccucgcaccuccggguggcggcagcgacggcggcucccacgucagagagaaccuuacaaaauggcgacggccgcucgagccuggacgcgaccgggcccuuucucgcgcgccagcucacgcacgcgcgagugcgcgcugcuucccuccccuuccccucgcgggagccgagugaccaaucccgaggcugcauacaaaugaccacgcagcacg

SEQ ID NO: 18652 - RNA, 5041 nt, Homo sapiens
ggccagaguaguuauaaccuggaucuguaacccuacccaccucuuuucucccucccucccuguggugccccaucccaggauggcccuacaugcggcgcugguagccagagugcaucugagccgcccgcagguaaucauuauaggagcccgaauagcgugcguaaucggaaugggcaucgggcaggcgacgguaauccagcgaggacuuugucggcgagcggcggaacgaaagcugcgacucugauaaacggcgguaaucagagagcucggcuaaacgccggucggaaccauaccuagucgagagaagaagacaguuggugaaugagacaauugaggggaggacuccaggugggcauuggggagaugccaauggggacagggagggugugaucacaguggucuccaagagauuggucuccuuuugucagaaggcucaucacccuauccaggccaaaaaaaucaagccuggcuucaacucagugggaaaucaaacccuccacugaaguccuccccucugaacuagccaagguggauuuuggucuacauucccacaccacagcaaacuaucuccgccccugggcccugcagagaaagaccuugguuguuuaucaacagaacggcggaugaaagcgagguccccaacuucccagaguggacgcaccucguaaacuugccuuuagccagugaaugccaaagggacuacucuuuaacccacaucccugccaaagccaggacaaccacguaauaggcuuaaggauccuugagacagugggaaaggauaugggccacaguccugcaggcaguagcuccaaugacacuugggcuagccuagacaggugacacugugccuggccugacuagcagguaccaccccaggcugagcacuaugcuccaccugaacccuggugaccaggaaaguucauagacacugcuccccucggccucuggacaucccacaaaaauagagaagagaagaccgagggaggggccgaugccuccaguuucccucccaugccaaccucagccccuugcccuaagccccagcugggggcagaggcgggggggcauacaguaccuuuucgacauggcgacagccuuuuuguagggaucgucguagcuggcccgggguggggagaggcggguacgcucauagggcggcggggugcuguuggcguuggcaacggcccccugggacauggacagguaggcugcagacggcugaccugccccaucguaggcauugccuggcuggccgcgguaggaggcagcagccuggggaugcugcugggcagcauaggaagcagccaaugaggcugaugacugagugcgguaaggagcugccaggguggcagaagguugggccccguaggcugcugcggcaccauaggagccaguggccgcagcagccgacugagccccauaggagccugaaaggcccauugaugcuugggccccguaacuauucagcugggucugcacaaccggcugggccccauaggagccagccauugggguaguggcuugugcggcguaggcugcuggcuggcuggcauaggcagcagcuguggcuggcugugccacauaggcagcagguugggaagaguaggaagcagccugcugugcagcauauggggcagacugggcauuguaagaggccgagggcugggcauuauaugaagcugccugggcuccauaagcuagugaggaggcugcagacugggccccauaggaggcugccugagccccguaggagccuaaggaggaagcugcucccuggguguuguaggaagaagcagcugcacgaaccccauaggaagaggcagccugggcgccguaagaggauggcugguuaccauaggaggcaagggaggaacccugagccccauaggaguugagcgaagaagcugcagcugccugacccccauaggaggaaagggccgaggcugagggcugggcuccaccauaugggccgagugaagaagcugcagcagacugggagcuaggacuagccagcuggccccuguauggugccccaagggagacagagggcugagcgcgguaagaggcugccugggcugucaugggcugaguccgauagccaacacccaaagaggcagaaggcugggcccuguaggcagcucccagugacacggacggcugggcccgguagguagcuggcugggccgucagaggagccacauaagaggcucggggaggugaacggcgcagagggcugcggucgcgaccaaagaaggguggugugggcugacgggcuugcccaucaaagccaccagugcuguugccaaaagccugcugguagucgaagguggcagagaagccaccaguuccagggaaggccguauccccagccccugguuucuuggucuuguccccagacuggacagccaggccaggccccuucuucugacccuugguggagaguuccacguugaugcgcuugcccuucacuucuuugccguugagcugcgcgauugcggcuuuggcaucugcuuccuucuccaugugaacaaacgcguagucugauaaagcagcagacagaggguuagcaauuaggggggcagggcaugcuaccugaugggucccaaauuggacacacaacagcacccagcuguugccagcuaccuccaaggccuccaaacccuccucuccaggaguaugucauaaaauguagcucccauauaacaaagcuucugacugucccaagcagucaucuuugccuacagccuucuucccauucuccccuuuacaaacccugccaucucacccaacuuccuggugagagaagaaggagcaaagaugaacugcaacacaggauaaaaaucuucacaucuccuguaaguacaaaccagcagaacaaaaugcagaaagcguuccuagaucacucaguucuucaguguucucaacccaaacucaccaaacaccuuugaggccuagcucacuuuugaggccuaacucucaaacacuggaaaugaccacucacguuuugguaugacccaucucucagcccauguccaauuaaggcaagagagauagacugcaacaagcaagcaguucacaacauuccaauaugaucucuccgcuuuuucacaguacuucccaaguuuucaaagcacucuuagguacaggaggaccucauuugggccucacaauccugugagguaggcagggcaaagaaucauuaccuccauuuaacagguggacauacaugcucaagaguuuuuauauggcuugccccacucaaaguguguuagagucaggaccagaaucacagcucuuccaaugccccuuugcuacauaaucuaucccugagaagucaagguauaaggcaggacuguguaauaugacuaaaaauuuaggcuuagaagcagagaagauggacccuguguaagccaaugagguaugggaauagaaacuaagcccacuggcugaguucaugcccaaucccccugucccagaccacacugcauccuccacuguuuccucuuuaagggacagagguauaccuuacaccuugggcuucuguucacagagcagacugcuuaccagaaagaucugguuucucaccuauaagguaugaagcugcaauuacugcagcuaacaggcucugcuaaccagguuaccccugcagcucucauuaugaccugaauaagcugugguaggagaagacaggaugccggucucaaagcuauacuuaucuacuacacagaaggagaaaacuucagggaaugaaggaauggaaagaaauucucauguccacacucacaaagcacaggcagaaucugaaggagagaauccugccccuaggaaauaaggcucuaagcuuagcuccauucucgaccuguggcuacucuuagauagcauccaaguaccaggaugcuaucugucacaucagcuuaagaaacaaagagcuacccagaugacaauacuaagauaagaaacauucuuaauaaccuccaaacaaggguccucauuuuuagaaacuuucguacugggaugccuuaucuagcugcuccuacagaacaagucauuucccuggauuugaagacaaugacacaagacuaaggauaauggggaaaaaaugcaaucaauaaguagaagucagaaguguggcauagcacaaaagggauccuuaauuagaaauucaauggucucaguuccagacccagguaucacugacuuguuauaagaucuuaggaaacuuaccauuuaggcagguacaggggcucaugccagggcuuugggaggccaaggcaggcagaucaccugagaucaggaguucaagaucagccugaccaacauggugaaacccugucucuacuaaaaauacaaaaauuagcuaggugugguggugcacaccuauaauuccagcuacucaggaggcucuggggcaggagaaucacuugaaccugggagguggaaguugcagugagccgaaauggcaccaccguacuccagucugggugacacagcaagacuccauuucaaaaaaaaaaaaaaagaaaaaaagaaaagaaacuagccaagcacgguggcucacgcauguaaucccaacacuuuaggaagcccagguggguggaucaccugaggucaggaauuccagaccagccuggccaacauggugaaaccacgucucuacuaaaaauacaaaaauuaccagggcgugguggcuggcaccuguaaucccagcuacuccagaggcugagggaggagaaucacuugaacccggaagaaaaagaaggaggcugcagugagccaagaucacugcacuccagccugggugacaagcgcaaaacuccgucucaaaaaaaauaaaaagaaacuuaccauguauuuccuccgacacaucuauccuaccuaccucaaaguuaagagguucaagagaaaagacaaaagugccuuguaagauaugaacagcuacagaauaaggaauuaugauuauucaaaccuagaaauaaccagagauuuauuucccuauagaauauuaucuuucaucucaagcaaaacacaaugccaugcaaac

SEQ ID NO: 18653 - RNA, 5041 nt, Homo sapiens
guuugcauggcauuguguuuugcuugagaugaaagauaauauucuauagggaaauaaaucucugguuauuucuagguuugaauaaucauaauuccuuauucuguagcuguucauaucuuacaaggcacuuuugucuuuucucuugaaccucuuaacuuugagguagguaggauagaugugucggaggaaauacaugguaaguuucuuuuuauuuuuuuugagacggaguuuugcgcuugucacccaggcuggagugcagugaucuuggcucacugcagccuccuucuuuuucuuccggguucaagugauucuccucccucagccucuggaguagcugggauuacaggugccagccaccacgcccugguaauuuuuguauuuuuaguagagacgugguuucaccauguuggccaggcuggucuggaauuccugaccucaggugauccacccaccugggcuuccuaaaguguugggauuacaugcgugagccaccgugcuuggcuaguuucuuuucuuuuuuucuuuuuuuuuuuuuuugaaauggagucuugcugugucacccagacuggaguacgguggugccauuucggcucacugcaacuuccaccucccagguucaagugauucuccugccccagagccuccugaguagcuggaauuauaggugugcaccaccacaccuagcuaauuuuuguauuuuuaguagagacaggguuucaccauguuggucaggcugaucuugaacuccugaucucaggugaucugccugccuuggccucccaaagcccuggcaugagccccuguaccugccuaaaugguaaguuuccuaagaucuuauaacaagucagugauaccugggucuggaacugagaccauugaauuucuaauuaaggaucccuuuugugcuaugccacacuucugacuucuacuuauugauugcauuuuuuccccauuauccuuagucuugugucauugucuucaaauccagggaaaugacuuguucuguaggagcagcuagauaaggcaucccaguacgaaaguuucuaaaaaugaggacccuuguuuggagguuauuaagaauguuucuuaucuuaguauugucaucuggguagcucuuuguuucuuaagcugaugugacagauagcauccugguacuuggaugcuaucuaagaguagccacaggucgagaauggagcuaagcuuagagccuuauuuccuaggggcaggauucucuccuucagauucugccugugcuuugugaguguggacaugagaauuucuuuccauuccuucauucccugaaguuuucuccuucuguguaguagauaaguauagcuuugagaccggcauccugucuucuccuaccacagcuuauucaggucauaaugagagcugcagggguaaccugguuagcagagccuguuagcugcaguaauugcagcuucauaccuuauaggugagaaaccagaucuuucugguaagcagucugcucugugaacagaagcccaagguguaagguauaccucugucccuuaaagaggaaacaguggaggaugcaguguggucugggacagggggauugggcaugaacucagccagugggcuuaguuucuauucccauaccucauuggcuuacacaggguccaucuucucugcuucuaagccuaaauuuuuagucauauuacacaguccugccuuauaccuugacuucucagggauagauuauguagcaaaggggcauuggaagagcugugauucugguccugacucuaacacacuuugaguggggcaagccauauaaaaacucuugagcauguauguccaccuguuaaauggagguaaugauucuuugcccugccuaccucacaggauugugaggcccaaaugagguccuccuguaccuaagagugcuuugaaaacuugggaaguacugugaaaaagcggagagaucauauuggaauguugugaacugcuugcuuguugcagucuaucucucuugccuuaauuggacaugggcugagagaugggucauaccaaaacgugaguggucauuuccaguguuugagaguuaggccucaaaagugagcuaggccucaaagguguuuggugaguuuggguugagaacacugaagaacugagugaucuaggaacgcuuucugcauuuuguucugcugguuuguacuuacaggagaugugaagauuuuuauccuguguugcaguucaucuuugcuccuucuucucucaccaggaaguugggugagauggcaggguuuguaaaggggagaaugggaagaaggcuguaggcaaagaugacugcuugggacagucagaagcuuuguuauaugggagcuacauuuuaugacauacuccuggagaggaggguuuggaggccuuggagguagcuggcaacagcugggugcuguuguguguccaauuugggacccaucagguagcaugcccugccccccuaauugcuaacccucugucugcugcuuuaucagacuacgcguuuguucacauggagaaggaagcagaugccaaagccgcaaucgcgcagcucaacggcaaagaagugaagggcaagcgcaucaacguggaacucuccaccaagggucagaagaaggggccuggccuggcuguccagucuggggacaagaccaagaaaccaggggcuggggauacggccuucccuggaacugguggcuucucugccaccuucgacuaccagcaggcuuuuggcaacagcacugguggcuuugaugggcaagcccgucagcccacaccacccuucuuuggucgcgaccgcagcccucugcgccguucaccuccccgagccucuuauguggcuccucugacggcccagccagcuaccuaccgggcccagccguccgugucacugggagcugccuacagggcccagccuucugccucuuuggguguuggcuaucggacucagcccaugacagcccaggcagccucuuaccgcgcucagcccucugucucccuuggggcaccauacaggggccagcuggcuaguccuagcucccagucugcugcagcuucuucacucggcccauaugguggagcccagcccucagccucggcccuuuccuccuaugggggucaggcagcugcagcuucuucgcucaacuccuauggggcucaggguuccucccuugccuccuaugguaaccagccauccucuuacggcgcccaggcugccucuuccuaugggguucgugcagcugcuucuuccuacaacacccagggagcagcuuccuccuuaggcuccuacggggcucaggcagccuccuauggggcccagucugcagccuccucacuagcuuauggagcccaggcagcuucauauaaugcccagcccucggccucuuacaaugcccagucugccccauaugcugcacagcaggcugcuuccuacucuucccaaccugcugccuauguggcacagccagccacagcugcugccuaugccagccagccagcagccuacgccgcacaagccacuaccccaauggcuggcuccuauggggcccagccgguugugcagacccagcugaauaguuacggggcccaagcaucaaugggccuuucaggcuccuauggggcucagucggcugcugcggccacuggcuccuauggugccgcagcagccuacggggcccaaccuucugccacccuggcagcuccuuaccgcacucagucaucagccucauuggcugcuuccuaugcugcccagcagcauccccaggcugcugccuccuaccgcggccagccaggcaaugccuacgauggggcaggucagccgucugcagccuaccuguccaugucccagggggccguugccaacgccaacagcaccccgccgcccuaugagcguacccgccucuccccaccccgggccagcuacgacgaucccuacaaaaaggcugucgccaugucgaaaagguacuguaugcccccccgccucugcccccagcuggggcuuagggcaaggggcugagguuggcaugggagggaaacuggaggcaucggccccucccucggucuucucuucucuauuuuugugggauguccagaggccgaggggagcagugucuaugaacuuuccuggucaccaggguucagguggagcauagugcucagccuggggugguaccugcuagucaggccaggcacagugucaccugucuaggcuagcccaagugucauuggagcuacugccugcaggacuguggcccauauccuuucccacugucucaaggauccuuaagccuauuacgugguuguccuggcuuuggcagggauguggguuaaagaguagucccuuuggcauucacuggcuaaaggcaaguuuacgaggugcguccacucugggaaguuggggaccucgcuuucauccgccguucuguugauaaacaaccaaggucuuucucugcagggcccaggggcggagauaguuugcuguggugugggaauguagaccaaaauccaccuuggcuaguucagaggggaggacuucaguggaggguuugauuucccacugaguugaagccaggcuugauuuuuuuggccuggauagggugaugagccuucugacaaaaggagaccaaucucuuggagaccacugugaucacacccucccuguccccauuggcaucuccccaaugcccaccuggaguccuccccucaauugucucauucaccaacugucuucuucucucgacuagguaugguuccgaccggcguuuagccgagcucucugauuaccgccguuuaucagagucgcagcuuucguuccgccgcucgccgacaaaguccucgcuggauuaccgucgccugcccgaugcccauuccgauuacgcacgcuauucgggcuccuauaaugauuaccugcgggcggcucagaugcacucuggcuaccagcgccgcauguagggccauccugggauggggcaccacagggagggagggagaaaagagguggguaggguuacagauccagguuauaacuacucuggcc

SEQ ID NO: 18654 - RNA, 5154 nt, Homo sapiens
ccagcgcccauuggucggcgugccgucgccccgcuggagggaggacucaggccccgcuggccgcgggcucgguacccggugggucgguggagcgucuguuggguccgggccgccggcuucgcccucgccauggcgcccuggcugcagcuccugucgcugcuggggcugcucccgggcgcaguggccgcccccgcccagccccgagccgccagcuuucaggccugggggccgccguccccggagcugcuggcgcccacccgcuucgcgcuggagauguucaaccgcggccgggcugcggggacgcgggccgugcugggccuugugcgcggccgcguccgccgggugaggacgcgccgggggcgggggcgccaggcccggguccaagggauaggagcuuugaccuaacauugggauggggccugcccgcuggacgaaccgaucucuggugauggggaaugggcagcgccgcacgggcggggccuugggcgccgucaagggccgacugugcccgccucaccuacuccucucuccaggcgggucaggggucgcuguacucccuggaggccacccuggaggagccacccugcaacgaccccauggugugccggcuccccguguccaagaaaacccuggugagugaugaggcucuugggguuccccgccccgaggccgaguaaagcagcaguuggaugaugacgggucaggucaagacgcagggaucugagguagcugcugccccaccuugagccacuucccaggccccgagggcuggaaaccaagaugcuaugaaggggaggaugccccggugcaggccgugccucacuguccacugugauggggugauugccuuagggguggcucucaucugaggagccuccagcuccaucuuggccagaucuugcuccccagauccagauccaggcccccagagcagcuucuuccucucccuccagcucugcagcuuccaaguccuggaugagcucggaagacacgugcugcugcggaaggacuguggcccaguggacaccaagguuccaggugcuggggagcccaagucagccuucacucagggcucagccaugauuucuucucugucccaaaaccauccagacaacagaaacgagacuuucagcucagucauuucccuguugaaugaggauccccugucccaggugaggagcccucagcuugaggagcccucagcuugaggagccagccgcugccucaucacccuucucccuucccucuggaguggguuucucuggucagccuaaagacuggucugccuauccaggacuugccugugaagauggcuucaaucuucaagaacuuugucauuaccuauaaccggacauaugagucaaaggaaggugaggacccagccuuggcuguaccuguuccuaucagaacaggacuuuccccccaacuuggcaccuuggugugugggaggagaaagacaagaggcaguguaccuguucaaggaccccauaauuccugagcucucccuaagccuucccagccuggcagccacccugaguaccuggccccuucuccuaccuuaucuucccgcucagaagccaugggucuuggccgggcgugguggcucaccucuguaaucgcaguacuuugggaggccgaggugggcagauuaccugaggucaggaguucaagaccagccuggccaacauggugaaaccccaucucuacuaaaaaaaaaguacaaaaauuagccaggugugguggcgcacaccuguauaccagcuacucgggaggcugaggcaggaaaaucacuugaaccugggaggcggagguugcagugagcaaagauugugccacugcacuccagcaugggugacaagcgaaaacucugucucaaaaaaaaaaaaaagaagcucugcaucuccaucacucuggcagggugggauggggcagaggcuggauuuuuugugcuggagaguccuugacaacauggccuuuccccaccaccucuugugggugguguccuuuagaccccauuuacugcuuuugcaccugggaagucaucacuucaguuuggcccuaaaaguugaucagaccucccacuccaucacuugcaugucuggcccccaccccuaccugcuccccggggaaaccccugccugcuagccccaauugcccuuccuuuuaucugccuggggucgaaccccuccucuucugcuccuugguccucagaagcccgguggcgccuguccgucuuugucaauaacauggugcgagcacagaagauccaggcccuggaccguggcacagcucaguauggagucaccaaguucagugaucucacagguagggauaguggccacaguccucauggauccaggaagagacaggaccuugcucgcaaggccucuggucaggucuggcuuagaacacucuuccuccccaugcccugcccaccuuugcccgcagaggaggaguuccgcacuaucuaccugaauacucuccugaggaaagagccuggcaacaagaugaagcaagccaagucugugggugaccucgccccaccugaaugggacuggaggaguaagggggcugucacaaaagucaaagaccagguuggaccccuggaagugagggugggacaugggcacugcacuggggcugacgaaggggcccggcucugacuccaacuccacccaucucuuguagggcauguguggcuccugcugggccuucucagucacaggcaauguggagggccagugguuucucaaccaggggacccugcucucccucucugaacagggugagcaucucgcucuacuccucuguccccagccuagccccucaggagggcuucuugggaccagccuucugucuccuagagcucuuggacugugacaagauggacaaggccugcaugggcggcuugcccuccaaugccuacucggccauaaagaauuuggguaugcauuaauggggucaggaggggcaaccggagccacuucucccuguacaagaaguuacuucauaaugggggggagacaugagcaugagaguuacacagaacuggguccaggucuuaaugcugacccagccaggcgugguggcucaugccuguaauuccaacacuuugggaggccaacuugggaagaucacuuaaggccagaaguucaggaccagguugggcaacauagcaagaccccaucucuacaaaaaauuaaagacauuagccaggcaugguggcuugcaucuguagucucagcuacuuggggggcugaggcaggaggaucgcuugagcccaggagguugaggcuguagugaggcauguuugugccacuguacuccagccugggugaaagacugcugggaugagcucuuggugaggagucagaaguuggaguugaguucugucucugccacuuuucuugcuggcuacuggucccuccuccccaucucucccagccucagaugugucauuucuagaaugaagacauucuucagaggggauggccuguggccugggguggacgaggaaugugaaaccucgcguagagggcuuaguucauuucuggcugugaauggcaaaugggagccugcccuucucuacucacccccaccguuccccaggagggcuggagacagaggaugacuacagcuaccagggucacaugcaguccugcaacuucucagcagagaaggccaaggucuacaucaaugacuccguggagcugagccagaacgagcagagugagugaggggcagggugaggugaggucagguggggccggggccugggugccuacugaugccaccccuucccaucucagagcuggcagccuggcuggccaagagaggcccaaucuccguggccaucaaugccuuuggcaugcaggugaggcccuagccccacugccccugccccaucucuuguugaccuccccgaccucuucuuggagucgauccccuacuccuucuccaccuccaguuuuaccgccacgggaucucccgcccucuccggccccucugcagcccuuggcucauugaccaugcgguguugcuugugggcuacggcaaccgugaguuccgcugccuguccugcauccagccaggccacaggcaggggugggaucacagcaucucagguccucuagaggggaaauagggggaaugccuaggaacccuguccuuacccacugccugggccaugaccagcugggcaucaucuguccucucuauggcagggaagcugagcugugggaggguaaauauugauggccuaauaaccugcaauaggcgggugggugcgugcuuccucccugccccagggcuucucccugaggcugguaggugggccccucgcuuucugcucuuuuccuagucccugucacacaguaggcccagugcaaguauuugaagggugcaaagugauuaaggcucugccuggagaauuaaggacccugauccuugcgcucugcacugcaccccaggcucugacguucccuuuugggccaucaagaacagcuggggcacugacuggggugagaaggugagucuugcuggcuuggccccuggcccuccagccgccauccuacccuggugcccucaccagcucccccucucccccaggguuacuacuacuugcaucguggguccggggccuguggcgugaacaccauggccagcucggcggugguggacugaagaggggcccccagcucgggaccuggugcugaucagaguggcugcugccccagccugacauguguccaggccccuccccgggagguacagcuggcagagggaaaggcacuggguaccucagggugagcagagggcacugggcuggggcacagccccugcuucccugcaccccauucccacccugaaguucugcaccugcaccuuuguugaauugugguagcuuaggaggaugucggggugaagggugguaucuuggcaguugaagcuggggcaagaacucugggcuuggguaaugagcaggaagaaaauuuucugaucuuaagcccagcucuguucugcccccgcuuuccucuguuugauacuauaaauuuucugguucccuuggauuuagggauagugucccucuccauguccaggaaacuuguaaccacccuuuucuaacagcaauaaagagguguccuugucccgagu

SEQ ID NO: 18655 - RNA, 16455 nt, Homo sapiens
aaggagauggggagagacccagagagggaucuuuauucagaagcacuuggcuggcuuuucucuuaggcccuugcuccgagggacggaugggaucagccacagggugcauccucucuccaucuugcauagagaaccucagugguuggggucaaaggucgcucuccccauagagggcacuggagaaggccacguaguccagggcuccagccggggccccggaucccuuguagggcaccauacggcggaugcaguacucggccugcuuggcagggagcucgcgccgcagcuccucgggggugauguaguucuggggagaagaggcguugaggacccacaggucccgugcccugcccuagcccaccagccccuccaccgccugggacucaccuugucuccugccaagaucuugaaggaagcuacaacuugcucagucgugucagucucggcugucucucgggucaugaagucuaugaaggccuggaaggucaccaccccagcugcguugggguccaccauggucaugaugcgagcaaacuccacuucccccugcagggauagaggccaggcacuaugcccaugagcacuaaagccaggagggcucccaguguccccuccuggggacuguccaaccucagcuagcagagccccaguaacaagggaguucccuuccuccagagaccuuagcccuggcuguaggaaguccuuuaugguaggcugaaaucugcauccuacccacagcaggaagcagauuugcucccugguccugauuuuuuuuccagggccacacccguuucuguagugcuguuucccuacagguaaaaauguugcaagcucagacuuuggguccacacagaacuggguccaagugaguuuuaccucccugagccuugcuagccccuguguggauguagugaagaugcaggggaugguguaugugaagaugggaggugcacaguaggugaucagcacagaggaggggguacuuugggacuccugggaaggagcuggggagcucucaccaggucauagcccauggagaugaggcaagcucggaagucaucaggcuccaucaucccauucugcuucuguagggggugagugguuaucaggcuuggucuccagccuccaccagcccccaagugucuuaccccacagggccaggccccugcugacccugucaaagugguugaaggaugcucggaacucguugagcugcuccuggcucagucccuuggcgucucgggucaguaccugguucuccacuucauugauggugcgggcaauggaggugagcagcugcucccagcccacgcggaugugcuggcggucaggggacaggccacugucagugggcggccagugccuggccacuggcucuagcuccacauccaguucacugaaugacccugggcaaguccucccccucacugggccuccauccccaucuggaggcuccacugaguaacccacccccaccccagcaguccuuccugucuuuugauaaccagcuauggccaaucuuggccugguuuuggacggcuuugugacucuggaagggucacuuuccaucgcugggucuuaagggaccuggccaagcugaacuggggacucugcugggacacacaugcucuguccagcugugaucucccugggccuccucagccagugcugccuccccacucuccugagagggugugaucccaccuccaugcuguagacggugugcuuauugucgaacaccaggcucuccugcagcagcugguggucacccuccagccggucaauguuagucuuguaguugauaauguucugcuccugcugccguagcccagccaucugcuccuccagagagccagcuagcccugcugccagccgccccacuuccugcagggguucccaggcagcaugagggcucccaacucccuguggcccagcccuggccccauccccccagguuggacccacuaucccagcccuuaccuccaccuucgccuggauccaggguccaauggcauuggccugggccgcaaacugucgccggagccucucguuuaccugcugccgugccagcuccuccugcagugucuggucacagcugggcaccagcuuucggaccugggaggagggcaguuaugccagagccagcucugggggcugggaaauggcuuuaggggagaugggcuccagccccucaaaccucagccccuguugcuuugagccaacuugucugggauauacgagaaagcucuugggcaagucacuaacccaugugggcuucaguuuucucaucugcaaaauggggcugauggcaucauuuacuaauauggguggauuuauaaaagauguccacacacaaggcuuaauucuacuucacaucaguccugacaggagaaugcugcuguuacagcucaucauauacagaugagcccgagacaggcaaggcgauuuauccaaucccacguggagucuguggcagaccccacaucugaagauggacuuuauucuccauaucuugggccacccgagauuucaggguggucacaguaugcaggagggggugggaggaaggcugcagguggcacugaccauaucccacuugguguugauguccugcgggcugagggugauguagggauugguggagcagggccgcagcccauacgucuggcagaucuucuggaucucacccuggaugcccaugauggcaccucgcucucagucagccucgggcaguguugccuugaacugaucgugcgcugucagcaggcucuggggacgacaggcaggaagugucagcuggugucccccacuuaccacaggcaacagaaagggcagcagugugccccaggccacccaccaguccugggcaguccugacacaagaaccccggccuccugucuuccagcccagcacucgggaacugggguuuuccucccaucccuaugccccaggagccuaaaguuguggguggcagaauuuggggccagcuuuccugucauccuauccauccccugcaacccuggcacccaccugggucuccuccacagaguguaccagccacacguccugcagguccuccacggcaccauccagccaguuguugaagggcgcggcccgccgggcaaacuccaguugcagccggucaauggucuccaggagcuucuccauccgcuagaggugggaggcguagugggucagaagccugcccugcagaccuggccucacccaccuacccaccccccagcuccccggcccccagccccaccucuagcgcaucccgccucuucugggucagggugcccagguugucccacugaucgcagauggccuggcagcggcuauucacugaggcugccucgugguaguccagcucacugggagcgagaaguagggcgaguguggggccagccccagcccagauguccuaacugcacucccagggcuggaaccugcuccccggaugggggugaaggcgugcgggagccagggcaggugguggguaaagcugggugcuuuccaagaggggcgguaccagcgcaucccucugggcaggugggcgcccgcggguccuuagcugcaguccauggaggugcuuggguggaggggcgggguugcgcaagaaggggcggguucaugggaggggguggccaggccaaggcugauggggaggguuuggagcaguaagccgggugaagagagcgggcagguuagagggcaggucacggagugagacaggucaagcgccagugggaagagugugagcagcagagcgggguccggaggugggggugggguuccaggaggggcggagcgaaugggaccuggguaccacggcgggguuacagaacccaggagagccuagugucuugagaagggcaauggggaucaggguggggcucgccaccgggggcggggccggggguguugggggcgggccccgcgaggccccgccuacuugagcuccugggccagcgcggcaaugugcuccacgcgguccuggugcgccgccaggucgcucucaaaggccucguggcgccgcagcaacgcccgcaccuccuguagcaaagccgaaucguagucgcgcuggcucagcaucuccuccuuuccugcucaaagagaugccggcuccggucacccaguggcggcaggggcaggggugcgcggcgggcugcgugaccaugaagccucaucugcuaagguggcgaucgcaccggccuagcucguccuagggauuugcucugcggcgucgguguaauaacguaggugaaaguccucuuccguggcgugauccgcaaaugacaucagcguccccugagcgagcuacguccagggggcccuugguacaguuuuagcauaauuugaccuuaaaauagcucucaacgauucuguaacccccaugagccccugacccggccuccuuuguucacuacagaaauccucgacagaacaaugaauggauguuucuauccagaguaauauauuugacucgugcaauauuuuagcgucaguauacuuugaguaugacauaagugauguuagggugaggaauggacucaccuuugaacaccugacacauauaaaauaaaaugcuaaauugaauuaaucagagcagaucuacagaagaccagagcagggcuggggggugagggggaaggcugaguuuauagaaaacaggcgggugugcgguggcucauuccuguaaucccagcacuuugggaggcugagguggguggaucacucgaguccaggaguuugagaccagccugggcaacaaagugagaacccaucucuacaaaaaguacaaaaaguuacugggcgugguggugcacgccuguggucccagcuacuuggguggcugaggcaggaggaucgcuugagccugggaggcagagauuguagugagccgagauuguacuagccugggcaauagagcaagacucugucucaaaaaacaaaacaaacugugguccacagaggggcaguggccaaaagagaggccuagguugcaccacagcaagucagggugggacuagaaauccagucucuggcuuuccugcagagcaccuacccuuguccugugcauuuugccaagaaccuccccuccugccccugcacaccaaucuccaccccaagagacaguccagccccaugagguaggucuaccuaccccggguccaggcuucgugcagggaggccuucugccggaacuucucagccaggugcuggagucgcugcaggcgccggaucuccgagagcagccaguccucauagcccuuuuccaccugcuccagcccccgccaggcguuggcgauguccuguggagcaggcaggggugcgcuccaucacgguuugcccauuguacagaugggauacggaccucaaggucaccuagggaauguguguagagcucaccgagaccagcuugcccucggagggcaugaaggcaggccgguggcugagccgcaacuuggucugcaguguguugaaguugaucuccagcuggcacuuuuccugaaugcggggcggcuugugcagacgccgguagucccgaaaguccucuaguuugcgcugcauggcacucaugcugggcucacccacacgguucuccagccaugggacagugcggcggauccacuccagcagcugacagggccaggcaggggcaaggcagacagcucugcgcugaccugcccagcucacccaccccucuccacccacacccaggcuguggccagaguguaggugggggugacuuugacaacuacgaaagcaggaugggguaguccccacaagucagagaagaagugggaugguugauuucugaguccaggggcuaguauagguuggcacagagcagagggccaugugacuacuuaaauacaagugaauggaucgaugcagaaguaaauggaugaaugaugagugaaucaaugacugacaggagcauggguuggcagaagggcaggugauggguggggauggacaggaggaggcugggaggaagccagggcuacucugagcagagggaggcucugcaggcccacgcuugggguuagcaggguugggagagccaguagggcugggguggggagagcacggugggagcccagccucaccucacuggcaagcuucucauacuccuccaucagcuucucguuuuccugguucacugccagcaccuugcagauccuguuggcagcugucucugccuguggggggagugggcagaaggcuggcauuaaagcaaauugcuucuguaaagcccuuaaaacccagagccccgccgagcgcgguggcucacgccuguaaucccagcaguuugggaggccgaggcgggcggaucacgaggucaggagaucgaaaccauccuagcuaacacggugaaaccccgucucuacuaaaaauacaaaaaaauuggccgggcgugguggugggcgccuguagucucagcuaccugggaggcugaggcaggagaauggcgugagccuggcaggcagagcuggcagugagccgagaccgccccacugcacuccagccugggcgacagagcaagacuccgucucaaaaaacaaaacaaaacacaaacaaacaaaaacagagcccccagcugggcgugguggcucaugccuguaaucccaacaguuugggaggcugaggugggugaguuacuugaguccaggaguucgagaccagccugggcaacaugaugaaacacuaucucuacaaaaaauacaaaaauuagucaggugugguagcacgugccuguagucccagcuacuggggaggcugaggcaggaggcugaggucaaggcagcaaugagccgugaucacgccacuucacuccagccuggaugacagagugagacucugucucaaaaaacaaacaaagaauggagucccugcaaauugggaaagggauugggggagcacggcucuuagguagggagugaguuuccaaaccaggguccucugcuccugcugaagacugagugugugcagcuggcacaguggcacuccaaccuccguggucuggcgccuccaauguuggacuacagccaagguugggcccuuggguccacaagcccaggcagcagcaguugggccgccuuaccugcucagccccggcaaaggcaugguagaagcaggacacauaggucaugauggccuucucauccggcuuugggguguucacaaugucuaggggaggacagcacggugucuacuggccaaagccaggggucccuccccaggcagagaacucucucugggugggagggcuggaagcauccagucauggccaccagcagccagccacccaagcccagugucuucucuuccuugaagcccucucuccuuaccccagggcucagcaacuuccccaucuccccaccuuggggugagcaaagugugagggacugggugggugagugugagugggcagccacuguggcccucgugagggacugguccacgcugucucaugccuugaacuauccuauaccucccucggucugugugucuuucccccaaguccacaagcuccucagggcaagaaaaaguucuucuccagcagugcccacacagccugggcaucaugcauaguagaugcucagaaaguguuugcugcuucaguugacuauugccuugccuaggcauggggaccacaggcaggacgugccccaggggagcugccagucuugggggaccaacaucccagguaacccagguaacugggaugugaggcagaagguagggccauuacauaggggagagguggcagaggaugguccucuuugggggauggggcaugggacaagauagaggacuccuggagaagggggacugugaccagggagugggguggggguggucggagcaucccaggaggaggaaagggccgugcaaagguguggagguuguaccaggcccaguguggagaauguggggucuuccccugggcuagcucacucucaccuucugcauccaacaucuuggggauguccagguauuucucugccaccucaaaggcaguguucagguuuccgauggggucauccuagaaggguguaagggaggagggugaaaggucagcugcaggcagaggccuugggcugggguggugggggccucuaccuuucgcaguuuggcguagucgaugaggucagggcggugucgguggaugagggcacagagggccaggccauccuuccagcuggacagagagaagaggggggucaggccuggguucaagcuggggccccguucuccccucggcccaggagcaccccccagaaggacagccucaucuguaaaauggaguaaaguacaaaucccuuagcuuggcguuugaggcccuucaugaccagaucuggaccaucuccugcuagcucaucacgauuccgucacacacucaugcuuaggcccgaccaguuucuaaauauuuuuggccuccagcuucccucuggcuggaauggccuuccagggaagucucaaacacucccuccuccaggaguuacuggaacccuccuggauucaauuccauuccacucaacaguuacugagcccucuuuucagacacuguuccaggaacugugaccuuuccuucccuguggcuugugacagagaccagcucagugcccuucacugaccagggagggcuccucucuaugcccaguaccccacagaggcccagacacauuugguaaccaccugacagaccugguguggaaguucugcacguugacguugcgguacggugcugucuuccucuggcaccacagaagcaagccuuccuuggcugagguuucugggucggggggaggugggaggauucauugggaagggguccaggucagcccucucacacuucuuuuuuuuuuuuuuuugagacagggucuugcuaugucauccaacuggagugcagugacacgaucauggcucaccgcagccucaaccucccaggcucaagcgauccuccuaccucagccucccuaguaucugggacuauaggcacaugccaccauggccagcuuuuuuuuuuuuuuuuuuuuugguauuuuuuguagagaugggguuucaccauguuguccaggcuggucuugaacuccugggcgauccuucaaguggucugcccgccucgaccucccaaacuguggggauuacaggccccagccacugcaccuggccccaaccuccuuucccauugcucaccuuccacagagauguccuggauggcgaagcgaaggaugaugguccagaucaugcccagggucaucuucagguucccgucaacaaucucugcagggcaggggucaggggacagauuugccuggcauucaaggucugugcuaucuggccucagcuuaccuuccccucugaucagcccucuggcccuugucucccauuucagggcuggcaccuaguaggugagcaccuagcaggugcucaauaagcaucucuuuuucuuuuucuuuuuuuuuuuuuuuuuugagauggagucucgcucugucacccaggcuggagugcaguggcgcaaucuccgccucccagguucacaccauucuccugccucagccuccugaguagcugggacuacaggcgcccaccaccacgcccggcuaauuuuuuuuauuuuuaguagagaagggguuucaccaugucagccaggauggucucaaucuccugaccucaugaucugccugccucggccucccaaagugcugggauuacaagcaugagccaccgugucuggccucuuuuucuuuucuuuuuuuuuauuauaauuuuuucccauggagucucccucuuugccccggcuggaguacaguggugcaaucucagcucacugcaaccuccgccuccuggguucaagugauucuccuuccucagccucccuaauagcggggacuacaggcugcaccaccaaacccggcuaauuuuuuuguauuuuuaggagagaugggguuucaccauguuggccuggcuggucucgaacucccgaccucaaaugaucugcccaccucagccucccaaagugcugggauuacagucgugagccacugcacccagcugcaucuauuuuuuggggggugacagagucuugcucuguugcccgggcuggagugcaguggcaugaucucagcucacugcaaccucugccucccugguucaagcaauucuucugccucagccucccgaguagcugggacuacaggugcaugccaccaugcucagcugauuuuuguauuuuuaguagagauggauuucacuguauuggccaggcuggucucgaacuccugaccucaugaucugcuugccuuggccucccaaagugcugggguuacagguguaagccaucaccccuggcccgcaucuauuuuuuuguuuaguugguugguuuugggaauuuuuugagauggaguuuucucuuugugugugugugugugugugugugugugugugagagagagagagagagagagagagagagacagagucucucuugucacccaggcuggagugcaauggugcaaucuugguucacugcaaccuccgccucccagggucaagggauucuccuaccucagccucacgaguagcugggauuacaggcgugcgccaccaugcccagcaaauuuuuguguuuucaguacagacaggcuuucaccauguuggccaggauggucucaaacuccugacuucagggugauccauuugccuuggccucccaaagugcgagaauacaggggugagccacugugccuggccaagauggaguuuugcuauguugcccaggcugaucuccaauucccgggcucaaacaauccuuccgcuucagucugccaaguagcugagacuacagcgcuaccaugccuggcuuguuauuuagcaauuauuucacuaaacucuuacuaggguuugggggcugagcuggcacuuuggguauauuggcuuuucuuucuuuuuuuuuuuugagacggagucuagcucugucacccaggcuggagugcaguggcaagaucucagcucacugcaaccucggccucccggguucaagugauucucuugccuuagccuccuaaguaguugggauuacagccacgcgccgccacacccagcguauuuuuaguagagacaggguuuuaccauguuggccaggauggucuugaucuccugaccucgugagccccacaccucagccucccaaagugcugggauuacaggugugagccaccaggccuggccggcauuuuuuuuuuuucuuucagacagagucucucgcucuguugcucaggcuggagugcaguggugugaucucggcucacugcaagcuccaccucccagguucauucaauucuugugccucagccucccaaguagcugggauuacaggugugcgccaccacacccagcugauuuuuguauuuuuaguagaaauaggguuuugccauguuggccaggcuggucucaaacuccuagccucaagcaguccacuggccuuggccucccaaagugccgagauuacaggcgugagccaccgugccuggcuggcauacuggcucuuuacaggcucucuugcgaggcagggauuauucucauugcugagaugaggaaacugaggcucacagaggugauuugcugaugucaagagaggccccugugcccugcccaagacccuuccugccaccuccucaccuucagcaccaauggacaccaguuuaacccccuugcuggcaaugaaguccagggccuuguuaacguuggcgauuuuguggaagcgcaucuugccuuuaucuggccuaggcagccucucaccuggguuuaagaggagaggccaagggccaaaggucaugagaggcagcugaagcuauuguccgcaaacucuccccuccccaccaagucccguccaacacuccgccacccuauucccccugcuguccagauguuccuggguccuggggcccaggugcacugauuugccauccucaccugaaaugaccuccaggagcagcaugaguuugaggccauugcggaaaucuuccucgauguucucgaucugggugccugccuugcgcaggugugaguugcaccaggcagugaaggucuaggggcagaggacagcacucaaacccuacgacuggcucugggggauguagggcacaguccugucuccucagucaggguaggucucagagccuuguauuucuggauucaagucucagcucagcucagccacugacuugcugugcauccugggccagucccuuucccucucugagcuuucguuuuccugagaggggagaaauggggucugugacccaugcaggucccaguucagacuuggggcacccggccaccagcaccccagccuugggggucuuaaacacuggagggcccuuagaaaauguuaacacauucaaaauguggggcccucugagguuuugaaccauaggagccagugcagggugauauugccuuucugaaaucugaaaacuccuggacucaagcacaucuggcccucaggguuuugccuaagggacugucucuguguuucuguuuucucagugcuacugaccuucuaggguuguuguaaauuggccuccaaguagacccuacaugaguaaggacucugagggcuguuggagcgucagcuggcacucgggcccagccugaucucauuuuguuuuuuuagagagagacggucuuacuauguugcucaggcuugucucaagcuccugggcucaagugauccuccugccucggucuuauuauguugcccagacuggucucaagcuccugggcucaagugauccuccugccuuggcuucccaaaguguugggauuacaggcaugagccaccaugccuggucugaucucauuucuaggggugacugcccaccccuuccccaaaagucagccucagccucagccuccuucugagaugggagggaugguacagggcugugugucuguuggggauaggggugacacgacacuugguacacaaguuucugccaaccuaccgcccuucagguccugaauucugccuuuccauagacuacuugguagagucagggugggcuccaaggccaacugagccacucaugcucugugaucuagggucagccccuuucccucuucggggcuuggucuucccauuuguguaauuaaaggaucagaaucuaugaugucucaggucuuucuucuuccagccuggcaggauucuuggauucagagcauccccacaccacaaagcagauacuccugggagguggcccugggagccauuuggaauucuuccccucagccaccuuuccuuccucagaccagcuugccagaugcccugggagcuggacauggaagaugaugcguuaaauacuugaggggcugucauugcuaaggaaagggagugagcuucccaucacuggagguauguaaguagacacugaguacaacuugaugggaaccuaagcacugaauagggcaguuagauuucccacaguucccuccaacccuggagucuaagaugcuuugaguuuggaaagggcagggggauaggcaggucuggguggugccaaacaugacucuuuuuuuuuuuuuuuuuuuuuuuggagacagaguuucgcgcuuguugcccagacuggagugcaauggugcgaucucuacucacugcaaccucugccucccugguucaagcgauucuccugccucagccucccaaguagcugggauuacaggcaugcgucgccacgcccugcuaauuuuguauuuuuaguagagaugggguuucuccauauuggucaggcugaucuugaauuuacaaccucaggugauccgccccccuccgucucccaaagugcugggauuacaggcaugagccaccacucccagcccaaacaagacucuuaaugagaugugguuccugcccuaagggagcucacaguccauccaagagucauuuuggucugagaagcgcuguaagagguugccgaggaauuuaugggagggacgcugcggaucaggguccccucuuggggaaggcgaguauuugaucagagcugugaugggcaggaauuauucaggaagggaagggcaggcaagggcauuucaggcaggggcugccaugcaggcaagugcucgguggcugugagaaacacuugcuacauuugucagacuacaaggaucugggcacugcuggaauggagcugggauuguugggguauaaguggugagaggcaggccggaggggcagcaggagccaggucaugugugaucuugggugcuaagcuggggaguuaaaauuugauccggagggcaacagagagucagggaagccucaggcaggagggaggugggcagaacuguccaugcugguugcagaguggagaugaauggcuuggcguggcagaaggcagaagugaggacgcagucacugggaucagggcaagagaggaagggugucagugugggggacaaggcaggauuggauggaugagacagaaauguuggaauguaagcucccauggcaggggcuuuauuuugucugcugccgaauuccagcaccugaaacagcgcuggcacaugguaagacaucaggugggaggaggcagcgugcugcuccaagacugugugaaggaagcccuuggauggaggagucacuggggagaaagggagcauagagcaacagggaggggucagggcuaaagcugagcacaaggauguuuauuaccaccuugcaauaaacaacgcuggacaagaaagaaaugagccaaauguccaacuacaagggaugcugauugauuuucagauccucuaugcugugccagccauugaaugaguagaugaugagauggugacugcaaguugggaugaacagauguuccugauaauuuguuaggugacaaaggcaaguuacagacuggcacgugucauauggggggcacgcagaccuggaucucggagaggcccggguggguggggguagggauaggagauguugcagaacagguggcagcuggagccaaggacagggaugacaccaccgggaaauugccaaaccugggacugcagccgugcuuggagacaggugcagggggagccuaaggggaggccugucacccggggcaccccagccgagucagcggagccucucggcccuuggggucaucuccugucaucuaacccagcagaaguacucugauucuaaauucugggacucucaggucauuuaaauuccacugaguaccccaguacccugcccucuccuggagucauacaguguuggcacacgcugagcaggguccaauggccucauagugcccuccugguuaccccuggccugccacucuccaaaguauucucccucuggccuggaucauuuucccuuugggaacccagguguccugcccccucuacuugggaaagucugggagugaaaauagcucagggagggaggggcccugagugcccaacgggcugggccuggguagcagcugccccugugccccucuuuggcgcccccgaggugcugccucagcacuaaguguccaucuggcuggagagucagguuacagcguaaggggacccaggucuccccuccuccccgaccuauggccuuuucagcagacucagggccccaugccugggguaucuugggaaagaauggggguagggaaaaggguaaagauccucagguugcggggguccugaugucugacagucugugauguggggccugucugugcucuuucugggcuucaguuucuucaauuguuaaaugagauacagcgacuauggaccccacccuggagacgaggugggguggggucugagaggacccuucucacuacccccacacucccaaguccacuaguugccugacugcaagccuucaggguggggucugggaauauuuaacuagaagaagauucuucuuucugaacccccccuaacuuggaucuccugggguuugcccagccuguuuucagcagcagaaguggggcagugggcccaggggaaugaacccugguggggguggggagcccagaaacucucuugucauuuuaaaccccucuugagggcucccagcccucuccuccagcccuggggacagcaggcagcugaugggcagagccugggcuggggauuagcacucuagguuaaagacaagcucugccccugcacugcugagaugcccaggacaaacagcccggccucucaggccucgguuuugcugucaggaaaugggcgagcacucacuuuccgcugcugcuucucccaggccggguccagcagcaggucgcggucccaguccuccuccuguuccauguacucgccgcccccgccgccgcccgcaaagcgccccuccccggcccccagacccucgggcugcauaaccaucaucaucucgaucgggcuccuggcuucgcuccgcucggcacgcucucggacacccgg

SEQ ID NO: 18656 - RNA, 7136 nt, Homo sapiens
agagcguaacugcugccccauggaccagguuagcuaagagagguuccaugaaacugcuguugcagaaaugcuucuaacuauaaaaugccaaaccugggaaagaauguuuggauucucauagccuggaucaguaggacacugccuuggcgugcuggugccccacccccaacucacccaggccaggggagguagagccccagccccugagacccucaggcauccugcaguuuccaggcccuacagagggucccagaaacagccccagcaacaaagugaggggccagaaacuaugcaaagauggagggaggcugagaaacaagucagugcuuuauuaaccuggcaaaggggcagcuaggcggccugagcagccccugccagacccuccucugcacuccucugccuaagucacggcccaagcccuggacacguaggaguguaggcgggcaggggcaaggccaaggaagggguggaguuguccaaugcagauguuaagguccaacccgacuuccuuacugagucuaggugugggggccccccucucaccccuuccucccugcacagcucuggcucuuccuggagucaggaggcugugugucccacaucugcuguggucuggaaggugaucccauccccaggcaauggggaggccaggaagggccagagccagacgagggcccagcggggccccagggcugccugcagguuguggcagggacccaggucauaggagugcuggccccgagcccacucccauguggucuggccccgcagcagcagcaucccauggaagagcagcccagccccgcacagcagcgcacccgccacgcacguguccgucacgaaggccaaggcaaacugugccagagacacucugccugcaauaaaagagcagagagggucagggaggggcagugggguccggcuuuccugccaccugcuccccuccaccacaaagcagggcucauuccuccgcucagcaaacccugugucgauacucgcuggccagcccgugcugggugacaagaacgcacugguaaacugggcagacgcagcccccuacuugggauacggcuucauuccugcaucacagacuuggugagcaccuccucagcccuggaggcggugccaggcacuagagggugucucugcccuuggggagcucacagacauuaaagaggccauucuuggcuggaugcgguggcucacaccuguaaucccagcacuuugggggggcgaagcagauagaucaccugaggucaggaauuugagaccagccuugacaacacgguaaaaccccgucucuacuaaaaaauacaaaaauuagccagacgugguggcaggcgccuguaaucccagcuacucaggaggcuggggggcucaggcaggagaaucgcuuuaaccugggaggcagagguugcagugagcugagaucacgccacugcacuccagcaugggcaacauagcgagacucccaucucaaaaaaaaaaaaaaaaaaaaggccggacgcgauggcucgugccuguaaucccaguauuuugggaggccgaggcggguggaucacgaggucaggaguuccagaccagccugaccaacauggugaaacuccgucucuacuaaaaauacaaaaauuaaccgggugugguugcgcacgcccguaaucccagcuacucaggaggcugaggcaggauaaucgcuugaacccgggagguggaggcugcagugagccaagauugcgccauugcacuccagccugggugacagagugagaaaaaaaaaaaaagccauucucaguuacuuaaugugugccgccacagaaaagccaguauccugugccaucuuggcccacagucagcaacaaguaccugcugaacuaacggacuacgagaggccaugaaauguuacucuaagugagagaagccaggcaccaaaggucacauguuuaucaucccacuuaugugaaacauccugaauaggcaaguccacagagacagaaagauuagugguugccaggggcuaaggggauuagggaggaacauggagggaccacuaauggguacgggguuucuuuuuaggaugaaaauguucuggaauuagacaguggugaugguugcacuacaucaugaauguacuaaaagccacuaaauuguacacuuuaaaauaguuaaaaugggccgggugugguggcucaugccuguaaucccagcaauuuaggaggcugaggcagguggaucaccugaggucaggaguuccagaccagccuggccaacauggagaaacuccgucuguacuaaaaauacaaaaaauuagucgggcgugguggcgcaugccuguaaucccagcuacucgggaggcugaggcaagagaaucacuugaaccuggaaggcggagguuguggugagccgagaucgcgcuauugcacuccagccugggcaacaagagcaaaacuccaucucaaaaaaaaaaaaaaaaccauucuguuugaagguccugaggcaggccagaggcacuugugagacaagcagguggacggucugcaggucugcaagcacagggagaagcccaggcuggacaaacaguucugcgaguagggggugcaaggcaacccugagacugugggcgcagcuagaccugccaaaguguguagagugaggggggaauggcaccuagacaggagcacggggaaaucgguucuuggggaucagauaaaagaugagaaagggcaaccacaaaggaaggugaacgcaccaaggucccagccaucggugaugccaggcggagaacgcuucacgggggcugggggccagcagugucaugagucuaaaaggucucauaaagcaagaaaggguccuggaguguguggagacagaucccugagugaguggugguggcagaagccaggcuggagcaggcagggaaugagcagccaugagccugggcaagucccuugggaagcuuagagcagggcaagcgcuggaggaggauaugagggcaagggaggguuuguccaagguggcaaaccaggagggcagagaaggccuggccugcaggagaggcagaugccacagccugaggccuccaagcagggagguaggcaccaaauacaagaagcugggggcagucagcugggcucggggaguugaggacagcacaauuugggaugugccagcugaugucucacuuucucagugcuggagcuuggagugugggagagcagggaagguuugagcugcuguugcugggaguagcaagcuuacaagcaaacgggaaggccaggcauagccgagggccugcugaggucagcagccaugaacauggcauggcaucaaccugccacagacugccaaugccucuggcucucagcagccagaggcagacacagagaagccaggaaagcacuguggaaggaagaugagggaggaaguuugcgaugcuggcaggagaauggugagaaggaugagcucugagcuggacgucgguggcgaagguggaaagguacagacgggcggugagggccacgagccugcaggcucauggagcaggugccagggcguggaggaguaaaagacggagagaagaggaggugggcagcagaaagaggaagaugggugguuugugagggugacucauuuuuggauucugaccaggacugggguguggacaugggaggagggaaaggaaggaaaaaugaaggaggaggccaagagcuaagccauccaggcauugagggggcuguucaugcaaacuuccagacacccuugauuuccacagggcccagggcgaagagagagucugugacuggagccagagucuuccgugacugaggggagugaguguugaccacaaggugguagggcagugcggcugaagggccgggacuccuggagggaggcagaggaggacccauugggaagcuggugugggcagaugaagauucugauaaccccagugggccgcuucccgaggccuccccugggcuguaggugggguccaugcacagagcugggcuuggauaggaugaggaggcacagugacuacccggaguagccggggagguuccucaaccacagaucaaagugacagagggaaccauggaaaggucaggaggaaggaaugggggcgagaaaggccaaagcauucuggggguagagaacaaagaguaaaaaggaccagcgaggcuucuaucuguagaugggggaagaggaacauaugugucgucuagaacauggcaucucaggcagccugcugauccaagucugcccuccccagcuucccauaacugggccuucuccugccugucacuuucacuggcuccccacuguccagucaaauaggagccaucuccucacaccaguucucaggaccccaccagccaggccuccccuaccaaucuggccuuaauucucacaauucccugcccacucuccaagccuuuguuccuauugcuucucucacuuagaaaugcuccuagaaugcacuuccacaucccgccaugcagagacucccacgagucuuucuccucucucaacaacuccaggaaucucccaauucuccagccagaacgcugcacuugucucaacacaccaguuuccauacugcacccccgggugaauaccaagcugcccuuacuggccaucacugacacuggggcugggucccccaggccagaaagcccgucucccaccagaaugggcuguacuccccagcccaauaccagggccccugccucugugcagaggccucccaggcuccccaccugugagcaacaugagccagggaagcaggaggagggcagccauguggaggggcgugugggcucgcagcagggccgacagugcagggcccagcagcacagagacguggagcaggacgccggcggcaugaagcagcaggcacaggaagggccgguaguugccgaagcccacgcagcggcccagcaggcggcagugguggucccgacgcaggaugcagacgcggcaggcagagcaguguccgcugcguggcggcaccuggcuuuggcauugguagcaguaacugcaggaaggaaccacagcgucaguucccccagcagcucagaugccccauauugugcacagggcugccccagagcccauccugcggaaguggcaacagccauuugcccuggcuaagccucaauuucuuuacaaguaaaugcaggcuaaacaagaugucccaggcccuucuaguucuagcacuacaggucugaggucucuuccagcccuaacauccccaguccugagaccucucucaagccacugacauccagcagcaaaucccucccuuccuccacggucaccccuuuguccaggucacuaggaacucucuggauuacugcaauagccucuugacuggucuccgauuccaccuuugccccaccucguacggucucaccccagcaaccaaacugacccuccucugcuuaaaacccuccugugguucuccaauuuauuucuaguaaaaagcaaagccuucaguguccuacaacauccuucuaucugugacaucucuuccccucucuuacugcacuccagccacacuggccuucuugcuguucugggaacauacaugcuggguacacaacugccucagagccuuugcaccacuuguuaccucugccuggaacaccuuucccucagauucccacauggcuaaccgccccccacgcccuccaaguuuuuugcucaaaugccuccuucucuaugaggucuaccuugaccacacauuuauguauauuauuuuaaaaauuaauuaaaaaaaauuuuuagggacagagucucgcuacauuacccaggcuggaguguagugguuguucacaggugugaucauagcacacuacagccucagucucagcaaaagccucugccuggcauaaaauguguguguagagccuguaccugguguaauuuuuuuuucuaauuauaaauugacaaauuccaguuguauauacuuaugggauaccaagugauguuaugauuuaucaguacagcuuggaauaaaucaagcuaauuaggauagccauuaccucaaacacucauauuuuugugaugagaauuuaccaccuguuuauuuauguauuuauuuauuugagacggagggagucuugcucugucacccaggcuggagugcaguggcucgaucucggcucacugcaaccuccgccucccagguucaaacaauucucuugccucagccuccccaguagcugagauuacaggcacgugccgccaugcccgacuaauuuuuuuauauuuuuaguagagacgggguuucaccacguuggcuaggcugguaaacuucugaccuuaagugauccgccggccucggccucccaaagugcugggauuacagaugugagccaacgcacccggccuaaccaccuauuuaauauugaaacuugcaaccccuuuacccugcucuacuucuuguuuccaaacuacuaucaccuucuagcauucuauaugauuugcuuauuauuccucuaguuucucaucugcaccccccucaaaucaggaauuuguucuauuguacccuucgucccuguaacaaaaccuugcaccuaguaggcucccaauaaguauuugcgaguaaauaaauaacacucaauucuagcucuuccaucccagguucuaaaaaaaugucugauucuaacaaccuggauccuaauguaacccgguucuaacaucucaggucuuggggccccuccccccuguccaaggcucccacuucuccccgcccgaucccgcaccccacucacgcccagcccuggcccagaccgcggccggccagcaucacgccacggaugcugggauccgagcgcaggaagagccccacguugcccagcagguugagcagcuggaaggcggccagcgccagcugcaaggcccgggccaggggucccagcggcggcggcccgggaccgagcaccagcacguaagccagcuccaggcccacggccgcggcccacagcgcggugagcacgagaggcagcugcgcgggcgccccguccgugcucccagccgcccagggcugccccauggccuggacacccagcugucggagccggaggacuaggccgcuuccguauuggggcggagauagcggcagacggacgucugcu

SEQ ID NO: 18657 - RNA, 29264 nt, Homo sapiens
aagauggugguugucucuaauauuuauuugucugguuauaaaauuaauaugugaggagcauuggauuuggugagaacguuuugaacccuagcugucacgugccaccugcgggaucuagaccagugacuucucagaacugccauuuccucaucugguagacaggaugguaagcccugucuugcucacuccacguauggcagugcagaugaaaugagaucacagaggggaagcaauuggcaggcuggaaagugcugacaaauggaagggguugugucaccacccucagcugagguaguaccaagguccaagcuccugccccucccccuccccagccccuaaauacacacacgaauggagggccacuugcagccuuggucugauggaauugggggcaaggccacacaucuuccucaagcuuggccagauggggccucacuggggcccuuccagaaucgggcaucggcuguggccagcugugugaggaucuccuccaacucggguccauccucugggaaacgcucagagaaggaucggaugaggccagcagcugacgccucguauuccagaagcugcacgucugagccuggggaggagauggagagaaaacagcagggaaaggucugaauagggaaacugaaucaucauaaaaaucuuaauaaucacaauuacagcagcagcuguuucuuacugagcucugccaaaaaaaccugugcucuacguuuuagguuaauuacuuaauuuacucuuuacaguaacccugugaggaaggaaauacuacagggggaguauuaaaugcauugcugcuuucguucauucagucaaucaaauaaagauuuaggcugggcaugguggcucaugccuguaauccuagcaccuugguaggcugaggugggaggaucaccugaggucaggaguuugagaccagcuuggccaacaugaugaaacacuguuuauacuaaacauacaaaaaaauuagcugggcgugguggcaugagccuguagucccagcuacucgggaggcugaggcuggagaauugcuugaacccggguggcagagguugcggugagcagagaucgugccacugcacuccagccugggugacagugagauuccaccucaaaauaaauaaauaaauaaauaaauaauaaaagacaccaggugccacacuaggugaaacagauacaguccuugguguccugaagcucacaauucagcaacgacuucaucugucuacugugggaccuggggcaaguguugcaaccucccaagcuucagucuccucaucuguaaaggagcugcagugaugacauagucacacaucgagggggugcucaacaaaugcuagccaccauggcaucauuaucuccgaaccuguuuacugauuuauuaaaugggcuguucugaggguccccugaauacccccgggaagcacugcccucaaacacacuucaacugcucuacccucucugugcaccuugucguguuccaugacaucacaagcugcacagcagcaaagagcacaagcucuggaguucaaguucuggcucugccacccaacagcuuugugaccgcaggcaaauacacagccccucugugccucauuuuccagaugaaaaaugaggauaauaaccauuucucucuggguuguuaggaguuaagccauagaaagcuuuuacagcgaccuggcugggugugguggcucacaccuguaaugccagcacuuugggaggcugaggcggguggaucacuugaggucaggaguucgagauuagccuggccaacauggugaaaccccaucucuacuaaaaauacaaaauuagcugggcaugguggugggugccucuaaucccagcuuuuugggaggcugaggccggagaaucauuugacuccggagguggagguugcagugagccgagaucucaccacugccugcgggacagagugagacuccaccucaaaaaaaaaaaaaaaaacuuuuuacagugcaccaccaucacaaccuuugaaaauccaaccuguucuucagaucuagugggaaccaccccuuccuccccagaacguucccggauacucuugaagauggaugcgaucuucccuccucuaaguguucagaguucuguuuauauguuuuggccacucauuaacacuucccuuguaugauuaugaugaugauuauuauuauuauuuuuuuuuuuagauggagucucgcucugucacccaggcuggagugcagugacgcaaucuuggcucacugcaagcuccgccucccggguucaggucauucuccugccucagucuccugaguagcugggacuacaggcgccugcaaccaugccuggcuaauuuuuuguauuuuuaguagagacgggguuucaccguguuagccaggacggucucgaucuccugaccuugugauccaccugccucagccucccaaagugcugggauuacaggugugagucaccgcgcccggcccccuuguaugauuauuuaucuccauaucuuaucauccccagugagcugugaucaccuccggaucccuaguggcucccccauggcucgcacagggcuggacauaucaaagcaauugagaguauuguccauguggcuggcaugauuuauuaaugcacucauuugacagucacugagcaacuccagugugccaggcugugcaugaggcacugggguaugcugcuccucccaucaugagaagugaccaccaagaaaaugggcaagcgugaugggcgcuagaagaaaaugaaacuggguagcagaacagagagggaccgaagcaguuacuuuagguggaggggucagagacaaccucucucacagggugccguuuuacaaggagcggaaggacaaaaagaaccagacaggcaaagaucuggaggaagaucaugccaagcagcaagaacagcuuauucaaaggcuguaggaguggacccagcucaguggguagaagaaacagaaaggucgggagacuggaguacagugagccagagaagggguggugaggcuggcaaggguuggggccaaaucccaggaagccucuggagagcauggaaaagcaucuagaaugagcgucuuaauaaaugcuuuuuccggcugggcaugguggcucacgccuguaaucccagcacuuugggaggccgaggaggguggaucaccugaggucaggaguucgagaccagccuggccaacauggcaaaacccugucucuacuaaaaauacaaaaauuagccgggcauggcggcacgcgccuguaaucccagcuacucaggaagcugaggcaggagaaucgcuugaacccgggaggcagagauugcagugggccaagaucgagccacugcacuccagccugggcaacaagagggaaacuccgucucagaaauaaauaaaauaaaauagccggguaugguggcucacgccuguaaucccagcacuuugggaggcugagguggguagaucacuugaggucaggaguucgagaccagccuagccaacauaguaaaaccccgucucuacuaaaaaaaauacaaaaauuagcugggugugguggcgggcgccuguuauaccagcuacucgggagacuggggcaggagaaucgcuugaacccagaggcggagguugcaaugagccgagauugugucacuacacuccagccuaggcgacagagugagacuccgucucaaaaaaaacaaaaacaaaaacaaaaacaaaaccaacccaaaaaccaaauaaauaaaugcuuuuuccucaccaauaauagguagugacuuuuugcaaauauuauucuauguaacccucacaacugcccaggacaaugcuuuuuuuuuuuuuuuuuuuuuaaagaguugaggucuugcucuguagcauugaacuccugggcucaagcaauccuccuaccucacucuuucaaguagcugggacuauaggcaggggccaccaugccugacucaaccacucuuaauuugacucuuggcuccuccacuaaaaagccauaagccuugugcaaauuacucucugugccucaguuuccuuaccuguaaaauggggauaacaacaauaccuaccuuauugggcuacugcaaggauuuaaaagguuaauccccagaaagcacuuagaaacucuaagaaggaauucagguucacgauaacaucagcaagcaguccacacugccuuuaugaaugaagacaccaaagucuagaaaugucaggugacuaggccaaagucacagggugguucugaagcuggugcucuaaccucuccauaacacacaucaucuuagguaucucaagugacaaguagcaggaaagaugagucaaggggugagaggaaagugaaggcaguaaggggcuggaaccccagggggucugaauacgaaagauacaagcaccguguggccaaggcucuggaauugucgcuugagaaggaagcgggaugaugcagcuguugaucaccauccuggaugugaccgaguccacuguccccuggguuucacuaggcuugcuggaucccagcucccuccucaccugacccccagccuggguacccaacaggucuaauucuuugguaugaacgccuggcuucccccuaagucugcauguucugcuauccccugcucugguggucuucuucaaaucuucugucacugucuuacaacuugcaugacugugugugugucgggggggugguggguggugacagauaccaagauaagggccugagguuuggcaugggaaggaccuuggcagaaagggaagggccaucccaggcuggguuagguucuuauugagcccugggauggguucuuacugcuucccagagggcccuguguggugcucaucaagggagcucaagagcucccucauuaccucauuaccuucaaggcgaguguugggcugaacaaugagcuuccgagauuccuuacgcagcagcaccgugucccugagggugaggaagcacucggggggcgcaucagugacuguugcauaccccucguacagggcccgcccuccggccacauccccuguggacuucagcaccugugagaaggauggaguaaaugucuaggaugggcaguuacccgguguccacagggcucugccauaggccacagcugauuguggucagcccuggacagucugugcuaugguuugaauguguccccuccaaaauucugguguugaaacuuaugguuaaguuucaacuuaaccauuaaggcuccuuccucuugaaugggauuaaggcccuuauaaaagaggcuucaggcugggugugguggcucacaccuguaaucuuaguaccuugggaggaggaggcaggggaucacuugagcccaggaguuugagaccagccuggacaauauggcaagaccauaucucuauggaaaaaaaaaggccagccaugguggcucaugcgugcaauccugggcacuuggggaguccgaggugagaggauugcuugaguuugagaccagccugguuaacauagugagaccccgucucgucucuaaaaaaaaggaaaagaaagaaagaaaaaggaaaacaggcuucaugccuguuuggcccuguugccauuuugcuuuccaccaugugaggccacagcauuccucccauuccucuccuacaaauaagguaucuucaacaagguaucaucuuggauggaagagaagagcagccuucaccagaaaaugaaccagcugguaccuugaucuuggacucccccaccuccagaacugccagaaauaaauuugugaucuuuuuuuuuuuugagacagagucuugcugucacccagccuggagugcaauggcacaaucuuggcucacugcaaccucugccucccggguucaagugauucuccuaccucagccuccugaguagcugggacuacaggugcgugccaccacgcccggcuaaauuuuuguauuuuuaguagagaugggauuucaccauguuagccaagauggucuccaucuccugaucucgagaucugccccgccccggccucccaaagugcugggauuacaggcgugagccaccaugccuggccaauuucuguucuuuauaaaucacccagccucugguauuuuugguguguuacaacagcacaagacagacuaagacacucugcaaaaugcugggcccugucacuuacaggcaguguaaccuuggacaaguuacuaaaccacucugaccuguuaucucuaaacaagaauaguucuacucucucauaguguuacugugcugaaugagugagaaacacagaucagugauuagcauagaguaaaugcccacaaaauuaaagcuaauguuucucguuugauuaucucauuugacauguagacaaggcagguaugaccauuacccuuuauaaaauaaaacauuucuggcugggcacgguggcucauaccuguaaucccagcacuuugggaggccgaggcaggcggaucaccugaggucaggaguucaagaccagcuuggccaacauggugaaacccugucucuacaaaaauauaaaaacuagccagguuugaugguggugccuguagucccagcuauucaggaagcugaggugggagaaucgcuugaacccaggaggugauggaugcagugagccaagauugcaccauugcacuccagcgugggugacaaagugagacuccaucucaaaaaaauaauaaauaaauaaaauaaaacauuucuuacacauacaagauacaguauguauaccguaaagaauauuaaaacaaacacucgggccgggcggguggcucaugccuguaaucccagcacuuugggaggacgaggugggcggaucaugaggucaguagaucaagaccauccuggcuagcacugugaaaccccguuucuacuaaaaauacaaaaaauuugguugggcguggugucucacgccuguaaucccagcacuuugggaggccgaggcggguggaucacgaggucaggagaucgagaccauccuggcuaacauggggugaaaccccaucucuacuaaaaaauacaaaaaauuagccaggcgggugccuguagucccagcuacucgggaggcugaggcacgagaauggcaugaaccugggaggcggagcuugcagugagcugagaucacgccacugcacuccagccugggcgacagagugagacuugguuucgaaaaaaaaaaaauuagcugggcaugguggcacacgccuauaaucccagcuacucgggaggcugaggcaggagaaucucuugaacucgggaggcagaggcugcaauaagccaagaacuugccacugcauuccagccugggggacagagcgagacucccaucaaaaaaaaaaaaaagacggacacucauacaacccccaccucaccucagaguuaguucagcugcuucugcuugacugcacucuguggcuguccccaucuaaggaaaccacuauccuugauauuguacuuucuuuuuuuugagauggagucucgcuguugccaggcuggagcgcaguggcgugaucuuggcucacgcaaccuccaccucccagguucaagcaauucuucugccucagccuccugaguagcugggacuacaggugugcaccaccacgcccagcuaauuuuuguauuuuuaguagagacgggccgccauguuggccaggauggucucaaucguuugaccucaugaucugcccaucuuggccucccaaagugcugggauuacaggcgugagccaccgugcccagccgauauuguaguuuuuaaaaaacucucuugcuuucccugaguuuuacucucaaucauauauuaaguucuugccugcuuuuuuuuuuuuuuuggagacaaagucucagucuauuacccaggcuggugugcaguggcagauuaucagcucacugaaaccuccaccucccagguucaagugauccuccugccucagccuccucuguagcugggacuacaggcaccugccaccaugcccaccuaauuuuuguauuuuuaguagaugugggguuucaccauguuggacaggcuggucucgaacuccugaccucaggugauccucccgccucagccucccaaagugcugggauuacaguggugagccacugugcccggccgguuuuugaacuguauauauugugauuuucuuuuucugcuuggauuauguuugagauucauuugugccaaaacauucagcuauaguuccccuucucacugcuguguauguagucuuuuacuuauaaacacacaacuucaucuccucuacuguucauguguaauuuggugcuuuuuuuuuuugagacguaauuuucacucuuguugcccaggcuggagugcagcagcacgaucauggcucacugcaauccccaccucccggguucaagugauucucuugucucagcuucccgaguagcuuggaguacaggaugcgccaccaugccuggcuaacuuuuuugcacuuuuuuuuuuuuuugagacagagucucacucugucgcuugggccggaguucaguggcacgaucuuggcucacugcaaccuccaccuccugguucaagcgauucuccugccucagccuccugaguagcugggacuacaggcaaaugccaccauacccggcuaauuuuuuauuuuuaguagaaaagggguuucaccauguuggccaggcuggucuugaacuccuaaccucaggugaucugccugccucggccucccaaagugcugggauuacaggugugagccaccaugcccagccuuuuuguacuuuuaguagagaugggguuucaccauguuaacuaggcuggucugaaacuccugaccucaggugaccugcccgccauggccucccauagugcugggauuacaggcgugagccagugcgcccggccggugcuuuuugcuaauaaugcugcugugaacaucccuguaugucuccugaugaacagaugcaaguuuuuccagaacugauucugugucggugacaggagugcucaacuuuaagagaugacgcugcuguuucuuaaaauucguauguaauucagccuuccaaaagcaguggauggcaguccucauugcucagucuacuaaguggaugcuggcaguuguuaauuccugccaugcugguggguaucaauuguaacuuaugcaguuuagguugagguugccuaauuacuaacaagguugagcaucuucccuuaguugaucaagggcuauucauuuuccucuucuguucauuuuugcuuauuuuauguuggguuaucuuuucuccuucacuuuuuuaaaaaaaguuucuucuuucuuuauuuuuugaaauggagucuugcuguauugcccgcgauggagugcaguggcaugaucuuggcucacugcaaccuccaccuuccagguuugagcaauucuccugccuuagccuccugaguagcugggauuacaggcaccugccaauacgccuggcuaauuuuuuauguuuuugguagagacagguuucaccauguuggccaggcuggucucgaacuccuuaccucaagugaucugucugccuuggccucccaaagugcugggauuacaggugugagcgacugugcucggcugaaaaguucuuuauuuauuuuaaauaugaacccuuugucaguacaguaguccccauauauccauggcguauauguuccaagaccauguaguggaugccugaagccauggacaguacagggcacuauauauacacuguuuuuuuuucaccauacauacacaccuaugagaaaguuuaauuuauaaauuaggcacaggaagagauuaacaauaacuacuaauaaaauagaacaccuguaacaaaauaacgcgauaaaaggugaauauagccucucucucaaaauauguuuuuuuuuuucuuuuugaggcaguguuucgcugugucacccaagcaggagggcaguggcacaaucuuggcucacugcaaccuccaacucccagauucaagcgauucucaugccucagccuccugaguggcugggauuacaggcgccugccaccaugcccagcuaauuuuuguauuuuuaguagagauagggcuucaccauguuggccaggcuggucuugaacucgugaccucaggugaucagcccgucugggccucccaaagugcugggauuacaggcgugaaccaccacacccaaccuaaaaauaucuuguuguauuuuacuguggcuaacugcagccgcauaaagcaaaacuguggauaagcggggccuaaccauauguguuauaaauauccuauccuaguguaagaccuuuuuuuuuuugaggcggaguuuugcucucauugcagaggcuagagugcaguggcgcaaucucggcucacugcaaccuccgccuucagguuuaaagagauucuccugcuucagccucccaaguagcugggauuacaggcaccagccaccaugcccagcuaauuuuuuuguauuuuuaguagagaugggguuucaccauguuggucaggcuggucucgaacugcugaccucgugauccacccgccucggccucccagagugccgggauuacaggcgugagccaccgcgcccagcaccuaguguaagacuugacaccuucuuuaugguaacuuuugauuaauauguuaucuuuucuuuuucuuuuagagacagaaucuaguucugucacccaggcuagagugcaguggugaucagggcucacugcagccucuaccucccaugcucaagugauccucccaucucagccuccuguguggcugcgaccacaggcgugcaucaccacacuuggcuauuuuuaaaauuuuuuguagagaugaggucucacuauguugcccaggcuggucuugaacuccuagacucaaggaaucuagccucccaaaguucugggauuacaggcaugagccaucacgccagggaaacugagcaguuuuauugguguacaaaguucauauuguauauuuacucucagcaucacucagccauauaucuuauggcuuaucaaaccuucucucuggggcuguuucuuuuuccuaaauuauauccuguagaaguguuguuacugaggguuuauuaacgguaaacuguuuuuguuuguccaaaaauguccuucguucuuaaaagauguccuggcugggcacagugccucacaccuguaaucccagcacuuugggaggucaaggcggguggaucaccugaggucaggaguucgagacaagccuggccaacauggugaaacccugucucuacuaaaaauacaaaaauuaggccaggcccgguggcucacgccuguaaucccagcacuuugggaggccgaggcaggcagaucacgaggucaggagaucgagaccauccuggcuaacacggugaaacccugucuccacuaaaaauacaaaaaauuagccgggcaugguggcgggcaccuguagucccugcuacucgggaggcagaggcaggagaauggugugaacccaggaggcggaguuugcagugagcacagaucacgccacugcacuccagccugggcgacagagcgagacccugucucaaaaaaaaaaaauuagccgggcgugguggugaaagccuguaaucccagcuacucgggagguugaggcaggagaauugcuugaacccaggagaagguuacagugagccgagaucacgccauugcacuccagccugggcaacaagagcaaaacucugucuaauaaauaaauaaacaaacaaauaaauaaauaaaagauguccuuauucuuuuuuuuuuuuuuagagauagggucucacucugucacccaggcuggaguguaguggugcaaucauggcuuacugcagccucgaccccucaggcucaagugauccucccacuuccgccuccagaguagcuggaacuacaggugcgcacuaccauaccuggcuaauuuuuguauuuuuuguagagacgagguuuugccauguugcccaggcuagucucgaacuccugagcucaagugaucugcccuccuuggccucccacagugcugggaucacaggcgugaggcacccggugcgcuuacauguuuacuggcuaccuuuccucacugcagcauaagaaacugcucacagcuuauucuccgugccugguaacacucagugccccuggagagguugguggggacccauccagacgagaggccuuugcuuaccugaagucuccgcaggaagcgcucuagagcaggcuugcccacagaccggaucuugcugcggucgaggcggacccgggcaucugggcgcccaucggagccuguggugggagugaugguaacgagucccucgccagccuccagcaagacucucaggaucacaaaccgggccugcauaugggccugccggagcaggggaaagacagcauuuguagcccguaucaagugcuugguccuaggcuugguccuuggcuugguccuuggucccaggcuugguccuuggucccaguugcccauuaacuggcaacuguuauugucauucuccccaacccugcggguccuuuucugcuuauucuccuccccucaaaugcuuccuccuuccucuucucacagagagggcaggcugcccuaggagacagggaggccauuuccaggcgggaccuggugcccaugcuccccaugucacccacugugaucccugcugcuccagauccccugcugaggacagcagcuacccccuccaggguccccaaacacuuucuccuccacaaccuuguuugugcucaaaaggggaaccaaguaggcaucauuauccccaguuuacagaugauaaaacagaggcccagagagguaaagggacuuccuuaggggcacacagcuaauaacggaagagccaggacucagacccacauuucuggacccugaaugacgucacaucgccuccucaaaccacaccuauuugauuuugucaaaaaguuucuauugcuggugggaugcgguggcucacaccuguaaucccagcacuuugggaggccgaggcgggcggaucacaaggucaggagaucgagaccauccuggcuaacacggugaaaccccaucucuacuaaaaauacaaaaaauuagcugggcgugguggugcaugccuguaauccuagccacucgggaggcugaggcgagagaauggcgugaacccaggagauggaguuugcagugagccaagauggugccacugcacuccagccugggugacagagugagacucugucucaaaagaaaaaaaaaauacaaaaaauuagccgggugugguggugcgccuauagucccagcuacucgggaggcugaggcagaauugcuugaacccgggaggcggagguugcagugagccgagauccggccacugcacuccagccuggugacagagcgagacuuugucucaaaaaaacaaaaacgaacaaacaaaaaaguuucuauugcuuaccccauauccaaaggacacauaacugagccguggcacugaauggcccuguaggcacuguauggaugcgaauccuggcucugccacuuaguggcaaguugcuucaucuccuugugccucgacuuccucaucucuaaaaugaggguaacaauagcaccuaccuccugggguaguuaauucauggagggcguuuagaauuguguguggcagagagugcgucaacugcgaggaguccuaauaaagucaccucaucugauucaccgugaaaugguggccggggagaguccuacucccauuucacagagaggaacucuggggcucacaagagugaugugacuugccucccaaacaguggagucuagcauuaaacccaguucaucugccuuaaagguacaguggucccauccuugcacccugaucuuggcacccacugcaggcucccuuccgccuccagggggcuccaccuaggcccuaccugucgccaguugaaggccucagguguguagaacuccagagcgagcagcccggcccgaaccauguugagccaguucacguagaucacguccuccgcaucagcccccucaaagccaaagauccugugagaggggcaggcagguggcaggauggucagaggcugcccuguccccaucccacuggccacuaccacccacccuccacgcccccagggcuggccacugcagcgggacagcccgccccucggcccugcugcucuuacuccagcacuugcggguggagacagagguagagacccacgcucucagcccggcacucuucguagcuggaggcgauggugcugaacuugcuaucccaggucuccccgcuccgauaccagcucugaaucuggaaaaggagcuccacugucgggcuuaagguggccacugccccaccugugcccacccucccaguacccuggggcucugcugaggccucccucaccugcucgcccgucucuggguugaucacuguuuccuggucaaaguugaaugcuccuuuuucguccugcagaacacacggugggugagggaaaggcgcccccaacuggauccaggccuccagccccagaauccacaggccggaaaguggcucaggaaggcaagcgggagcgcaggagcgggcggcgggagcagcaggucuguccacacacugacgccugcacagcccugagcccugugacgcuggcugccuccucagagccauugggagccugagaaccugagcugccuaccccaccacacagagaggaaaacugaggaccagacagccgagggacuugccccaaguccugugaggacccagaucuggugucuccagaccccagugggagaugccccaauggguaggccagacagcccagcugugcccaccacgggcuccuggcacugccagaggaggccacggugucauucucacccucccacugcaugccaugcgucuuucaugcagcauccuuugaauccucacaaccaucuuccgaggacagugccacuaucaccccacuucacagaugaggaaacugaggcucagagccuaagagccccacacuggagucagagcacacaaccuccguggacgcugucucucaacacuaacaccuguuugcugucagggcuuacuguguguuagggcuuacugucuucaccuuuacuccucacaacagcccacacagcaggggucaggaaucucauuuuacagaugggccaacugaggcucggugaaggugcugaauuauccaaggccacacacagccuugauaaagucuggacaaggcguuucgccagacugcugacccagcagcuguucugcgcauccuccugaccccagggcccaguuccagcccuuccugauccagggaagcagccccacaccccgagaagcaggacccacccagaaccccgcccucggaggggaggggccacaccucaccccauuucuggucaucuucaugcuggggguccacaucagcuuuucagccccccauaaaugacugucuguguuuccauauucccuggguagguauggagggggcuccagccacucuggccggcuggcaagaagggucugcucuggggagaaguggcucccuacgauacccggaaaagcccagguuccacggaacagcagcgcaaacaaagacagcacugcugccucagaugggagcacccagagaugcccccugccccaagugucuguccuggggcugcuggagccacgcccuaagcacgcccuuagggugugcuuccuuagccugagccaaacaauuccuccuggugcggggaacagcagcugaacugucccgaagggcccucuacauccaggcucuacauccaggcucuacaccaggcucaucccugagccccagauguacacccaggcucuacauccaggcaucugagcuccugggacaucuugagggagggcaagacagggucuucucugccuaaggggccauuuuccccacucaacccauagcuccugagggcagaggcuggagcagcuucaccgcuggguagggcagguuguggggaguggagcuguaggcuggggugccagggcuggccacugccuucucaccuguacgaagagcuugccacugccauggcccagcagcucgugcaggcccaccugcacaucgaaggagggccccuuccagaggauguacagguccugccaagacaagcagagacccgcgcuguccacuggccagcccuggcuauacagccugucggccuccccuccccugggccauggacccaucucagugcaugugcuugguaaaggccaacugugcuccaccccacagcccauuucauccuugcaacaacccaggaggaagggagggaugccucccuagugugacccaagaggaaacugaggcuccaaaguccacacggucacaugguugggaaguggcagagccaggacugaagcuaugugcuuuccucucuacugcucugggcugucucucuuccugagucugcugaggaaggugaggcccagccccgacccuccgacugcuggcgcccaccuugucauccuccuccagaaagguaagcuucucccgcugcguggcguaggccacagccagcacauuccccagcgacacguucuuaaagccuuccgucugccucagaucaucgucuggagaagguggagaaggaccagaaagaagaggugagggucaaagguaacagacaagaggcacagagcaguuuguggaggguguguguguggacagggaggggcgacucuaaaggaagguuucuggggcucgggggcugggccugagacacucacaguuggggauguugaugccggcagggaugccggagccagcgaaggugagaacauccagggaggugaagucaggggugaggaacuuguccuucucaaagguugggggccagggcagcuccuucagcagcugcucugcgcucgccaccagccgcucaaacuuggcacucauggccuuguucaccacagcuacgaaaccugcagaggagggaggggguuguggcuuggcaggguuccaggagggcucccacuucacccuacuccagccaucacgcauguacugaaugccuacuguaugcagucacccugggcuggaagauggggauagcagugacccaggccugggcccuacugggucaggaccuggacaggaaagaugcagcugcacaaacccgucucucccucaggccccugggccgccugccccuucucccugggccugggucaucccugagccccaacaggugugugcucuccucccaggcuaaucucuccagcuuuagcaggcagaugcucagacucuucuaaauccaggggcuggggaggauuagggcagucagagaaguggcugaauccucaggcuggaugcccugccuugcacagguggguccccuggggaagggggugggggccgcggcagccugccaccagccugggaugacagccccgggucagguccacagucacaauguccauccugcuuccagccacugagugcagcagucugcauccuaaucacauuggugcucagaggucuggcuauuuggcccaagaucacacagccuaggagugguaaagcugggcuugggaggcacauggcuaccuggagccugugcccugaccagacaccagaggcagcacagcaaaauagcucagagccaggguuccugggccaccccccaacugugccccagugcucacaucugcaaagugaagauaaauauccucaugggaugauggacucuaaauuaguuaauauagcuaagcuucuuacaacagugcccaauacauuguaaacgguguuuauuuaccauggcuguucuuacuguuaugguuauggcugagcggggguggggagaaccaucaggggacacuggaaacguggacuuggaugugggggaagggacugugacugaccuccucccugaggaaguuaccuucaaauucuccucgggaaccaaaggggucgcgguagcucucgaugaacccgauguaacugggggagagaagggcagagguggaggaggggcaggcaggagggggcaggugggguggagcuggcgccucaccucuccacgauggggccuuuguccuggauccagaagcgggagccccucuugugggccucgauggagcccugggugaagcucucuauauacugggccagcaucugccccugguggcuguuggcugcauaggccugaggugagcgggggucggucagccucgggccacccacccaccuccacacccgcucugcugcccagagggguccucagcccgcaccccucagcccccagccaguccaaccuuggcuuucuccagcugcuccaccaccuucuggaggaugggcgcguaguccccccgggucaccuggaaagggcuuccccggaauucauagcucuucagcuuggaagucaccucagaguccagggaaggcucuggggaaagaaggugucauucaagagaaaaggcuggaguaagaggccucacucagagaaaaggccugaguaagacaccucagccggcuuuuccccauagcacucuuucacucuaagauuuucaauggcucccuguagccaacagacaugagcauaaacucucaacuucaaaaaaauauauaucagccgggcaugguggcuuacgccuguaaucccagcacuuugggaggcugagacgggcagaucgccugaggucugaaguucgugaccagucuggccaacauggugaaacccugucucuacucaaaauacaaaauuagcugggcauggugguaggugccugucaugccagcuacucgggaggcugaggcaagagaaucgcuugaacccgggagacagugguugcagugagcugagaucgugcugcugcacuccagccugggcaacagagaagagacuccaucucaaaaaaaaaaaaaacaaaacaaaaaaaacaaaacaaaaccccaaaacuaaaaaacaaaaauauauguaucacauaacaugugcuuuccguguguuaacuccuuuaagccugacuccaacucugggaggaggcggacauuaucauuuccauuucaccgaugggaaacuaaggcaccgagagcuuaaguggauagcaaguggcagacuggauuuaaaaagacagccacaucccaaauguaaucgacagucccauggggagacaagagggugacugggaggaggagcugugacgauagcagaggggagcuggagugaaguuggggggcuggacagccuuccagaagcuggaaaaggcaaggaagcagguucuuccugagacuccagaaggaaugcggcccagccuugcuuuuagacucuggaccuccacaacuguaauagaauaaguuuguguuguuuugugccaguaaauuugugguaauuuguuacagaagcaaugggaugcuuacacacuacuguauuuuccuuguugucucugaucaauaaaauauacuucaaggcuauguaaaaacaaacaaacaagcaaaaauagccacaguauuuccugucuuacugccuuuuuuuuuuuuuuuuuuuuuuuuuuuuagauaggaucuuguaagguugcccaguugaucucagacuccugggcucaagcgauccuccuggcucagccuccugaguagcugggauuacaggugugagccaucauauccagcucaacugugacuuugcccauggagaugugggaucuguguucccuccuccugaagccaggaaggcugugacuucagcagcagggacaccaugugcuuaggccaggucacacaaggugagcaggcuucugccuggcucuccugggaugcucacucuuggagcccagcuaccacgaacaauaggagggugccacaugagguauuuuagucaacagcccagcuggguuccagccggcagccagcaccugcgugugagucaacaagccuggggaugcuugcggccccaagcugucgucuucccagcugaggccccagacauggucacccagcgaccggcuguuccuacugugcuccaccugcauuccugacccagaguccaugagcaugaaaaggugguuuuguaucacuaaauuugcggagcauuuguuccacagcaauagauuaugacccacucgggcaguccggcuccagggccacauucaaccacugcccgaaacugcaucuuguacucuaaguauaggcccagcuuauguuccagugagauccacuccuguuccucugaacccacaucugccaucaucuccccaguggaugcucggauccaccaagcgcuaggcaccagggagacaacaguggaugaaacacacaggcccuccucucggggagcuuguagucagggaagcuacugaaugugccgaugggaagaaagaagggcacagacucaguuaugggaagauagggaaagguccuggggaaggcaaguccaugcauggccuagaggauggggaggagguggccaggggacaaggagaggcuggaggggguuccgcaugagaagcagggaauggauugugcaaagaccuggacaggggccaggcgcgguggcucacgccuauaauccagcacacugggaggccgagaggcacgcggaucaccugaggucaggaguucaggaccagccuggccaaauggcgaaaucucaucucuacuaaaaauacaaaaauuagccagguauggugaugggcaccugcaaucccagcuacuggggaggcugaggcaggagaauugcuugaacccgggaggcagagguugcggugaaccaaggucgcaccacugcacucuagccugggcacuccagccugggcgauacagcaagacucugucucaaaaaacaaaaacaaaaagaccuagagaggguccaucagaacuggaugcuguugagcauggccagagcacagagucugagugggaggauguggagaugaagcaggggcuggggugcgaguggggaacaaagagccagguggcaaaggucuucauaaaggccuggacacuucuguccauacuauuuccucucuccugggaauggaccccaauuuccccuugagaauaccaccccaggccccacuacuacuaccccaagugcaggugguuugggaagggccagccucuuuuuuuuuuuuuuuuuuuccuugaucuggagcuucgcucugucacccagguuggagugcagugguaagaucucggcucacugcaaccucucccuuccagguuuaagcgauucuccugccucagucucccaaguagcuggaauuacaggcacacgccaccacgcccggcuaauuucuguauuuuuaguagagaugggguuucaccauguuggccaggcuggucucgaacuccugaccuuaggugauucgcccaccuuugccucccaaagugcugggauuacaggugugagcugccaugcccggccugaagggccaaccucaucgccugacuccaggguaggcuugagaccagguugagccaaucagagaccugucccuugccagcccucagggauugguucacagacaaauaggggacugauuuagagaaacuagagccauucccaggacuuauguagaaaauccugggagagaaggaugcucuuucugaaggaguggcagaguugguaggaccugagccacccagguccggaaaugcccaggagggagcagaagggaagccuggggcuaagcucaccugagccaagcacagaagccagccgcaccucguaguagggcuucccuucuccaucgaccucuuugaagagccggguguuguaggcacugagguucuagaagagaccaggacagggguuaagagugaagucuggagagggcaguggggugggaggaaggaaaaugggucaacccuaggggagaaggcauggaggcaaagcaggcugggccuucuggguuggcugggagcaggagugggagagagugggagugggcagcccagggccgacucuccugcucugcucaggacacugugcacuucuacuaagcacugacugcaaccacugugccaggcacugcacggccucugcgaacccagggcuacuggagguggguaccacuucacagacauggaaacugaucacauggcuggugaguggcugagcugggagcaccacugacacauggaccccggagccucacaccccuguggccugagguccugguuccucgcccugcccugaggcugucauuaggcucuauagccuggggugggcaggggucgcgccuucccuaguacacagggaguagucaagcagagacccaggaguggucaccaguugugagggggcugggacuaggaaccccaccaaaccucugcuaccuugagcuccccuaaccccaaaccugugaguccagaaaguccugggccaauuuggcaucuuccaugguacaauucccagagaaauagguggugauucccuguuggggaagacaggggacaugagaaagaggaguugccaaggucagggcugcagggacgucauauucccaggcuucccgccccucccuccuuucagcagccucuaccccuuaccccuccaucuaccuccaggggaaaaaguuauaaaacaaacaaacaugcucaucuccaguguugcugcagcucugcccaggccucucucuggcuggcccaccccuaaggcuugccaagguccucaucccaugcaacggauguggccuccagaggugggaaaccugggaccccccuccuucccugccauccccuccucagcucccuccaccuccagccuuccucuccuucccuccaucagcacauggcauccuguguacagaaugucagaucugggagggcauucagaaagcauucgacccaacaugcuuaccauucuacagaugacaaaacugaggccugcaguggggagcagcauugccucaggagugugaggcagagcccacugccuccccaucccguguccuucccuccuuaccagguggccuugaaggauucccuccacucccuguccccucgggggagucaggggccucaccuccuuccccaguccgaggugucgaagccuuggcuccagagagaacauaagcuccccgcaggucugccagaggccccugacuucuucugggugcugcugagcagccucacucccuaggaucacccguuccagcuuuuccugcaaggaaagggaggccaauggcccagucacaccacccaaaccugccuuccagagccucccuacccacucccaagcucuucuccuaugaucuaagagcucuggcucauugugugguccauggaccagcagcacuuguagguccugagaaaugucaagcguccaugugugguggcucacaccuauaaucccagcacuuugggaggcagaggagggagagaugcuugaggccaggaguucaagacaagccugggcaacacagagagaccccaucucuacaaagaauaaaaaaaauuaggccagacgcaguggcucaugccuguaauccuagcauuuggggaggccaaagcaugaggauugcuugagcccaggaguucaagaccagcuuggguaacacagugggauucugucucuacaaaaaauuuuuaaaaauuagccaggugucauggugacaggcaucugugguaccagcuacucuggaagcugaggaggaucaccugagccuaggaaguugagguugcagugagcuguguccgugccacuacccuccagccugagugacagagugagacccuaucucaaaaaaagaaaagaaaagaaaagaaaagaaaagaaaagaaaagaaaauuuagcugguguggugcugcauacccauauucccaacuacuugggaggcuaagccaggaggaucacuugaguccaggagguugaugcugaagugagucaugaucacaccacuacacuucagcuugggugacagagcaagacccugucucaaagaaaaaaugucaaaucuuggguccaccacagaccugcugaaucagaugcugcaugucagcaugacugccaggugacuugugugcauauugaagucccggcucuuauaccugcuauaagaaccaccucugcccgagauaggcucaagucucauaacccugggagggaugcccccggcccagcacuucccacuguuccuggugaugaccaacaagcuccauuuuugagagcaccuaaaaguucacagaacacuuccacaucucgcccuuguucagccugcggaucagcagucagggcgaguggugcuuuuccuuuauacacgaagaggccgcagcacccagugaggcuggugacacccacagucaugcaggguggaagcgacaggguccaugcucugcucagggcuucugacacuccaguuggggcuccuucuacugcauuuuccaucucuaccccaccagccccccauccccaccuuccccaacccucccuuggcucaccuugggcaaguugggaacaaacuuggugucaccaaaggacuuguaguugcccauguuggaguaaacacccgcggcauagaccaggaacgccugagggggaggcaggcaucagagacccaggaagcacagccucccugaccccagcgacaccuccuccugagaugcgaaugccccagcagagccagugugggugaggcugggaaaugugugggcaggaccuagguccugggaagccccagucuggcccacacucacuuccacagacccauuuucacacccccguugucuggccuaacugaucuucugggcaguucccaaacacacccaagcauucgucugccuuuucccuccccaccccagcacccucucagccaccugaagcuacuguguccuuuaaggcccaguuccagcagcaccucccucuuucuccagagccuguccucagccucugaccugucaggcagcuggccuuggaagcaucacauguuagagccggagaggccuuaaucaucugucuauucuauggcuucugcuggccccagaucuuccucugguaacaagaccucaauccuccuuuugugggugggaggguggggugggggaucucccuucccccagcuccaggggugggcauguaaccuggcucagucagucugagaaaccaccauccuuggcuacaggauggacacaaggcucaagcuggcauaagagagcuacccaggacauuucccauuggcaaagagccucuguacaccagggaucaucaggccuggaacuccuggagcuccccuccaggaguaagaaaagcaagcaagcugagagacgaagacugcaucccagugguagcacugaguccgaguccagccaugccugaaacuuccucuagaccuggacuuuucaagcaugugacccaacaauucuccuuuucauguaagccaauuugagcuggguuucugccacuugcaaacauaugaauuccccuaaauggccaggcgugguggcucacaccuguaaucccaagcacucugggaggccgaggcgggcagaucacgaggucaggagauugagaccauccuggccaacauggugaaaccccaucucuacuaaaaauacagaaauuagcugggcgugguggugcaugccuguaauaccagcuacucaggaggcugaggcaggagaaucgcuugaaccagggaguuggagguugcagugagcugagauugugccacugcacuccggccuggugacagagcgagacuccgucccccacaaaaaaaaaaaagaauuucccugaaaauaauaacgcuuggguugcaccuuucuguuuauaaacauuuccacggauauuagcucuuuuaaugaguaagccaaggccucaagaugggaagugaaugcccaaaguucaaaagagguagaauaaacaguacaucagcucagagagaaacaauccaaucccuuuauuucacauauagaaaaacaggccauauucuuguacauucuuggugggaauauaaugcagugaagcuuuuuuagaagaugauuuaacagaaucagucaauuguaaauguacagagccuuugacccagcaguucuucuagaaauagauccuccucacaugugugcacaaguaugcucaccauggcacuguuuguaagaaaaacgggacaagcuaaauguccaguaaugaagauuaaauugauuauaguguacacugcuguggaaugcuuuacagucaauaaaaaagaaugagguacauuuaaauguaccccauucuccaaguucuucaagacauggcauucaauggaaaaagcaggacacaaagcaggaaaagaacauuaucucauuucuauaaaaaagaaaauaaggaacugauucaccaugcauauacacauaaauguauguaauacacagaugggauugaaaaggcuguaaccaaggcugggcacgaugguucacgccuguaaucccagcacuuugggaggcuaaggcaaguggaucacuugaggccaggaguucaagaccagacugggcaacauggugaaaacccaccuguacuaaaaauacaaaaauuagcccggugugguggcacauaccuguaguuccagcuacuugggaggcugaggcaugagaagugcuugaaccugggagguggagguuugcagugggccaacauuacgccacugcacuccagccugggugacagaaugagacucugucacaaaaaaaaaauaaaaaauaaaaaagagagagaaagaaaaggcuguaucagccucaguggguuaccucugaggagggcacugagaaugagugaucuuuguguuuucuuuugugucuuucugcauugcugcaaugcacuaagaauuuguguauuacuuggccaauacauccaaaaacaaaaaccaagggacaggcagaacauucugcccagggccacacagugugguagagaagaacugguccugaacucagaccuccugauaccuacucuggacuccuucuucugccuucccugaaucuccaccacaguuucuuuuguuauaaucacagcagccaucauuuaucuugaagucaggcacuguucuaagugggucaucacaacacuaagagguacagacaucccacaugcauauuuuacgggugagaagacugaggcuccagagaggggaagugccugaauuuguaaccuuuggucuaauccuccaccuaccccuugaaagagacagacauuugcauccuggucuuucacacccagaagccacucagguaauguggguuggcccaagagaacugaccugauacuccuccucgguaaggccuucagccagggcauguuggcgcagcuggucgggguccugggcgcggaagaggcggcugagcagagcauagauguagggggccucaggggaggucugaagcagcacagccaggccuccguaccaggcggcacgggacaggugguaggcauagaggcgcucugugggugacagcaggcggaaggccucacggcaguccaggcuagacacgccgaugucauugggcaggauguacuggguguccgccaugggcccugcugagaaccaucacugucaucacagcuguuguuuaccccauaccaauugcauaccuggcucugaacucuuaugaucucauuuaauccucccaaaagcccauguggaagggaauacuauuguacccauucaccagauaugcuaacugaggcuuagagaaggugagaugacucacccaaggggucacaaaauacacugguggaccauauuuggucuguagucccuaaaccuuaaagauugacucuaaggucaggcaugguggcucacaccuguaaucccagcacuuugggaggccgagguguguggaucaccugaggucaagaguucaagaccagccugaccaacauggugaaaccuccuuucuacuaaaaauacaaaaauuagccaggcuuggugccaggcaccuguaaucucagcuacugggaaggcugaggcaggagaaucacuugaacccaggagguggaggcugcagugagcugagaccgcaccauugcacuccagccugggcaacagagugagacuccaccucaaaaaaaaaaaaauugauugacucuaacuaccuaguauuacagauggggaaacugagguucagagaggcuaagagccuugccuaaucccacaauggagacaucagcagcagagauccucaucucuaggcucccagcccaggccccucccugcuuccuuguucaguauuauuuuuuuaagacggagucucacuuaguugcccaggcuggagugcaguggcaugaucuugacucacugcaaccuccgccucccggguucaagcgauucuccugccucagccuccaaaguaguugggacuacaggcgugcaucaccaugcccagcuaauuuuuuguauuuuugauagagacggggucucgcuauuuuguccaggcuggucucgaacuccuggccucaagcgaucugcuugccuuggccucccaaagugcugggauuacaggcgugagccaccgcgccuggccuuuguucagaauucuuuacacuuuccacugugcucacaaggauaaagugccaggccgccagcuggaaggcucagccuuuagccaggacucggccccagacuccuaaaagucaaguccauugcuucacuuuucuguaccuccguuuccuccucuauaaaagagagaauaaccccaauauuaccaggugggugcgcuaaucagaugaagucgcccuggacggaaaguauccacagcaauaaaugauuuugcuugaaacugucccauucucaucccucuaaaugccuuuuccuuggcccuccauucuccugcucgcucccugugcuccaccagggaagccacagaaguucacaaccagaagaaagcccauuuuacagauagggaaacugaggcuuggaaagggcaacaauuuacugaaggucugacagccccguuggaacccggggauuccccaacccggggcauucuccccgccacgccccgucccggcugggacagaguguccagccuccucgcccugccccggccuccagaagccccgccccaauagcacagccucgagguucggaaagggcuguuaacucuuugcuccccggagcacuccuuggccucgagggcggggugaauuuggaggggguacuggagagugggcagaaagggaacgauuuugcgcucaguauggauucgccuuggucccccgggaugacacgcuuugaccccaaaagcccaggcgccgcgccucaccugcagcagcugcuccguucgcaaacucacuuccugcuuccggcucccccauucauuggggcucugcg

SEQ ID NO: 18658 - RNA, 12148 nt, Homo sapiens
uuuggcauggaggaccucauuuaauucuugcaaaaauccugagguaugaucacuuuacccauuguacagauagggaaacugaggcuaagagguucgccgacuccuauaacaccacacaguucagauaucccuggccccaacauagagauacacacacacagucacucacauggagcagucuaucacuggagucauaacuccccagccuuggcucuuccccaugggaaugcaaaaggggucggugaggagcaacaguuacgaaucaacuguguuacaggugcucucuguauauucacaaccaccuggcgagguagugacuguuauccccuuuagcacugaggaaacugaggcucuaacagcuggcaaaggcagagcugggacaagaccagggcucugaccuccuccaccaauaccucugaauccuccccagcaucuacuguggugcccuuugcuggucuuuccuccuagggucugagguuccccacuggaaaugggaucagaauguuccccugccugguucccaacagggucagaagagagaacuuggaagaguuggauuuugagugcuuuguguguuguguguauguugaggggagagaaguuggaaugcucccacaccuccugcagcauccccacccuccccuucacccccacugcagcagugccaugcucuggaagcaagaaucugaucacacccuccuccuucucucaucacauucgggugcccucugucuucucaauaacccaggucugaucucccuggccgcaaccagcuguguggccuuggucagguccaucccuccccuuggaaucuguacuucccuaggcucugucaucuauuggggacgaugcccaggucaggccuauacucagagccuucuucucuucaucuccagaacagccgucugccugucuuccuggcucgcucccugcaggaauggucuggggcaaccccagcaacacgcccaccuguggccaggaugaauaggaauccaguucaggcuuggcuuccauggcaaucaaggcccaccaggccccagcaaccuucccuaccccccauuccuuuuugcugccccccuccacaccaggcauguucccugccacaccaugcuguuccccucaccugggcugcccucccaacuccucucugccucuggagaugcucugccauucaagacuuggcucaggcuccagguccucccugggccuucuagagccccugguucucacuccucugaacacuuccagccuggcuaauagcccacugcauccuggccugggguacagguggccagcacaggugugggggccagcuuccaacacaagcacggguaggucccucugcagaccaugggcugcaagaggcccggccuugcccacugcaggggcccugcgcagggcugggcacgaagcagguggguguccaccaaucuaguauccaaaacccugcuugguucacccccaccucuguugaaggaaagcaacacugugauggagaggagcagcuguggauucaaauccuggcuuggccacuuucuaguugugugacuuggugcaucugcccucaucuccucagagacaaaaauggcaacaccucccuucuuggguuacuaugaggauuaaauaacaaaaccuccaagaagcagagcccggugucuggagagugcucaauggacguaguuauuauuaucaucaucagcacagugcggggcacauggugggcauucagggaugauggcccuugugucacagccgacacucuugaccagugaguccucucuccucccuuuguugacuccugaccguccacaaaugagguucagaauccuccauccagcaucuucccuggucacauggucccaaccuuuugcuccacccccuucucuguuccccccgcaguccaugcuccagccauccugacucugucccuggauuucuggcuuacugacaccugagccugugcacaggcccucccuucuguauagagcacgcuucccaucuuguggacuugcuucccaucuuguggacucggaggguuccgagcagccguugaggcugagcuccuaugacaccuccuccgugaagccucccucacuuuuccauuaccagugaggccugccacagccugauuuguacucugauccuggcacgcaugaagccguguugccauuuguuaacagucuguccuccacuagacugugaacuccaccagggggggaaccaggucugauugccucuguguccccagauaccacuuagcacagagucgagcccauaguggcuaucagcaagugcuaggcccagccugccacccacccaccacucacuugggggcuggaggcauugcacgcaugcggggcaugugggacuugugggggcagcugagcagcgagguuuauagaggaacccagggcggcagcaggaaggaugaaggaugagugucugaaacuggguuggcaggcucagggcauagccagccuaagcugggggucaaaggccccuggccccuucacucccccaggggcacacagugucggcggcacgaugugggaugccccaggaagggcaaggccauggggcugggcuuuccuccaucgacccaggacagagcuggugcugaaggccccaucagcaugacugggguggagaucuuggggaccuccuuggggggccacaguuggggggaagggcacagcccauccaacauguccaucugguguggcugugccagcagggagugucccacaugcagagcucccucugggcugcaggagguggggaccugggugggcaggugggcacagcagcagggggccccagggagccuaauccagcgggcccuggaaaaugaggcggacgcagccaugcucgccgguaagccaggccccgcaaaaggggcaggcggcauggaaagcaugggugccguggggcaguggugucugggcccaguagcgggcagucuucucagagcagacguggccgcaaggugcaaaggcauggcuaggcggcccaggguccaggcagaggccggccuccuggccaagccauagaggcacauaaggccccacaaggcggcagagaggacauucgcgcuccugggggccccgcucccgccggcagccccagccgugguagccauggacgugcccgcagcggacguagacccagggcugcuguuugucgggcgcugugcggccacgggcugggcuggggaaggccagagugcugaggcccacggggcacuggggccgcgcugcauuugccuccugccgcugggccuccaguugcuucagugugggagcccgcagcagccccgccggugugcgccacagcaguguggccccacacaggucgaugagagagccguccugcagcacguuggacucguuuuccaccugccagaggcaguagaagggccuuacugcccaagaggccccugcugagccgcggguccaucccacagagccucccuggagaggacacccuggcgggcagggcaggcagggcagaggagcaaggcaggcuaggaggccaagugggcaggcaggugcaucccaggcacaugcugauccccccucccaacggggcaugggccuugguuuccccaucugucuaaucaggaagucugacccagacaggguuuuucuaaaauaagauguuuucugaagugcccuccuccugacagaggcaggaaaggccucuaaugaggaaugcuggguacuuagcucaaagcuaacggggaaugcuggguacuuagcccaaagcagcugucccaguaguuacaguuaaaagcaaaaacucaggagcuaggcugcccaggcugaauucuggccucaccguugacuaacugugucccuugucgaguaacuuaaccucucuccaucucaguuuccucauccucaagauggacugcaccuucuggcaucucaagugguucuugugaagauuaaaugaauccaucaggccgggugcgguggcucacgccuguaaucccagcacuuugggaggccgagacgagcgcaucaccugaggucaggaguuccagaccagccuggccaacaaggugaaaccccaucucuacuaaaaauacaaaaaguuagccaggugugguggcucaugcuuguagucccagcuacgugggaggcugaggcaggcgaaucacuugaacccaggaggcggagguugcagugagccaagauugugccauugcacuccagccugggggauagagugagacuccaucucaaaaaaaauaaauaaauaaauaaauaaauggaucaaucaguuuaaaaacuuagaacagugcguggcaaauagugcucaagaagaguaggcuugugaaacauucacaugcauuguuuuaacaaacaaugcuuccccagaccuccccacagaguugacgcucuggaaagaaaagccaggcuuuucucugagguuuugcaucuccuuggccaaugugcucaugccagagaagagcagugcauggccaguuugaggagcacggccaugugaccuuggacagccccugccucucucuaggacucacucccggucccuaaccucagcucucugaucuguaccacaaggagcugccacuaacaccugugucagaacuacuguaaggacccuuuccuccugcgagaggagaacagugcuaaaccugucugaacgugauagacaugcuacaaacugccaacccuuuaggcuauaaacugcucacacaugggccaagugucacucucauaagaaggugugauuuuuuuuaagcugccagcagccuugaagccaccugggacugcacaguaugucugugugugccuugaucgcaucacccccuggaccuccagugguaugcaugcuaugcuuggggacccuggucugucugccugucugugggacaaguggcucaugcuaagaacccccugggccugggauucccugauauggagccuguuggggcucccuggggcagaaggacuggagaucaucuccuggcuugggcagggggaugggcagcuugugagggccuggcaaggauagggguggggaauggagcgggccaccuaccagcuugccccgcugcugggcugagcggcugucccgcaauguguacacauucccacagaccgagaucucccgccagacacccggggcugaguccucggagaagccgccugccgggugcaucaccaggacuccauugguggucaguccauccaucaggccaucugggguccgccauuuggccgcucgcuccugggaccacaugagggaucagaucacaucccccaggggccccccagcaggccaugugccagaggcacugcccccgcuaccuucaaguucagaggcggcccagagaggacuggcauugaagcugcaugacuugagcgucucucugggccucacuuugcucaucaguuaggugggguugcuaacugccaggaccaccauuuggauuacugugggcugguucaucaccucaagaugcugcaccucccaagccuaccccuugccucacagaugaagaguuggucccuuccuggggcucacucacuccaaggaagauguugcuagaggcaucgaagccagcggcauagaugcgggcaguauaggguggccggcggucacagaggaugcggcaggcauagcgggagauggugcucugggcagaagggcccucggcagccccuccuccaggggacgugucuguuaccacgaagucaaucauguucucuguggagcggccaaucugugaggacagggagagcaagcagggacuguauguacauaggggacucucaugggccuucccucccagaguaccagcagcugcucuguaugcaaggucaccaaaaaaggaggcugccaggcccuggagaaggggcagcaccaacuccauaggcccucuaggcucccagguggggucuccaaguccaagaagccguggccuggagcagcuucuccuucucuguugcccccacagcacuagggaucgccccauucaauaaauacaaguugauuugcugauauaauuauaagagggugcucaaauguuagcagcagauagugacuucuaaguaacuauuugcuauaugccagccaccaugcuaaacauuuuauaugcaaugccuaaguuaaucuucccgugggguggguacuauuaugggccucauuuuacagaugaguaaaccaaggcccagagaacuuaagugaugcuuccccaaagucacccagugguaagugauggagccaaaaucugaacccaggcacuaggccucucacaccugaacuccugagcugugugaccucccacagucuaggagucuugaauuugauccuugauauagccacugacuugcugugugacucugcagucaacagcccacaccgggacauccugcuuccucgucuggagagaagcagcuuucccauggccucccaacccguagccucaccugaaaugcuugcagagccuagaggccugguggccaggagguguguggagaggccugagcauaccuggaacaugucugugucgcuaucauguguauacuccacuaugaccgaguggcuccgggacaguguauacgagaugcugugcugaccacgguuacucagugccugguggggagaaaaaagucacuugccagggugugcagccaugauaaguguaugccuugagcaagcaccuggagcucaaggcccagcagccacucccugggaagggggcagcuccauccuucucagaggguggacagugcagcagauguuucacaugauuuaagcccuacagucacccuaaggaugggguuaucaggcugggugcgguggcucacgccuguaaucccagcauuuugggaggcugaggugggcggaucacuugaggucaggaguucaagacuggccuggccaacauagugaaaucccgucucuacuaaaaauacaaaaaaaaaaaaaaaaaaauuagcuggguguggugguacacgccuguagucccagcuacucgggaggcugaggcaggagaauggcuugaacccgggaggcagagcuugcagugagcugagaucgcaccacuguacuccagccugggugacagaacgagauuccguuucaaaaauaaaaagaaugggguuauuguuccauuuuagaguugaagaaacugcaggucagagagaaacuggccuaaaggcacacagcuggaaauaucagaggcugaauucuaacccaaauccucuaaagucaaagguuuuuccuuuaucauugcaguaugacugucaccucccacucucugaaccuuggcugccucuaaaauggugcagcucauuuccacccauuuccauuuccauuggauggaaauaagcagcaccaucuuagaggcagccaagguucagagagguccagugguuaaggcaacauuuugcaaacuguaaagaacugcgcacacugcaaaggauuuuucaucaccauucucggauggcccaauaagcagugagugaugacacaaagugggcuccccuguuaaggugugggggcugugggcagguaggaccuggaaggccgaagaccugggccuugggcagggagggcaggaccucaggucuaugggucaguugcuugccuuggagacgagcggcguggagauguggugcaugacgucuggcuucaccccguuggcgugcgaccggcggcucagugccaggcggcuucgccggcggcccuuguccccacuugccagacaaccauuguagcuguagaugucggggguuaagaagaagggguugcaagaggagagagagaaagagagaaagugaaccccugaugagacuuggaggaaacugccaacuucuaggcagauccuaccuuaauaaacaagcucuacaagcaccugaaacuagaagacccuacaauaacaaauugguaccuuggggagugggaggggggugucagagcaguuucaaaagcacuuucauucaguuaaccaaguauuuccuggacacuugagccaugccuggaugggugcugugcacuggggcgguagaggugaugcaccacgggucaguugugggcccucaguggagggguuccucagcuucuccaggaaccuaggugccaccugccacacccaggcacaagccaaggaugccauaagccuagaggaagaaaagggaauucucgcccuaggaucagguuucugggagagggaacaccucuacuggguuuugaagaacuagaaaggguucaccuguaguaagcugucacuuaucacaccacuacucaaaaccaaaauggaaggaaaaaaugacacacaaugccaguaccuccauauguccauacaugucaaauuuccaccugccuuuccagcucuugucuggagggcauggcugugagaggcacagaggaggugaggcauagcucucaucgcugccaugggcugcugccucuguguuccuggccuucauguuaucaaucaccuaauggaaucugugcaguggccugccaggcaaguggcuuucugcccaucuuacaaaugagagaaaucaaggcucagggagguaaugugacuugccucuggcuaguaggugaaaauguccagauuugagcccagucucucugacuccagaagccccucuagauggaggcucacccuaagcaaagggcccaaggcuggcagggucugaugagaucagggaaugguggcuuugguggugaaguaugugggggagaugacacuggugggagggcucugaacuccaggcugaggacauuauucaacaaccaguggggugccaggaaggucugggaacaggaagugacaggacaaagagcugccaaauacagacaaggccacuugaaucagaaucuucuagugaguuuguuaaaauccagaugaggccgggcgcaguggcucacaccuguaaucccagcacuuugggagaccgaggcaggcagaucacuugaggucaggaguucaagaccagccuggccaacauaauaaaacccugucucuacugaaaauacaaaaacuagccaggcaugcuggugggugccuguaaucccagcuacucaggaggcugaggcaggaaaaucacuugaacccaggagguggagguugcagugaacugauaucgugccacuguacuccagccugggugacagagcaagacucugucucaaaaaaaaaaaaacaaaaaaaaaaaacagauucccuggucccacccacugcgacugugauucuguaggcuuggagagggccugucaauguguauuuucagugcccuccagccagcucugauaugcagccaguguggacucugcuccccaagggggcugacaggaggguccauacccaugggucugcagccucccacauuaguggccuugccuugggcuggaaagccaguccugccuuugggauaugaagcagcugcuuuuccaaggcagcuucucccaagggagacaucacuuuugcccuugugagcucuucucacacauggggggcaggucuugaggugggacaguucaggacacaggcuugggacacagaugggccuggcuuaaaucuggcucuuccacuuaucacaugaccucuguaaaauggagcuaauuuuuuaggaccuaccucgcagguucauuuugagaacuaaaugagacaaagcauuuaaaagcgcuuggcacagaguuuggcauauuuauaggaagcccuugauaaguguucacuauuacugcuuuuuuuuuuuuuaaagcaugugucaacaaacagccauuaaaaaaaaaucuuaaugauaauauagcuuaucaaauaguuucuuuaggacugauggcaaagagaggccaaaaggagauccagaugggggaggaggaagagggucugucccuggggaaagaucugaguggauggugcagggauccuggucaggcaaagaccaggaagggaugagguuggccaggccgccagaucacguugcuuccucucuccuggccuuggcuuucucaucuguagugugagggucagcuguggcuuagugaaagcgcacuagaccuagaguaagaaagaccuggguccaaaucccagcccugccacuuaccagcugugugcccuugggccagucacuuccccucucugagccucgguuuccucaccuccuuccucacagcaucuuugugaagauugaaaugaaauaauguccaugaaagggcuuggcacaggccugccucccagaacacucgauaugugcuaggcgcuguucuauguacuuuacagaaaucaccucauucauuucuuccaacaacccucugaggaagggauuauuaucauccccauuugcaaaacaggggaaacagaggcacagggaaguucagcaacuugcagaggcaggauuugaaccaagcaguuuugcuggagaaccagaguucuucaccccacaccacacacacuaggugcuuuaggaaaggcagcugguguuaacauuuuucucaucugaucaggaaguugggugguuagaguugucacaguacuuugugaaaaaugggaagauaaaauaauaauuaugaauugagguggguuuggucaauuuugucuuucagcuaggaaggugaggagggacaaacagcugaaggcccuauguggggggaggaggggucgggcccuuguucuggcugcguugggugggugucuggugcuucaccccuucuaggccagggaugcucaccccaggacgaugaguucaccauacuugaugggcuccucgccuggcugcgcaucuucaccgggagaggagagaacgcaagagcccuuguucccccggugcuggaggucugagguucggggggaccccacuucaggguuuccuuccagcaccauucugggcagagugggagagaaaagagcuuuguagguucccaccccagcccggcucaauuccagcugcagccugcugcagggccgccuaggcuaaggcaagggugaccuuucaccgccucuacugcuauggcaaccacuuccccucugccuccucuaaacugcccgagguugcugggauaccagggagggguggcacagugaagagagucaggauauucaguggugccaaagagauggaccaacuugggguggccagaggcugcuuuuuggccaagaucccagucugggaugugcuucaaagcggggcacccaaugaguugggggccguuaccccucaucucagacucaguuccugcuuauagcucuuagccucuggaccucugauuuagccucucugacagguucuuugaaucuaccuguccaucugaaucuuucuugccccuuugaggucuaggccucugucuguccaucugcuuucucaaugacucucuguccucccagccgcuguccuuuuugccgucucucuccccccauuccccaucucugccugucugcccgccuccgccucaccaucugccucagucuccccaucucggccucccccugcggguaggccaauagacuccuccugggugcgcgcucuucccucccucaggugucugucugcguccccagccgcccgggucucaggaggccugcggaggcggcgcuccccccucgagcucgggcugcagcacagccgucucccgcaggcagcccguuuggaaaacauccccgcgccagagggaccgcgccggggcaggcccgcgcccugcgccccgggcgggcagaacgggaaccgcggcccagcaccuacgcagguccacacccggcggccccuccgcacaacacgcgcgcgugcacggccccgcacgccccgggcccggacggcgcagagaccacccgcacccgcgaccgcagggacgcgcgggcgcgcagcagccaccggcgcccgcccucggacccacucccuccaccacccccagacacgcaaacacgccccccgcgcccgccggggcccgccuggcgcagcccccgcccccuccgccccggcggccucaccuggccacgcuccgggccccgcugggcgccgcucccuccccgccuagccccugcucggccccgggccgcugcggcgggaugggcccggcccgcggcggcuccgcgcugccucgucacggggacacccagggccgggggagggggaugagcgcgaacagccacgcuccgcccccuguccggagg

SEQ ID NO: 18659 - RNA, 1457 nt, Homo sapiens
ggaagaugaagacgaggccuggaaggccuucaacgguggcuggacggagaugccugggauccuguggauggagccuacgcagccgccugacuuugcccuggccuauagaccgagcuucccagaggacagagagccacagauacccuacccggagcccaccuggccacccccgcucagugcccccaggguccccuaccacuccucagugcucuccgucacccggccugugguggucucugccacgcaucccacacugccuucugcccaccagccuccugugaucccugccacacacccagcuuugucccgugaccaccagauccccgugaucgcagccaacuauccagaucugccuucugccuaccaacccgguauucucucugucucucauucagcacagccuccugcccaccagcccccuaugaucucaaccaaauauccggagcucuucccugcccaccagucccccauguuuccagacacccgggucgcuggcacccagaccaccacucauuugccuggaaucccaccuaaccaugccccucuggucaccacccucggugcccagcuacccccucaagccccagaugcccuuguccucagaacccaggccacccagcuucccauuaucccaacugcccagcccucucugaccaccaccuccagguccccugugucuccugcccaucaaaucucugugccugcugccacccagcccgcagcccuccccacccuccugcccucucagagccccacuaaccagaccucacccaucagcccuacacauccccauuccaaagccccccaaaucccaagggaagauggccccagucccaaguuggcccuguggcugcccucaccagcucccacagcagccccaacagcccugggggaggcuggucuugccgagcacagccagagggaugaccgguggcugcugguggcacuccuggugccaacgugugucuuuuuggugguccugcuugcacugggcaucguguacugcacccgcuguggcccccaugcacccaacaagcgcaucacugacugcuaucgcugggucauccaugcugggagcaagagcccaacagaacccaugccccccaggggcagccucacaggggugcagaccugcagaaccagcgugugauggggugcagaccccccucauggaguauggggcgcuggacacauggccggggcugcaccagggacccaugggggcugcccagcuggacagauggcuuccugcuccccaggcccagccaggguccucucucaaccacuagacuuggcucucaggaacucugcuuccuggcccagcgcucgugaccaaggauacaccaaagcccuuaagaccucagggggcgggugcuggggucuucuccaauaaauggggugucaaccuuacccaaggcuucugacccccacuggugcuuaagggagguucugggagg

SEQ ID NO: 18660 - RNA, 1457 nt, Homo sapiens
ccucccagaaccucccuuaagcaccagugggggucagaagccuuggguaagguugacaccccauuuauuggagaagaccccagcacccgcccccugaggucuuaagggcuuugguguauccuuggucacgagcgcugggccaggaagcagaguuccugagagccaagucuagugguugagagaggacccuggcugggccuggggagcaggaagccaucuguccagcugggcagcccccaugggucccuggugcagccccggccauguguccagcgccccauacuccaugaggggggucugcaccccaucacacgcugguucugcaggucugcaccccugugaggcugccccuggggggcauggguucuguugggcucuugcucccagcauggaugacccagcgauagcagucagugaugcgcuuguugggugcaugggggccacagcgggugcaguacacgaugcccagugcaagcaggaccaccaaaaagacacacguuggcaccaggagugccaccagcagccaccggucaucccucuggcugugcucggcaagaccagccucccccagggcuguuggggcugcugugggagcuggugagggcagccacagggccaacuugggacuggggccaucuucccuugggauuuggggggcuuuggaauggggauguguagggcugaugggugaggucugguuaguggggcucugagagggcaggaggguggggagggcugcgggcuggguggcagcaggcacagagauuugaugggcaggagacacaggggaccuggaggugguggucagagagggcugggcaguugggauaaugggaagcuggguggccuggguucugaggacaagggcaucuggggcuugaggggguagcugggcaccgaggguggugaccagaggggcaugguuaggugggauuccaggcaaaugagugguggucugggugccagcgacccgggugucuggaaacaugggggacuggugggcagggaagagcuccggauauuugguugagaucauagggggcuggugggcaggaggcugugcugaaugagagacagagagaauaccggguugguaggcagaaggcagaucuggauaguuggcugcgaucacggggaucugguggucacgggacaaagcuggguguguggcagggaucacaggaggcuggugggcagaaggcagugugggaugcguggcagagaccaccacaggccgggugacggagagcacugaggagugguaggggacccugggggcacugagcggggguggccaggugggcuccggguaggguaucuguggcucucuguccucugggaagcucggucuauaggccagggcaaagucaggcggcugcguaggcuccauccacaggaucccaggcaucuccguccagccaccguugaaggccuuccaggccucgucuucaucuucc

SEQ ID NO: 18661 - RNA, 6154 nt, Homo sapiens
ugguuuauacguuggugaguuucuaagggggaagccggccagggagcgagcccagaacggaccggacgccugugcacccccagcccugccccuuggccgcagaggccucagcccuggggagggagggggcacuggugcccccagccucuccaacccccaaacugcugcugcggggaaccccccccaccccgccuucagagcccucccccuuggacuagagcggcugggcagagcucuaaacaggggcaggggcuccucugccagccugugggcauggcagucauuccuggaaggggcaggaccuccggccuuguccauuucgggggaaacuugggcccugccaaggggcagagcuugacccuggaaauucugggccaucccccuccacccccacccugaggcucccccugcagguggggggguacccgcaccgggaaugagcaggcucagcaggggggcagccccaccccuagucugcccuccccucucccccaggcucuuucuccagcccugucuccaucugccccaaccucagcccaccuugucucuuggaccuauuuucuaugucgccuggaggaguccggcacccccuccccggccauuugugacaaaauaugaauaaacuacugcaaauaugugggccccgguucugcuccuggaaagcuugaagaggagaugggggccgauuacagggacuguauagggggcagcccuaagcugaauccccagccuggcuugucucaccccacuagcccacagacccugcuggagccccccagagggaucagacgccuuccagguccccucagcagccuccuuccaucuucucuuucccagcugaggcugcugaaacccuuacaaggcaguaucaaggucaccaaagucaugaagcccucccuggguccaccuucuuccuagacggccccaagcccgauccccugggcaaugcagaggcgcagagguaucuguagcuccccaucaggccccaggaacaagggucagacaaagucaaggaaaucaaaucuucaaugaaugaaaaacucagugccaucuggggccagggggucaccggaccagguggaaagucagccaguauaugaugaggggcuggaaggcugcagcucccagagucagguagagcuggagacgcugccgggggacggggccccccaugcugucggggcccagggcugcuguccgcaaagagcgcaccuggaagaaaggagaacugaagccuggccaggagggggagguuugcccucaagugaaggcaggggaaugggggggugcaccagacucacaaugaaguacaugagcgccgaugagguccaggccagcgccacguaguagccaucgcugccgaacagcagccccgugagcacacugaggaucauucugggggugggaggaggaaaggguuggugacccccaggggucuaggccugagauuggcccuacccccaacgcccagagcccagcuagaccccaccucccacagcaccuuuuacucucaaucuguccccacagggacccagaccccaaagggauauggaaggcccaggacucagccccaggaccuggaucugagacccccuucucuccccaagacucgcagagugacucucaacaccuccccaaccucugcauggcacgcagauccucaggagacugcuggagacagcugcucccucuuaacagagcagugcuagaggucacuaggggccgagacauguccagggucacaguucgaggcuacagcuaugcaggcccagauccaaggccaccucccccuggcccacaagugcucaccccacguauuuguagccacuguaggccagcaggugaaaggugcucaggucacugcgcacgguggccagguagaggcccaggagcagggccagcaccuccaucaccacccacaccagcgcugugcuugcacacaggcccagcaccuccggggagaaccugcgccaaagcagggguggcucagagccaggcauccugaggcaggggugaggaagagagacuggggcaacagagggugagcuggggaccaccacauaugcccuagggagguugggagaagagcucacagggaggggaggguaagggaggggcuuggcacugaccuuuucugaaugcccagugccaucccagccaggagcacguaaguaaugaaggccaucgcugccaagugccagagagaugccaucagcuuggcuuccuccaucagagcugccuuacuaggcauucggguucaccgacaugucccauacuuccuucucugaauagcccagcauggccugaccuccacauucugcuuccaaaugcccugccuggaaugccugucuccgaucagcccucucccacuguguaaaugccaccugacccuucuuccagaaccacaagccaccuuuccugucccugugcugggaagcucaucaguguucugcugcaucucagaaacuguaucaugggccaaggccauuguuccgccuauacagggaccaaacugguuucuggcaagaccagaagccagguucaguggacacccaugcuguccugagucuggggucauggagaugaccucaccgcagucagcaauucuaagucucagcacuggcuagggcucuggcugcccaacaaugcagggaacuccaaguuuaacuuugggcaguauucauaaaagcucagagccagugggagccgggcauuagcagcaguuuuaacucugucuucugccccgcuuaaagcacuagaauuggcugggcgcaguagcucacgccuguaaucccagcacuuugggaggcugaggcaggcagcucacuugagcccaggaguucaagaccagccugggcaacauggcaaaacccugucucuacuaaaaauacaaaaauuagcugggccugguggcaggcgccuguagccugcagucccagcugcucaggagacugaggcaggaggaucaccaccugagccugagaggcagaggcugcagugagccaagaucacaccacuguacuccagacugggugacagagugagacccugucucaaaagaagaagaaaaaaaaagcacugacaugaccaccagcggggagugucuggaguucuggagucaggaaaucagcuguaccaccugucaacuuugaggccucaaugauacugaagcuccucugaggcuuggcuucaacauguaaaauggggaugccaguuccagccuuacacgguggcuacgaugggcacacgggaugaaggauggaagccccugugcugcccagcacaccuaggcuggcugccugcccucagucccacuggcugcccucacuggaagcucaucugcgggcuggucccugcacacucacucacccuggguguccacgaugggccuggcccugugcagccaacaggacagagaagagucagcuguaugugugggcagccugaaaaaugccauguggacaggcaguugugggaacccagaagggagccaccacuugcucagggggucaggaaaggcuucuuggaagaagggauaacagagcacgccuuggaggacaagcaauaacgaugauaagaguuaauguuuccuacguccuuccugugugccaggugaggugcugagcaaacaucaccuugcugaaucucuccaacaguccuuugggguagggacuacauuaguccuguuuuacugaaaaguacaaauaaccagccugaaaucccauagcuggagucugcaaagccaggucuaaacccagagcuccaggcuggggagggauacaguccaaaucaagaaacaggaaggucucaaaaggguguccuggggacacugaaggcgcauucaggaagcuccuuacuggucacccugcacugccugccuggugucuugcaacugccacacauacacaaagcaccaagaacagaugcugacucaguagcugcgccucucuucccauucaucccucaaggcacaagucccccccgaccccaccccaccacguuccccagcccagguuggagacucacuggggauauagaggucaggggcguugaggucuugccgggggggcagaggagcaucacgacuguacugcacuucccaguucuggcaguggcaguggcagcagcggccacaucaggaggggaagaagagaaaagaggagagaaggggguugaggucugggggccagacucgggcagaaugaggaaggcccaccagcucccuugguaggaagcucaccugguguguguaggggaagaccagcagcccuagcuucuuggccacguaggcuguguccacagcaaaaaaauacuugaguuugcucacagacacaaaacggugcagcugggaggggagagaggaagcugugggcaagccgcaccccaggccucagggugccccucugugugcuccaucccugagggcacugugaggaaucggguggaaucccaugaugccccagcccuagccaaaaauucugccacccgugccccgggggcaggccacaccuccuugugcaccauguccuucccaugggaugcgauggagcugccauaggccauagccacauuggccauuggguccccaagcaagugguugacacugaaggccacgucugcuccuguggcuggguaucccccgggcuggcuggaauaaccaccgcuugugucaucgaagaggggagggggauccggggcugcccgggcccugugcuuggagccuguggguuuggagguaucagaguagaugacagaaauaccaagcaugagcccaaaccaccgccccuucccuggcuggacagcccugcacggguccuggaggcaccgaucagugaggggaccccaagcugggugagggggagcuaacugagaaaaaacugugaugagggauccuuugcgagaaauccguugcuaaauguaggcaaagaaagagcugaggcagcgccuagaacugguugcccacuugggguuucugaaggccucucacuggaagugaccucugaacugagccacagugaguagaagugugcuaggugaaaauaacugggagggcauccuuccgugaacaaagcugggagaggcgacagcuggcuaccuggaggcccuggacagugaucagggaccucaucagguucacaacagucaaaggaguuucuggaggaggaggcggaccccguuuuugcccgacuccggcaugggauucccaggacugggccgagagggcgaaguccgggacguguuggaguguuacgaggggcaggaacccgagugacacccccgcccugggcggcggucccagucgcuaucucccucggggugagcgggccacgccgccgacucuccccccgccggccgcgccgcgccccgcccgcgccccacgcaccgugggcuccguagcccgagugauaagccauggccgcgacgcucgcuguccccgagggcccgcugcgccgccucguggguacgaauacuaaugaggcagcugcuccgcgcccaggguaccgaccgaggccacccggccgcgcgacacgucccccaccccgccggucucggccaccauguccguggcgucaucccccgcgccugccauuggcucuucggcggcgccggcucgccccuccccucucccaauuggccacugacgagcucuggccugagcggauucggcagaaggcaacauccgggugagggacaggcggagcgacuugcggugccugggauuggaucacgggcuugccaguucacggugggaacagccaauagaagaguuaagaaagaaggugggcgagaauuauuugcgcgccugcgcggugaggcacuugacgcacccugccacgacuacaccagggagucgagagguaaccugcagccggagucaggagcaaagcuuccuuggugggacguacuccaggagggaacggggcggucgaguuccaaccaagcccugcccuucggggcgccuguuucucccucucugggcuuguuuuccucccccgucaccuacacuucacccaaucuuggaacggagccccggcagacccggaggugguggugggaggccggaccuaucagugacagagcugccaagcaagccccaggaugcugacuccacccgccucccacuccucuucuccgcgcgggugcuguccgucgu

SEQ ID NO: 18662 - RNA, 757 nt, Homo sapiens
cgggaccgcgcccccuaccagggcuggcccgauccucccacaggccgcgcccaugacgacccccuccccuaggccgacccggagucuccucccccgcuuuagggccugaccccgucucccggcccaaucggcccgcgccgaccugcgccuggugcucgggcccggcuccgacucuggcugccucccgcuucacccggacccgcacccgcgagccggucccgccgccuccaucccgccggccuucccagcagcccccgcgccgccuuaaaggugaagccgcuaccucgguggcgucggagggggcgaaacacgcuucucuuggcccguucgcugccuuaaaggagcgcgggccgggccggcuccagcgggagggggacggggcggggccaucgaggcgggggcggugcgaggacccgcccggggcgcaguucccagggcccgccagccccgaggggugcccucggccgcaaaaugccgcggggccucagcguguggagcugcucgggaggucgaacccgaagguaccuaguguggcgccauggcgccaucgaggacgucgggagaaacugaggcgcagggagaagguugggcuuccuggaguacagagcgaggcgccacuaacugagcgccuacugcguguugcgcgcuuuggugcccuggguucauugacuuaaugcucacgaagacccgagaagugagugccgcuguuaucuggcucgcagaucugaccccaggcuccgcaucccggggucacauc

SEQ ID NO: 18663 - RNA, 757 nt, Homo sapiens
gaugugaccccgggaugcggagccuggggucagaucugcgagccagauaacagcggcacucacuucucgggucuucgugagcauuaagucaaugaacccagggcaccaaagcgcgcaacacgcaguaggcgcucaguuaguggcgccucgcucuguacuccaggaagcccaaccuucucccugcgccucaguuucucccgacguccucgauggcgccauggcgccacacuagguaccuucggguucgaccucccgagcagcuccacacgcugaggccccgcggcauuuugcggccgagggcaccccucggggcuggcgggcccugggaacugcgccccgggcggguccucgcaccgcccccgccucgauggccccgccccgucccccucccgcuggagccggcccggcccgcgcuccuuuaaggcagcgaacgggccaagagaagcguguuucgcccccuccgacgccaccgagguagcggcuucaccuuuaaggcggcgcgggggcugcugggaaggccggcgggauggaggcggcgggaccggcucgcgggugcggguccgggugaagcgggaggcagccagagucggagccgggcccgagcaccaggcgcaggucggcgcgggccgauugggccgggagacggggucaggcccuaaagcgggggaggagacuccgggucggccuaggggagggggucgucaugggcgcggccugugggaggaucgggccagcccugguagggggcgcggucccg

SEQ ID NO: 18664 - RNA, 855 nt, Homo sapiens
ggaagguggaaaagggggcuuuagagucgcccuucccccaggucggcagcuggagcucagcccgggcaggccugcugcucucccggcuuggauccccuuucagcccauucauccgggccugggccgggggugggcgggcagacaaucagacacuguuuuaucccaggcaucggcuccagccucccgcuuggcgcccgcaacgcggggccgccggggaaaugagucucucgggacucccugggagcguaagcguucgaggaucugaccggagggccgggccggaaagcuugagagccuucgcucccgcaggugaggcgcagaaaacacucccucggggaagugccagcccuccucgcagccccgcccuccggcccgccgccggccuucggggccguagcggcgcgcagggcccgcagagaccgagaccugcgcacuacaacucccaggaggccucgcgaccagaccgccgaggggccacuagagaaaggugcgucugcggcgaaucccgucgcccagcgcacggcagcgggugugccugagugcgcgucgccucccaaccagagaggacguggcauacggcgccaccggaaguuccggcaagugggcccugaggcuggccccagcuuccggguuggucgcgcgccuuccugcggcuaagauggcgacggagcaucccgagccucccaaagcagaauugcagcugccgccgccgccaccuccaggccacuauggcgccugggcugcccaggagcuucaggccaaguuggcagagaucggagcuccgauccagggugaggaacacaggaagucgaggggccuuuacgggccugcggagaagcggagccugguuacccg

SEQ ID NO: 18665 - RNA, 1903 nt, Homo sapiens
gcccagucaugaaagccacugacuuuauugaucuaaaaaacuuuacaaggacagugacuguucugccaaaaaaggagccaaaugguaucaaacggauugaaagugagggugggggugagggauggggccgggaauccauucaggaaagcugguaacugucaccagggaacuggcaagggaaaaaggacgggggaggcaugcaagagcgagaauccaaaaaaaaguugaaaugguuaggggagaaaacucccaaaagaccccggaguacgucggaggugaguacgacaauagcaaucuuuuccuucguagaggacaggggaggagucccuacucggcugcaaacucuggaugagggcuggggauugagagcuucccagagagcaucacaagaaggcgucgcaccacucucgaaggcauccgaagcagucccgggacugcuuggcguuggcgccacaagugucuuucagccauucccggaagaggucuucaucuuucuuuagcaccagaaacuggccaaggacaacauaggccugcaaaacagggaaaaggaaggagcgugcugcucagugcucagugagagauaagagcaagacagccauuccugugccauucagagcacacaagcccaggaagcagcgcggguuuugccccccucuccucuccaccaggugcccaggcucuggcagccucuucagauuauaccuuacuguccaucccccagcagauggaaucacuucccuuccaccccccgcuugcacuagguacacgcagccaccccacaccuugucaaaaccccuuuccuccagcuucuugcccaggacuucaccaaucccagccaggcuccccacuggcuucucccccaugggcucugccacgaagucucggugcuuuugggagguugucaucuugaucaggcuuaaucuaggaaucccaaaaaaaaggcagauuagggcugaagaccuggaacuucuaagggcccacgagcaaucucauaguaagaggaagccaagccagggguuacaguggcuugcucgaucccccucauccugaaaggagaaaacaguuccagggagacucuucccuacuauuuuuaagaggaguuucuuccugcaggaccuggauuuugaucuugccccagaggaaaaacgauccugccuaacagguggcgcaagcggggcaguggaaagaugcccagaguccguagccagggcugcgcggaagcuaucacucccucugugaccuuggcugaaccaagacgacacugccugccuggaacggccacuuggcguggaaagcuaaccaaagggucucucuaccuacagggcgaagcgcacaccuagcgcugcgcacacccgcuccccgcccgcgggguucacgccgcgccccagcuccgcccccaccgcgcgccgcugcggcccgccccuucccgcggcccggcucccacgcgcugcaccccgcccccuccccgcagcgcggccaagcucucccccagggcccgccacagcgccugcgaccccucuccuccccuucuccccgcaaccccucuggccuccaaucagggcccugcuccgcggcuggcgcucacccgcaacuucaguucccguaacgguuccucccgccacccggccgcuccugcggauaccucaagccacuagaacuuucuuccacuuccgcuuccgggucgcuucaagagccgccuuuaaaaaagaaacauuccacguugggcacuucuagccaguuagagcuauagaguugaggcgccccggaccucgacggcguccuuaguaggcgcuccuuuccgguccuucgcgggaagcccugccuucuaaggucucgcuucucgcgcaguucugagggagauaggccuccagggagaggacuuccuuucucugcugcccggacc

SEQ ID NO: 18666 - RNA, 2517 nt, Homo sapiens
uguuguugagguggcgcggcgcuaagauggcggcggcggcggcggcggccguggcggggguggggcgcgguggcgguggcgcggagccacggcaggagcggagccgggcccggggcugggccggcgucgaacgcagcgaaggccggaggugacugcgggcggcgggaggggcagggcagggccggggcgggagcacagcucgggcccgugggcguuaauggcggcgggcgcggcacggccggagccuggcucuccugcaggcucuaacaagcccugguucgagucugggaaccgccccauuggccucggaacggccuguaaccucucuggacuucagcguccucgucuguaagugggcccgauaacgccugccugggaggccuggccuuacagagccggccucgggagcugcgcgaacgugcgcuucuuugcguuccucuauuaaaugccagcgcaccggauaccugccaggaaaagggggccuuggcagggccgggagguguagcuggggcugguugcucccacgccuggauucacccuucggcccugccacgcacugcaggugugaccuugggcaaguccuuuuucucagccucaguuuccuuuucuguaagucaaggagaauaguaauaacugcagcaacccuucuggagcgcugacuccucaggcaucuaauuuucauagcagaucuacgggacaggaacaguuguuaucccauuguaaagaugaggcaacugaggcgcaucgacaguaacucuuacucaaggccacaguuuaauccagugccuggcaucuguaguuauugucucagacccugcccugacucgguucccucacagcaggauggaaccaggugaggagcuggaagaggagggcucuccagguggccgugaggauggcuucaccgccgagcaccuggcugcagaggccauggcagcugacauggaccccuggcuaguguuugaugcccgcacaacgccugccacugagcuggaugccuggcuggccaaguacccaccaucccaaguuacccgcuauggggaccccgguucacccaacucagagccugugggcuggauugcaguguaugggcagggcuacagccccaacuccggggacgugcagggccugcaggcagccugggaagcucugcagaccagugggcggcccaucacaccggguacccugcgccagcucgccaucacccaccacgugcucucgggcaaguggcuuaugcaucuggcaccgggcuucaagcuggaccacgccugggcuggcauugcccgggccgugguugaaggccagcuucagguggccaaggugagcccacgugccaaggagggugggcgccaggucaucuguguuuacacggacgacuucacggaccgcuuggguguacuggaggcggauucagccauccgugcagcgggcauuaagugccugcucaccuacaagccugaugucuacaccuaccugggcaucuaccgggccaaucgcuggcaccucugccccacucucuaugagagccguuuccagcuuggggguagugcccguggcucccgagugcuugaccgugccaacaacguggaacugaccuaggggggccaaauuggggagacugcccacuccccccuccaugcugggguuggauccuccugucuuccuccuuguccuaugaaggccacaccccccagcucuggggacuccuaggucacuugggaacuaccugcaucuucaguccccuugaacuucugcccucuguucagggcugacacaagccccacaggcuggggggcuccgguucccugagggaugagccuucagccucccuuuguaaugcugcuccucuccacugcccagcaccaugaguugggugcagacaccuagaaggagagacuucuuggaacgcucaucccccgcuauaccuccccuuccuccugcaucuccccuucuuuccuucccccucaggagagagaaaacuuagugcuuccagcccuucuuggagccuucaugguccagggguaggggccccacuggccugagcaugccauuuugaggggaggguaguugugccuacuuauccccuggcagaggggaugccaggaccauggacaugaggcuugcccaucccugccaacuuacacagccuguaccacuguccccccuuccuuggcuacuuugacaugugccugcuccuggcauuucaauaaaacccggcuugggucugugucuugaguguuuuuuaaaauacugucuuggugguuaccugcuuucguugcuagggaggggcagggccaggagagacuacccccuugacccggccaggcccccauagcugccccuagcaauaaguugugccucacugcugagguuaggcacugucucuaagaaccucugcaaaaccagccccacuuccccuccauccguaaucaguuucucagagauuucccauaauuccagggguugaccccuccaggaacgucuaaggggccacugcuagcccucagggugcauuug

SEQ ID NO: 18667 - RNA, 2517 nt, Homo sapiens
caaaugcacccugagggcuagcaguggccccuuagacguuccuggaggggucaaccccuggaauuaugggaaaucucugagaaacugauuacggauggaggggaaguggggcugguuuugcagagguucuuagagacagugccuaaccucagcagugaggcacaacuuauugcuaggggcagcuaugggggccuggccgggucaaggggguagucucuccuggcccugccccucccuagcaacgaaagcagguaaccaccaagacaguauuuuaaaaaacacucaagacacagacccaagccggguuuuauugaaaugccaggagcaggcacaugucaaaguagccaaggaaggggggacagugguacaggcuguguaaguuggcagggaugggcaagccucauguccaugguccuggcauccccucugccaggggauaaguaggcacaacuacccuccccucaaaauggcaugcucaggccaguggggccccuaccccuggaccaugaaggcuccaagaagggcuggaagcacuaaguuuucucucuccugagggggaaggaaagaaggggagaugcaggaggaaggggagguauagcgggggaugagcguuccaagaagucucuccuucuaggugucugcacccaacucauggugcugggcaguggagaggagcagcauuacaaagggaggcugaaggcucaucccucagggaaccggagccccccagccuguggggcuugugucagcccugaacagagggcagaaguucaaggggacugaagaugcagguaguucccaagugaccuaggaguccccagagcugggggguguggccuucauaggacaaggaggaagacaggaggauccaaccccagcauggaggggggagugggcagucuccccaauuuggccccccuaggucaguuccacguuguuggcacggucaagcacucgggagccacgggcacuacccccaagcuggaaacggcucucauagagaguggggcagaggugccagcgauuggcccgguagaugcccagguagguguagacaucaggcuuguaggugagcaggcacuuaaugcccgcugcacggauggcugaauccgccuccaguacacccaagcgguccgugaagucguccguguaaacacagaugaccuggcgcccacccuccuuggcacgugggcucaccuuggccaccugaagcuggccuucaaccacggcccgggcaaugccagcccaggcgugguccagcuugaagcccggugccagaugcauaagccacuugcccgagagcacguggugggugauggcgagcuggcgcaggguacccggugugaugggccgcccacuggucugcagagcuucccaggcugccugcaggcccugcacguccccggaguuggggcuguagcccugcccauacacugcaauccagcccacaggcucugaguugggugaaccgggguccccauagcggguaacuugggaugguggguacuuggccagccaggcauccagcucaguggcaggcguugugcgggcaucaaacacuagccagggguccaugucagcugccauggccucugcagccaggugcucggcggugaagccauccucacggccaccuggagagcccuccucuuccagcuccucaccugguuccauccugcugugagggaaccgagucagggcagggucugagacaauaacuacagaugccaggcacuggauuaaacuguggccuugaguaagaguuacugucgaugcgccucaguugccucaucuuuacaaugggauaacaacuguuccugucccguagaucugcuaugaaaauuagaugccugaggagucagcgcuccagaaggguugcugcaguuauuacuauucuccuugacuuacagaaaaggaaacugaggcugagaaaaaggacuugcccaaggucacaccugcagugcguggcagggccgaagggugaauccaggcgugggagcaaccagccccagcuacaccucccggcccugccaaggcccccuuuuccuggcagguauccggugcgcuggcauuuaauagaggaacgcaaagaagcgcacguucgcgcagcucccgaggccggcucuguaaggccaggccucccaggcaggcguuaucgggcccacuuacagacgaggacgcugaaguccagagagguuacaggccguuccgaggccaauggggcgguucccagacucgaaccagggcuuguuagagccugcaggagagccaggcuccggccgugccgcgcccgccgccauuaacgcccacgggcccgagcugugcucccgccccggcccugcccugccccucccgccgcccgcagucaccuccggccuucgcugcguucgacgccggcccagccccgggcccggcuccgcuccugccguggcuccgcgccaccgccaccgcgccccacccccgccacggccgccgccgccgccgccgccaucuuagcgccgcgccaccucaacaaca

SEQ ID NO: 18668 - RNA, 8500 nt, Homo sapiens
cgcgggcucuggcaggugcgucaguccgcaggggaacccggggcuccaccugggcgcggcgaggaaguuacaccauguaugggcagcuacgucaggggggcgggcccgcagccuccggggaacgccgagccgggcccaucccggugaaaaggcugcagccggacuuggggaggcgucgccaaguucgggaccgacgggccaaggcggcgcgucucggggguggagccuggaggugaccgcgccgcugcaacgcccccaccccccgcggucgcagugguucagcccgagaacuuuucauucauaaaaagaaaagacuccgcacggcgcgggugagucagaacccagcagccguguaccccgcagagccgccagccccgggcauguuccgagacuucggggaacccggcccgagcuccgggaacggcggcggguacggcggccccgcgcagcccccggccgcagcgcaggcagcccagcaggugaguggggcccgacgccgguggucccacgggaggaccgcgcgugggaggccggggucaacucccgcacgcuccgggacuggagcggggaaccggagucggggccgggcugggggcuggggcgaggauccugccccucgccguccggggccaguugcccccaccgcgcagcgggcagcagagacccgcgaacuccccuucucccagccgcccccuucucccucgccguccgcguccgucccuccgucuccgugcccgcuuucucuccuccugcccaccucugacuucugcguccacccugcuucagaaggggcgugggcgccuaggguggucgccucgaaggcuaggagggucucuccgcuucgggcugaauuccugggaucuggagucugggcuggggugaggguccccacacgggagggaggcgggauccgucgggagagcagcugggccagggugggagucccggcccggucugcgacccuccgcguguccguccgucugucuguccuucgccccuccgucgccaagucccuaucguuucucggccuggggaguccagggggguccgggcaguggaaccugccagguccccggagaccggcccucgaucccuuugccgaaugcggcgaauagagaccucgagguuccgggacgugcgcggggucaggcugcgggcgacucucgcgaccccacucucagccccuaacggcgcccgcugcccgccggggggcacccgggaggcugcaggugcccauuuccugucgaggggcugcgagcacgugucgacaggggagggaaggaggggcguccguuccgccgagucacggcggccgagucacggcggcugagucacccggggcgucccucccuuccuggccuggagcggcccgggcccgggagugggagaugccgccggcggugccucggacccggaacuggggucacugggacgccgggcccgcagcgcuugggcucgggcuaccgcugucgggacuugccugggcuugugggcgcuucccggacgauugggcgcccacacccagggcccagcggcagagcuagaacccacuucucccagaacacugagccccaucccaacccacuccucagauagcuggcugauagaaugggaacagggacguugugcugggcgcuugcuacaucauuuaccauauuucacggaaucgaagaccucaucgauugaaaaaaaaacccacuauaacuuuaugccacuaauuuucuuuccuucucuuucuuuucuuuuuuuuuuuuuuucugagacagggucucccucuguugcccagacuauagagcaguggugcaaucacagcucacugcagccucagccuccugggcucaagcaauccuacugagauccuagcugggaagcgaccuggccacaggcacgcaccaccacacccaacuaauuuuuuaauuuuuuuguagaaaugaagucucacuguguugcccggugugaccucaaacuccugagcucaagugauccuucuaccucagccucccaaagugcuggguaugagccaccaugccuaguccacuaaaauuuuuuaaauugccaauuaaacuaugauuucagagcuauuaaaggguacuucuuaacaucagugaaauccuguaauccucaccuguaacaauauuaaaaaugaggaaacugaggcacauggagguuaaauaacuugcccauggucacacagccaguaaguagcugagagcugagauuagaauugggacagccugccaugccagguggcuaaagccugucaucucaacacuuugggaggcugagguggguggacugcuucagcucaggaauuugagaccacccugggcaaccuagugagacccugucucuacaaaaaaauuuaaaaaaaauuagccaggccgugcgcggugccucaugccuauaaucccagcacugugggaggccaaggcggguggaucaccagaggucaggaguucaagaccagccuggccaacauagugaaacccugucucuacuaaaaauacaaaaauuagccgggcacaguugugggcgccuguagucccagcuacucgggaggcugaggcaggagaauugcuugaauccaggagguggagguugcagugaggcgagaucgggcuacugcacuccaaccugggugacaaagcaagacugugucucaaaaaaaaaaaaacagaaaagaaaaaaaaaauuagccaaaugugguggugcacgucgguagucccagcuacuugggaggcugaggugggaggauugcuugagcccgcaggucacugcacuccaaccugggugaaagagugagacccugucucaagaaaaaaaaaaaaaaaagcaauggaauggccugaacccagagcagugacucuuuccugccucagccccucugcacugggcaccugccacuuaccagacugucgcacacauucucucaccugauucucacagccuccccuugagcugggagcuguaauuauccucuucgugcaaacgggugcaggaguggguaagagcccagcugcugggcucauuggcucugugucugcggacaacuguucucccgucugaaaaugaagauacuaggcugggcgcugugguucacgccuguaaucccagcacuuugggaggccgaggcggguggaucaccugagguugggagcuggagaccagccuggcaaacauggugaaacccugucucuaccacaaauacaaaaauuagccgggcaugguggugcacgccuauaaucccagcuacucaggaggcuggggcaggaggaucacucgaaccugggaggcgcagguugcagugagcugagaucgugccacuacacuccagccugggcaacagagugagacuccaucugaaaaaaaaaaaagaaaaaaaagaaagaaaagaaaaugaagauauuacugugccaaugauaugagucaguauuuguaaagugguuagaacaguuccuggcaguuugugcuuuauaaauguuaguucuaauggggaaaugggggcacagagagguuaugugaccugccccaaagccacacagcuuaugagcagggauuugccaccaggucagucucugacugccaagcugugcucuuucuguucccagagcuagccuguacauugaagguagacagcaguguagccucugcccaguggaagccccucaauccacacggaccucaucuguggccuuccauuucuuauuccuuagaaguuccaccuggugccaagcaucaacaccaugaguggcagucaggagcugcaguggaugguacagccucauuuccuggggcccagcaguuaccccaggccucugaccuacccucaguacagccccccacaaccccggccaggagucauccgggcccuggggccgccuccagggguacgucgaaggccuugugaacagguaaggcacagaggcauugcagugguuccgaccccgcccaggagugcuagggugcagagaagcuccugccagaaaggagagcacaggcuuaggaggggguaagguaggcuacaggugacuacugcccaaggcugaaagugauaggagccccacgggaggcccagaggguacaacagucacuuccagaucagggaaagcuuccuggaaaagguggcauauuagccuagaaggauggguaggacuggcagaggcagagaggaaggaaaggacauuccagguagcggggguggcaggagcaaggauggaggcggaggcaagaacauguaaggugcgcacacggaauggugagggggucuccaccugcugacaugcauagagggggcgcuuauguugucugggagagaacaggaacaagaggguucccuucagcuacucccucagucucaguuucccugucucauuuaauccucacaaaaucucucuggggaauguacucugguuuuccccaucuuccaccaaagaaaugaaggcacagaaggguagucacuugcccaagaucacacaaguagugaguaaugacacaggacuggccuuggccccaggucuauacaacucuaaagucagauccuaaccaccaaaccagggccaggugcaguagcucaugccuguaaucccagcacuuugagagaccuaggcaggaggaucacuugaggccaggaguucaagacuagguugggcaacauagagagacccugucucuaccgaaaaaacaaaauaaaauaaaacccccaaaacuaaucaccaagccacgcugucucacuggaagcuaacagaaggcucaaaguagagggaacugacaauucuuggcuccccaaagcccuuaccaaaauaagugaguaagagauggcgagucuuuaaaggaguggcucaucuuuccucucccuggggcauuuuggugugggagacuacaggggaugagguuaaaaagcuuggucggcagguagaggauggggagagagguuagggcccugggaaaggugagagaucagccagagacagguuucccagaacagaaugucuggccuuuguggugaggagggacugugguaugagccgcagaagcgggccagggguaaacccuccugugcguccuuccuucagccugguccugagggugacccuuugauccuggguucuccagguagggcugugagcugugaguuggauccuuuuggugaaauggucucucucaucuggccugucacucaauguggaauagagugagugaguucuauggguucuaaguccugcucuggaaccauaaguaaguuauccucucugggcuucaguuuuucauggaaaguugcguuaagaaucuaguuuaaggccaggcaugguggcucacgccuguaaucccagcacuuugggaggccaaggaagguggaucaugaggucaggagaucgagaccauccuggcuaacaugaugaaaccgugucucuacuaaaaaauacaaaaaauuagcugggcgugguggaaggcaccuguagucgcagcuacucgggaggcugaggcaggagaauggcgugaaccccggaggcggagcuugcagugagccgagauggcaccacugcacuccagccugggcaacagagugagacuccgucucaaaaaaaaaaaaaaaaaagaaucuauguuuuuuuaaaaaagaggccagcuguggugacucccccugguaauccaaacauucuaggaggccagugcaggaggaucccuugagcccaugaguuccagaccagccugggcaacacagugagaccccgucacuacacaaaaaaaaaaaagaaaaaaaaaggccgagcacaguggcucaugccuguaaucccagcacuuugggaggcugaggaggguggaucaccugagguuaagaguucaagaccagccuggccaacauggugaaaccucgucucuacuaaaaauacaaaaauuagccagguguggugguacaugccuguaaucccagcuacuugggaggcugaggcacgagaaucacuugaacccaguagguggagguugcagugagccaagauugggccaaugcacuccagccugggaaagagugagacucugucuaaaaaaaauaaaauaaaauaaaauaaaaucuuugcauguucucagugaaaaacaagaaucuacguaaaguacuuggcuggcacauaguaguuuuccaauaaauugcaacuuaaucagcagcacucauuagccccuccuagugcuuacagcucauggaagaggagacuugguuguccacagauccagaaggaugaggguccugcaaagagggugcugagaaggaaaggucacuucuggcuggggaauaagacggcuuccuggaggcaggagcaucuuaguugaguccugggagaugaggaggguuaggguuugcggagggggagggcauuaugggagaggaaugugcacuaaagcuaggugcgaggaggaaauuuuaccaaucaaagcagacagcgccucagugcagggaacugguugggugcagugaucccuaaaucaccggcugagggggcccugccaugaccucugccaggguccuaccacugggccaccaugaggggcgaguuccaggcagccaguagcccaggguccuccucacugcgggucucacccccagaucagcccggaggaagaggagcgccgccgaguaaggcgcgagcggaacaagcuggcugcggccaagugcaggaaccggaggaaggaacugaccgacuuccugcaggcggugagcaccagcccugguccaccgagcucagagggacccugucucccagagcccccagagccccaguauauguagcccccuccucaccauccuagcuccuugucugaggggcaguccuucugggaaaaugaugaggaaaaauugauuagaaacuggcugcagcaugucucacucacagcagagcugaagcucagccagcaaucuccuuuuuuuuuugagacagagucucgcucugucacccaggcuggagugcagugaugagaucucggcucauggcucacugugacaucugucucccaggcuccagcaauucuuaugccucagccugcugaguaccuggggcuacaggcgccugccucccuacccgacuaauuuuuguauuuuuaguagagacgggguuucgccaaguuagccaggcuggucucaaacuccuggucucaagugauccgcccgccucagccucccaaagugcugggauuacaggccggagucacugccuggugccagcaaucuccuaaaacgucugggccugaugggaguugugcccauuuucucccaggggcuuaugggaguuguaguccagacuugcuggggacucuccacugcccccccucuccccccgcccaaccccagcuccucagaacccugaguccaaacgucugcggcucugggguauucagcccucaccuuucugacuccucuccugaucuucuacaggagacugacaaacuggaagaugagaaaucugggcugcagcgagagauugaggagcugcagaagcagaaggagcgccuagagcuggugcuggaagcccaccgacccaucugcaaaaucccggaaggagccaaggagggggacacaggcaguaccaguggcaccagcagcccaccagcccccugccgcccuguaccuuguaucucccuuuccccagggccugugcuugaaccugaggcacugcacacccccacacucaugaccacacccucccuaacuccuuucacccccagccuggucuucaccuaccccagcacuccugagccuugugccucagcucaucgcaagaguagcagcagcagcggagacccauccucugacccccuuggcucuccaacccuccucgcuuugugaggcgccugagcccuacucccugcagaugccacccuagccaaugucuccuccccuucccccaccgguccagcuggccuggacaguaucccacauccaacuccagcaacuucuucuccaucccucuaaugagacugaccauauugugcuucacaguagagccagcuuggggccaccaaagcugcccacuguuucucuugagcuggccucucuagcacaauuugcacuaaaucagagacaaaauauuucccauuugugccagaggaauccuggcagcccagagacuuuguagauccuuagagguccucuggagcccuaaccccuuccagaucacugccacacucuccaucacccucuuccugugauccacccaacccuaucuccugacagaaggugccacuuuacccaccuagaacacuaacucaccagccccacugccagcagcagcaggugauuggaccaggccauucugccgcccccuccugaaccgcacagcucaggaggcgcccuuggcuucugugaugagcugaucugcggaucucagcuuugagaagccuucagcuccagggaauccaagccuccacagcgagggcagcugcuauuuauuuuccuaaagagaguauuuuuauacaaaccuaccaaaauggaauaaaaggcuugaagcugugg

SEQ ID NO: 18669 - RNA, 4586 nt, Homo sapiens
ggcgcucccggaaguggccugaaggcggcgcgccagucccgagcagugcucgcuccugcucggggcgcugcggccccgggcgucgccaugaccagugagcuggacaucuucguggggaacacgacccuuaucgacgaggacguguaucgccucuggcucgaugguuacucggguccgugaggggcguguggggaagccagucggcggagcgguuguguugaaugggagagggggcggggcuaagacuugggcauccuuuagggaagugggcgagcgccugggaauaagagguguuauaggggucugggauggaaacccuuaagggccucuggcgucggcggggcggggccugaugcuagcguccgcuuuccagugaccgacgcgguggcccugcgggugcgcucgggaauccuggagcagacuggcgccacggcagcggugcugcagagcgacaccauggaccauuaccgcaccuuccacaugcucgagcggcugcugcaugcgccgcccaagcuacugcaccagcucaucuuccagauuccgcccucccggcaggcacuacucaucgagaggugcucacccucugggaugguggagacaucaaccagucugacuguauacccauuuugccggcugaaacaggcccagggagggaugggauuuacccagccaucagaaaguugagaguggaaggggucagaccuaggcccugcuaggccccgccagacucccuuuccugucuuuuauggagggucaaugguguucucugacuccacaagguacuaugccuuugaugaggccuuuguucgggaggugcugggcaagaagcuguccaaaggcaccaagaaagaccuggaugacaucagcaccaaaacaggcaucacccucaagagcugccggagacagguaugcacugcauccacacggacacagcaucccaucuacacuucacucccucccuuuggccacuggcccaguuccagccucugauuguggcagcagcuucauaccuagucuucuccucccuuccccuuuccccuccuuuuuuuuuuuuuuuuucgagauggagucuugcucuguggcccaagcuggagugcaguggcgcgaccucagcucacugcaaccuccgccuccuggguucagguaauucuugugccucagccucugcaguagcugagauuacaggcgcccgcucccacacccagcuaauuuuuguauuguuaguagagacaggguuucaccauguuggccaggcuugucuugaacuccuggccucaagugaucauccgccucggccucccaaagugcugacauuacaggcgugagccaccgugccuggcucccuguugugccuuccaagcuauccuguacuguauggccagagugaccuuucagaaugaccugaaauuuuaucagaccccugauaaacuuucauuggcucccacugccuccuggguagcagcugcacuccuuggcuuugaccuauggacuguccuguuaucucaucccugcagaccucucuaggcuuacauuucuccagccccaggcuuuccuuuacucauguugcuucuaccuggaggguacuguucuuggcaauaucuaccccuugaaauccaagacaagaggugagaugccaccuucuccacaagccuuuuugguacgccaggaagaaguaacccuucugggucuuugaugccuuucuuuuguaucuccugugagcuuucuguuuauagcuuagcauuuguuuuuuauuuuuuaguuucuagggcuuagccaggaaagucucuuccaacucaaacuugugaagaucuggagagcauggugcuaaaaugggguuggauuuagagauaagauugaguaaacauuuauccaaggcaagauacagcaggaguugcuaagcauuugauuugauaacaaguacuaauaacuaauaguugguugaaggaauaacaaaugcuaaaucagcaucugcugacuggauagguggauggggaagggagagauguucaauaagugguuuauugggugagcgacacaguguacacucugaccaguccucucuucuacccuaacugcccugcaguuugacaacuuuaaacgggucuucaaggugguagaggaaaugcggggcucccugguggacaauauucagcaacacuuccuccucucugaccgguuggccaggugaggagcuagccaccuccccaucccgcacacuacuuccugggcccggaggcucguccaccuucccuaccccaaaccuucugaccuccugaguaugcugggggaaugauuaucccacuuuuggucuguacuuuuuuuuuuuuuuuuuuuuuaaugagacggaguuucacucuuguugcccaggcuggaaugcaauggugcaaucuuggcucacugcaaccucugccuccugguucaagcaauucugccucagccucccgaguagcugggauuacaggcuugagccaccgcacccagcuuggucuguacuuuggaccagacugaccuggauucaaagcacaguccagcgauuuccagcugggcuguugagagguaccauauguaaagcccauggcacagcccuggcacuuaggaagugcucaguagauaguaacuguuacccuuauggucucccacuguauccacuaguaaacuugagcuggaaccuucucuucgcacagauggggaagggucauagagaagugacuugagacacgucacacagugacuugaggcagagagaggccagaacucggacacccagcugagguugcaggugggagcugcuuccuaagaaggaauuucaagcccuaagaggacccuccucucgucugugcagggacuaugcagccaucgucuucuuugcuaacaaccgcuuugagacagggaagaaaaaacugcaguaucugagcuucggugacuuugccuucugcgcugagcucaugauccaaaacuggacccuuggagccgucggugaggcccccacugacccaggugccuggacgccuccccauccucaggaccugauuccccaccaguaguuucucccacaggcccucaguuccuggcauccgcuccuguucauggcccccacccaggcucccccugcccauagaauguuuuccccacacacaccuugucugcagacaaagggcccauugccucucuguggccuggggcaugucacuccaucucucugacacuccauuuccucuuuuguccccaggggggaaauaagguggugggugaggaaaggcuuaggcuaucacaggagggguuuuuaucacccacccccacccccuucauggccucacagacucacagauggaugacauggacauggacuuagacaaggaauuucuccaggacuugaaggagcucaaggugcuaguggcugacaaggaccuucuggaccugcacaagaggugaccuuguaggggcccauggggcggggccugcaguaggggcccagguggcuauaggcgugacccugucucucugcagccuggugugcacugcucuccggggaaagcugggcgucuucucugagauggaagccaacuucaaggucuguggucccauccagccucugacccuuggcaucuucagccuccaguucgccaccccuaccgggcagcucugccccugccagggauuggccggcagguggcacugcugcucccucugguggccgcugacgggagcagcucauaaacaauggggacuugguugauggagggagguggauggaucuggggaggggccugcuccuccucccccagcuucugugcucagcugccaacuucuggggcagaaagcagagcuccaaggaucccugccccacagaaccugucccgggggcuggugaacguggccgccaagcugacccacaauaaagaugucagagaccuguuuguggaccucguggagaaggugagcugucgugcucucugacacccaaccuggucugucccuggccuauacaagugcuaaguauucucuugggcccgcaguuuguggaacccugccgcuccgaccacuggccacucagcgacgugcgguucuuccugaaucaguauucagcgucuguccacucccucgauggcuuccggugagcagcccuguccuccuguccagcuuggcuuugccccagccugccaccugccaggaccucgccuccugcagacucaagguuccccauucugcuacccugggggugggaccaaagucucuggaccaaagcucuggcucucccucuuagaagcugugugauuuggggcagguuucuuaaccucuccaugccucaguuuccucauguacaaacuaggguucaucaugagaagaauuguaaggauuuucuaagggcaaaaugaaugaagguguagaaagcacgcagggcagggccuccaucacggugaguguugugaaaacucagcugucacuguucauguucuuacagacaccaggcccucugggaccgcuacaugggcacccuccgcggcugccuccugcgccuguaucaugacugaggugccucccaacgcuccgcccacgcugacaauaaaguugcucugaguuuggag

SEQ ID NO: 18670 - RNA, 6779 nt, Homo sapiens
gggcgggggacgcuggugcgaggaggucgaggaggcgccuuggcacccgacucuggcaucccgcacguccgacaucagcccugcccuccuucucaggggcuuccauucauuuugugccaaaagggaacugccgcccucgcccccaaacuuguagcuuuguggauggagggugugggggaggccguguguagugaaaggaccacccggcugaagacgguccuggggguggagggcaggagggagcgagaaggacaguucugcuccugggagccucucguuccugggcgagggucuggggacccuggaugaaguuuuaggaucuuuuacaaugacggucuggggcagagaauaaaauuuugcagggagcagauugagggucuggaggacuggguuaggugggcucuagguacccaggacgaucucgggaggcgcacaaugagaaucugggggcuccaggauuacggugugggugcacaggaugaaauucugggggcgcagauuagguaggaccuaggugagcaggaugacauuuuuggugagcgucugggggcccccgggugagucugggggccuggcaucaaggucggggccccaggaucgagcacugggggacccugguccggcgccgggaggcggcuccuggcggcgccgcgggggaccggguaggggccuguggcuggccgggggcggagaagcggggggucggggucccucccccuggcgcuggcucaggaauccgccgaagggcgggcggaggcgccggggugggccgcgccgcggcaggcgggcgggcggggggcgcuuccuggggccgcgcguccagggagcugugccguccgcccguccgucugcccgcaggcauugcccgagccagccgagccgccagagccgcgggccgcgggggugucgcgggcccaagugaguggcugugaccguccgugggggagggcgugggccggagucucggccgaguccgcggcagcguagcgcccacagaggcccgcgcuccucggccuucgccgcaggggcgcggggcgggggcgggguggccggggcgggugggccugggacccgggccugggaccugggccugugaggagucggcccccagcccugggaggccccgaggcccaagcacgguccugagcgggcaguggcgggggcugggcucgggcucccgguacagggaguugaggugccgcgggcagaggccccugacccguguccaccaucucgcagccccaggaugcuccccugcgccuccugccuacccgggucucuacugcucugggcgcugcuacuguugcucuugggaucagcuucuccucaggauucugaagagcccgacagcuacacgguggggacagugagggccgcuggccugggacaggaaggguagggaggaagagaccgggacccagggugacugcugccggggaagucuuccuccccuggcugguggagagcugggggccauuguuuggagcaggccggaggguggccaggcucaggcccuagucuuggccuggccaguuggaggagaucuuagggugaccacuggccacuucugguucccuuccaggaaugcacagauggcuaugagugggacccagacagccagcacugccggggugugugugccugggggaccaaacacccccaggaacccggaaagggauugauagcugcuuuccaagggacagccccaccuccaagaacugccgugggagcccagcagcccguucuaugcccagcucugcuacacagaggccagcucuggcucucuggaggccaguugagcuagggguggccucauccucucccagaaacccaggaaaccuugucccuaccccucagaggagcuggauccuguacgccuucucugaaccacucuccugucccagcucuuugucucaucacaaccugggaggguagcguccccagggguggguaaggaggccccccaucuugggcugagcuagggcuagggccguggggagggauagagacccacuugcaggccgagaaugagggcaacagugggaacagcugccccaucuccagccuuggccaacccuggggagggguccugagcaggcagacuuagcuuguugagcagagugggaaggcuuugcuggggccacacaucucagagaaggccgagcuggguuccugccuccgcucccuccagggccagcccaggagacuggcugugcccagcaggccccucucugcagaugucaacgagugucugaccaucccugaggccugcaagggggaaaugaagugcaucaaccacuacgggggcuacuugugccugccccgcuccgcugccgucaucaacgaccuacacggcgagggacccccgccaccagugccucccgcucaacaccccaaccccugcccaccaggcuaugagcccgacgaucaggacagcugugugggugaguggggacugcucuggugccuggcuuccaguccucucaccaggcgucuuaaacucagaccucauguuccuccccagcucaaaagggccacuggugauguccacacccucauccagacacucauguuguuuaggaccugccgcagguggccccagcuugugugccacugcuccagccagcuccgggccccuccccucgguugcugcagagacacugcaggaagucugccuuccagugucuguccccugggagccacaggccuuggaggaaggacaguccaggaaucaguguugcuggggauguuuggacaggaccuuauuuccugugcaacccccaacaugugguuuuagagguuaggggugccuuuccugauggcuccaggcuggugaacucuuacgcgugcuguugagagaaccgaauacaaguguuggaacuaucugucauguuggguggugugcgggaucccaggcaggggcugaguggugucucucgcagauguggacgagugugcccaggcccugcacgacugucgccccagccaggacugccauaacuugccuggcuccuaucagugcaccugcccugaugguuaccgcaagaucgggcccgagugugugggugaguccaggaagcagcuucuguagucccggcuuugugucccuggucuggcccuugcccuagcaccugacccccauucaagccaggcuucacccccggccccugccaccucacccuccgucaucagacacagaggacuguagcggggaguguuugggagguguccuggcugacccugccuaauucagcuccucggacacaggauuauggguggugaagccuugagucccagccggcucgagcccaccugcccucugcccucugcccuccgcccuccuucuccugccucuaucccuagacauagacgagugccgcuaccgcuacugccagcaccgcugcgugaaccugccuggcuccuuccgcugccagugcgagccgggcuuccagcuggggccuaacaaccgcuccuguguuggugaggcugggcugggccaggcuccuggguccugggcagggaggugugaggugggggcgcucccuucuugaccagcccagguagaguggaggcucugggcuccuccuccgcuuucaucccuccuguuuuuccuggcacccccagaugugaacgagugugacaugggggccccaugcgagcagcgcugcuucaacuccuaugggaccuuccugugucgcugccaccagggcuaugagcugcaucgggauggcuucuccugcaguggugagagcuccaucccugcuguguacuccucuguggacccccaggcccuagcuaugccgugccuccugccacacaguucuccauuugaggccuccgccuccugucacugugcacccagcugccuccuggguacucgaccccggcuggcuguggagcacucccaggcuagugggggaggcacaaggagaggcagcuacguccuuacugaagccuacuggugagacugaggaugugggugccaccugucccacauaucaggcucaccugcauuuaccugcauuugaauuuugcacuaggacaagucacuccucucugagccuguuucuucuucuauaaaauggguugucuugaggauuaggugagagugugauagaugggcuccagcaagucucaagcugcagugcuuuaaagugaaugaacugccacuuaaugagaaccugcccucguaguguauucccugacacacuuggccuccuuccucucaagaauccuaggagguaugauuuucuccuuccucuacaaaaugaggacauucauaucucccuccacguuuguugggaggauuacauaaaaauaaucacaaaguccuggguaaauggugacuuucaugauucagcuaagagagguuaagugacccgcccaagcucauacagccaggaugagauggggccagggcuggaucccagacuucuuacacccuguaaacuggcauguacccccuauguuaugcuuugcugcgggaugaggccucacugcuaccuggcagcaugaggggaacaagagaaaggaaauguucugccugugaagcucacaguuaguuggaggugaccacugggugcucagguugacuguggguugcaggaauugggcguuacagcacaagccagacccauaagacucaucuagucuaacacacucauuuuacugauugggaaaaugagauuccccuagaucagcuggugggauucacacccaagccucuagauucccaguaacuuauuuaguguuucuuccaguucugggcagagagaagucugugagcugcggcagccugggcaaacuuucuuugaacccuccaucucccggcugaacuuguggcuugucucaucccccucugucuuccuacauucagucuaacauggggcugggccuucuugggaaauguuugugggacugaauggugaggaaugcccuugacccgggguccccauccccaugcuuccucagauauugaugaguguagcuacuccagcuaccucugucaguaccgcugcaucaacgagccaggccguuucuccugccacugcccacaggguuaccagcugcuggccacacgccucugccaagguacagguugcccgggugggaugggcaggacggugucaggagcuggcagccugacgcccccgauuccagccccucuccccuggcacagacauugaugagugugagucuggugcgcaccagugcuccgaggcccaaaccugugucaacuuccaugggggcuaccgcugcguggacaccaaccgcugcguggagcccuacauccaggucucugagaagugagucaauucgaugccaggcccccacagaaacuacgucucccagggggcuuuggggcugacuggcaucuauucagaccagcgagugccccugagggaugaugggaaucauaguccuucaugaaaaccagucacagggguagaaggguccuuuugggauucccucccuuuguaggguaggagaaauuggggggacgggcaaggagcucauuugugucccccaccucggggucucuagccgcugucucugcccggccuccaacccucuaugucgagagcagccuucauccauugugcaccgcuacaugaccaucaccucggagcggagcgugcccgcugacguguuccagauccaggcgaccuccgucuaccccggugccuacaaugccuuucagauccgugcuggaaacucgcagggggacuuuuacauuaggguaagguuucugcaacccucaacugacaugcacaaucuaaaacugaacuccaggacgccuuaagggggaacucggccaggcugcuaugccccaccccucccccaaagccccgcccccggaggcgggguuucugcaggaagacggggguacucuaaaugcaauucuaacgguuaaaugcaauucuaacgaagcacucggacacgggaguuugaguccugguacugguuuuccauauugaucucaguuucuucacccacaaaccaagggaauggcgugugcagggcccuggggucagaaaguccacuccuugcuaguggaucuguuaggugggagggggccaggggcggcucacagugagcugcucacagugacuggcagccgcaugcaugggucucagcaggagaagggguuugucuaguaccagcccuucucuuucuuuuugaaauugaaugcucugaagggagucugcucacuuugggucaccaaaggucccaccagucccaagagccacauguggccuugaaucgucaguuagccugggucagacagagcaggcuggagagggugagaagagccccagcaggagauuucugagggcaggagccuggguggggaggagagacaucgagggugucaaagagcugcaugagaggcugggguggcagccuggccagggcuguuccucugccucacggccacggggcagggaggugacgcuggggcaggggccuagcacacaggcugacacaauauauauguccccccacccacugcccugcagcaaaucaacaacgucagcgccaugcugguccucgcccggccggugacgggcccccgggaguacgugcuggaccuggagauggucaccaugaauucccucaugagcuaccgggccagcucuguacugaggcucaccgucuuuguaggggccuacaccuucugaggagcaggagggagccacccucccugcagcuacccuagcugaggagccuguugugaggggcagaaugagaaaggcaauaaagggagaaagaaaguc

SEQ ID NO: 18671 - RNA, 4078 nt, Homo sapiens
gcaaaaggcucaggguaccggcaacacccuuuugguuaaacacagggaggcagugcucaagacaccggggucugaagucccgggcuccaccuggcuggccccacccugaaugcacuccagccacaucuagaggaggucaaaggcucaacuuggccugacucacagcagccacugaaccugacccucauaaacuugagucagccauccagggaagacagcagaccaaacagaaccuuugagcuaccucugacuugccuaucagcccacaccuagaaagggacagaacagaauaucagauggaccucacuguccauccaggcaaggcuacagagcacccaguucaggcauaaaucacuuccgcuggaagaccccuguagccagcacccacuccuuaaacagccaguccagugucaaucacagcaccaacagaauaauggugaccaucagaaaggcgucucagccagucauuggagccagauaagggugugcaggggcugguuggguguggaguacagaggagagagauagcaccauuaucccagugcacccccaauccugaagucuccugugucccaaccuugaaaaacacaucccauuaaugagccuuuuuauuauugucuuuuuuuuuuuuaaucgaaggucccuuacugguccugcuuccaugaguagccgugaccaggggaaaagggagaggaaccagccggcacagggaggggucaucuccacaacauuccauuuauacacagaacuaaacagacaagcacagagucacuauugcgguuagaaguuggcagcaugggaagggggaggaccagguggggaauggggauguuguuaaaaaaaauacaggcucccccacaacuggggugccuggggggaacuuggucugcuucagcccaagaggaaucaaaagaucaaaagcaguuugggaaggccagaaccgucaagggauggagggagaaggaaaauccaggggguggggggucuguuuggcaacuggggugaagggauugcccucccccugcugggauccccccagccccuccggucuggcaggaagggggcagccugcaacccccaagggcagguguggggcugccagaugcuccaggcagggggccagaaggggcucacaaaggcuugcccuccagggagaugacggcacugccccccagcuucucugccagggugcagcgguccuugaccuccucguagcaguuugcuugcaauucaugcuugaucccuauaaagaagaaaggggagcaucugugagcaggaagcacugggguggggguaguuucuguggcugggaaggagccaaucaaagcagauggaaggaacaagcaggcagcgaagacaagggggcagacccccucugcgugccauucacccugcccugcagccaaggccagagcagaagggcacucagcaccaaugcuggcccuuaccugucagcuucuucuugauggcguccuuggagcuggcauaaaucauuuugcucuuaaggggcgcagacucgggggcccuggacagaaacacgcgucaggcaacucccagcaacagcaaagccacaggugacuuugagaaacccuugggcuggcagugaggagucuuuuguuacaacccccucccccuccaaacccacacaucuggguugaccaggagccacagaaguucccaucaugagaaagggggcaggugacaggaagaagugccagaaugagcucaccagaagauaaacaccagauccuccuucuugcucuccuuggucucauagguugcaucauagagggcauagcggcaguccuuaucuggcagcaucuugacaaagguggcguaggggucgucgacagucuggcccacaucgcccaccaggaucuccuugcccuccuccaggaugauguucuucuuguccucacucaggcagaagagcaccgccuucuugcgcuucuucaccuccucuggcguugaagacuuacgcaccuucaugucguugaacaccuugaugacaccaucagagacagccacaccggaggccuaggagacaugccacguauacgucaagaaaaggauucuagggaacugccccuuguuuuuucagaagaucucaguccacgucccgaguggucacuagugcccuucccaaggcaagucacuaguuuucccacccaagucacugucaaagaaccagaugggacacaaccucagaauggcagccauggccucugaucaccuaguucaacaaccccuucccucauuuuacaggauagaaaugcaaaacucgugaaaagcagaaccuugaccaaaaugugaacccagaauuaaaagauccaccggcuacugacucauuugcuacucacaguacuugcucucagccuuuggauaaaacuggugauuuagaacuucggauauggaggacccaaacaccugagccaagacuccucuucagaaagagccaagaccccacaaugcuagaugggaccccaaggacaccgaacaguuacaacaaacccaccagaacugcuuaauacaguuacuacacaaacgaccccuguucccagcuaggcucuuucccaaccaagacaagaauugcaacccccauuaaggacccugcccgacaacucccuucuuccgggaauggugcuaggccccagaagucgcugauaaaaauuaacaugccaaacucaagugcccagaggccucgaggucuuuaaacucuuccuacucugcgucgugcuucggggugcccgagccaggagagggaggggcaauccaagguaaaucuggucccccaaacuccccggaacugcagaagaagccggccacgugacucggccgcauccggagugggcggggacaggagaucggcugggcccggcccccucaccaaugcagaaacgcguauccgagaggcagcagcaucuccaggucccuaacccuguggaaucgcccuaaaacaacggguguaucagacccaucuccugcaggcaggagccugggcaagcuacauaaccuucgguuuucucagcccucgggccguauacagggggcggggugguuuccgggcggugcccgccugggucacuucccuaaacucggcuccacccucacucaggcccauccgggaaggccucgcuggcccagggcuucggcaccggcggccgggccugagcgugcgcgcacgcgccgacagacagcgccguuccagcccucgcccgaugcacgggugagaacgcagcucguuagaugcgcucccgaacgggccgcggucucugcgaugcccccuccaagccuugcggugcaaggccuuaaucgcaggcacccacgccccaaccgggaccccgucuucccagcaucaccccucgccgcgccagcacccgccccucccgggcgcaggcaucccugccaccugcucccgagacggacccggcugccgagggagggugacgcgcagacaggaacagccuuggguggggcgcgcgcgccgagaccucucgcgcgcuuuuuccucgccgcccccgggccggguuuggacgccgcaugcuccagucgagagcgcgccccuaagaagaaaggcgcgacgccggccguuccgcgaggggcgccccagcgcgcgccccgaaccccuccccccgcggccgguguccgcgcgggcgcaccagcgggugggggaggggagcccaggcggagcgcgagcgacguccagaccggcccuccccggcgcccacgggcgcgcacgcgcauuccggcaccgcccgccccuucgugcgagacccucaucccgcccggggcgcugggggagggggugcggacgucgcuccccagucgcuucccgcgcgcaggcgaccgacccgcagccgccucccucaggcgccguggccugccgcucaccauguuuccggaaacgaaaaggagagggcaccgagagccgcagaagacgagagcgcugcagccgcugccgggacccgacugaacgcggccucucccggccccuuccguuuaguaggagccgcacaaugagggguggggcgggcuuccggcgcucccaccgcgagccgacgggaaauggaguccgcug

SEQ ID NO: 18672 - RNA, 1057 nt, Homo sapiens
ccgccggagacauguugcaaaaaccgaggaaccggggccgcucuggcggccaggccgagagggacagagacuggagccauagcggaaaccccggggcuucgcgggccggggaagacgcccggguucucagagacggcuuugccgaggaggccccgagcacgucccgcgggccgggcggcucgcaggggucgcagggccccucgccucagggcgcccgccgggcccaggccgcccccgccguggggcccaggagccagaagcagcuggagcugaaaguguccgagcuggugcaguucuugcugauuaaagaccagaagaagauuccgaucaagcgggccgacauacugaagcacgucaucggggacuacaaggacaucuuccccgaccucuucaaacgggccgccgagcgccuccaguacgucuucggguauaagcugguggaacuugaacccaagagcaacacuuacauccucaucaacacccuggagccuguggaggaggaugccgagaugaggggugaccaaggcacgcccacuacgggccuccugaugaucgucuuagggcucaucuuuaugaagggcaacaccaucaaggaaacugaagccugggacuuucugcggcgcuuaggggucuaccccaccaagaagcauuuaauuuucggagauccaaagaaacucauuacugaggacuuugugcgacagcguuaccuggaauaccggcggauaccccacaccgaccccgucgacuacgaauuccaguggggcccgcgaaccaaccuggaaaccagcaagaugaaaguucuuaaguuuguggccaagguccauaaucaagaccccaaggacuggccagcgcaguacugugaggcuuuggcagaugaggagaacagggccagaccucagccuaguggcccagcuccauccucuugaaagguggauucagagggacccccgggacaagggucugagacccaaaggcacaguuuagaggauugggggaagggagaacgaacccagggagcauauugcuguaaacgcuucaauguguguagcuuuaggau

SEQ ID NO: 18673 - RNA, 1502 nt, Homo sapiens
uggagacgcacggcuucuucaccaggaacgcgcggggcauuuucgaacccucgucgcuggacacgggccgcuuccguaacugaagccgggagccgucccaccuuugcggggccgggcugaacgccgggaacgggggcacaacagggaaggagucgcuaaggcgcccccacguuccggggaagguccgagcccggacggcgcgcggcgguuccaccuccgcggaaugucgccgucuucccugagaacgaggucccuugcggccaggugcaccgggcggcgcggggaagcggcagguaagcgucucccggcucgacuggcguccccgccgccgcucgggaagucuuaaagugcgagccggacggacggguucacgcuuuauuggcucgcggcgguguguguugguggcuggggcggggggggguggggguggggggcggugaucugaucuaauuagcuugggguggcccggggagcgacggcgcaugcguugggaaauaacggugacaacccaccuauuuguuaccugucgaaccgguuuccauuccgcugcgggugagguggccucgcggcccgggcggggcggccgggcggggcggggucggggggcgagcuucgggcacucagccccuggcugcccagccggcccggcccccgcgggaccuccuagccaggcguacuggcguuugcaaacaggaguuucggagcgagcggagccgggagggagggggcaacguuauuugcaccggcgcuggcacgcuccgcgggugaugacacgaaacucgccccacuggggccggcccaacccggcgcgcccgaggcuccuggggaggcgcgaagccgccgggcgggaacgggcggcccgguccgcacuuguugaaccgggccugggcccaggcggcgcgggaucccaaaggcuuggcuaagcaacucguggcucagccggggagguguuugcugggcgccggcuuugugcgaaaaggcacgcagggccgcaggagcggccccggccgguguguggggaggcacggaccgcgcgaccgaguacccgucggagaacccgccuucugcccggagggcuucacggaggaaguggcuucaacugcgcggagugcgccgagagcccgacagacccccgugucuuggccagugggacuuaugcauccucaaaaaaacuccuccuugucccaaauggguggauuucaggugcagccaggcugguggagcgcggagggcuggggaccucagaccgggaaaggcucagccgccuuugcccugcugcggccaccgcggagagcuuccuacccacggccugcccagggcugagguucagccugggacccgcgcccccagccacucuucauacucuccucaggccccaggcccacguggagggaugcccccgcuccucagaggccuccaugaagcccacacucucaucgugacacuugggcgcuggcugggcuuccuucacucgcugaccuacuuaagggcagggauggggc

SEQ ID NO: 18674 - RNA, 1502 nt, Homo sapiens
gccccaucccugcccuuaaguaggucagcgagugaaggaagcccagccagcgcccaagugucacgaugagagugugggcuucauggaggccucugaggagcgggggcaucccuccacgugggccuggggccugaggagaguaugaagaguggcugggggcgcgggucccaggcugaaccucagcccugggcaggccguggguaggaagcucuccgcgguggccgcagcagggcaaaggcggcugagccuuucccggucugagguccccagcccuccgcgcuccaccagccuggcugcaccugaaauccacccauuugggacaaggaggaguuuuuuugaggaugcauaagucccacuggccaagacacgggggucugucgggcucucggcgcacuccgcgcaguugaagccacuuccuccgugaagcccuccgggcagaaggcggguucuccgacggguacucggucgcgcgguccgugccuccccacacaccggccggggccgcuccugcggcccugcgugccuuuucgcacaaagccggcgcccagcaaacaccuccccggcugagccacgaguugcuuagccaagccuuugggaucccgcgccgccugggcccaggcccgguucaacaagugcggaccgggccgcccguucccgcccggcggcuucgcgccuccccaggagccucgggcgcgccggguugggccggccccaguggggcgaguuucgugucaucacccgcggagcgugccagcgccggugcaaauaacguugcccccucccucccggcuccgcucgcuccgaaacuccuguuugcaaacgccaguacgccuggcuaggaggucccgcgggggccgggccggcugggcagccaggggcugagugcccgaagcucgccccccgaccccgccccgcccggccgccccgcccgggccgcgaggccaccucacccgcagcggaauggaaaccgguucgacagguaacaaauagguggguugucaccguuauuucccaacgcaugcgccgucgcuccccgggccaccccaagcuaauuagaucagaucaccgccccccacccccacccccccccgccccagccaccaacacacaccgccgcgagccaauaaagcgugaacccguccguccggcucgcacuuuaagacuucccgagcggcggcggggacgccagucgagccgggagacgcuuaccugccgcuuccccgcgccgcccggugcaccuggccgcaagggaccucguucucagggaagacggcgacauuccgcggagguggaaccgccgcgcgccguccgggcucggaccuuccccggaacgugggggcgccuuagcgacuccuucccuguugugcccccguucccggcguucagcccggccccgcaaaggugggacggcucccggcuucaguuacggaagcggcccguguccagcgacgaggguucgaaaaugccccgcgcguuccuggugaagaagccgugcgucucca

SEQ ID NO: 18675 - RNA, 8084 nt, Homo sapiens
ugggguuuccaccuagggcucggccugaggcuuguaacacuccguuuucccccgagucacaggggcagucuugccccucgcagcugggucgcggugucucucaaaggucccccucuacaggggcuucgugaggcccgggcccacagggcgcucggucccggaagugacgucucccagaggggccggaaguggcaguggagggagggaagauggcggagguggugaguccggugcccggggcggggcggagggagccaggggagguggguagagcccgaggccccccaguagccgacccuggcgucgcgcugucuccccagggggagauaaucgagggcugccgccuacccgugcugcggcggaaccaggacaacgaagaugaguggcgugagugacguuggggggcgggacuaaggaaccugagggcgaggggcgggagucaacugaaaucccgggauggggaggggcgucuggaauuauggggcgggcgaggcgcagauacuuugaugaaggggcguggcucuuagcugcuccgagagguacagggcggggccuggaaagggguggcacuugugacugaaggaggcuuaggagagaccuaagugcuggagcuuagggauccggccuggggguggaguucaggucguggaaggguggagucucauagccuggccugucuaaggccccugucuaugcuauucucauagcccuggccgagauccugagcgugaaggacaucaguggccggaagcuuuucuacguccauuacauugacugugaguucugggccugagguggggcaucaggguaggguugggggacagucuuuggcauucuguccugagccauccccacugcuacagucaacaaacgucuggaugaaugggugacgcaugagcggcuggaccuaaagaagauccaguuccccaagaaagaggccaagacccccacuaagaacggacuuccugggucccguccuggcucuccagagagagagguggugaguaggucccccacuucaccuuuucucuccugccuccuauuucucuugucuguuggcauuaggagcuccuggaugggcaggaggcggcucccucucacccugacuucaucuugcaaaggaugggggccaaauugcacauguagcucccagaguccaguagcuaguccuguguccuucagaaggcgagggugggguuugauaauuuugaggugagggaccccucuuccccuuccccaucccacugccauccccgccccaaaggaagacccuggaccuaucucuacagccggccucggcgcaggccagcgggaagaccuugccaaucccgguccagaucacacuccgcuucaaccugcccaaggagcgggaggccauucccgguggcgagccugaccagccgcucuccuccagcuccugccugcagcccaaccaccgcucaacgguacccucagcaauuccagggaccuugcuuucuucucaggucccaccuucucuaccuucugacccaccuuuguugguuucucucugcagaaacggaagguggaggugguuucaccagcaacuccagugcccagcgagacagccccggccucgguuuuuccccaggugaguuccccaaaccaucucuuguucucuuccucucuucuacucucugguggcuuuuuucaggcucauuucacagccaucccuucuuuuccuacuaucucggcagaauggagccgcccguagggcaguggcagcccagccaggacggaagcgaaaaucgaauuguuugggcacugaugaggugggucuggggagcagcagaagggaacugggugaaaaggaagggaugcaggcaggguggagaguuauuuagugaugaguuuaaaaauaaagaagggguggugggcagagcuaguguuggugggauuaggagacaggcagaacauuguucaaaugagucauuggggccgggcaccauggcucauaccuguaaucccagcacuuugggaguccaaccaaggcugguggaucaccugaggucaggaguuugagaccagccuggccaacauggugaaaccuuguuucuacuagaaauacaaaaauuagccaggcgugguggcgggugccuguaauccagcucggaaagcugaggcaggagaacugcuugaaccccggagguggagauugcagugagccaagaucgcgcuacugcccuccagccugggcgacagacugagacuccaucuaaaaaauggggucauugggugaucuuuuccacaucaucgauccuuuaggguuucagguuuuuuaucuggaaauuggggaucaugguaccucccccuuaggguugcuguuaggcuugaaggaaaccugucaaagggcugugagcugugguguccugcugagcugucucuuacaaccugguauuuuccacuggcccugggcaggacucccaggacagcucugauggaauaccgucagcaccacgcaugacuggcagccuggugucugaucgaagccacgacgacaucgucacccggaugaagaacauugagugcauugagcugggccggcaccgccucaagccgugguacuucuccccguacccacaggaacucaccacauugccuguccucuaccugugcgaguucugccucaaguacggccguagucucaagugucuucagcgucauuugguaugagggguccagggaggcugccuucccagcacccuccacguugcccuuguuccugauccuccucucuuccccagaccaagugugaccuacgacauccuccaggcaaugagauuuaccgcaagggcaccaucuccuucuuugagauugauggacguaagaacaagguuagugcuugagaggcagugaggcgcuggggugaaucaaaugacagcuucuucuugcucagguaaacacugaccagucaagccagcagaucaguccagcccauuuuuauugaguuccugcugucuggcaggugcugguagccaggaaugagacagucucuguucucugacagcuuaguccaugggagagacagucauaccaaugaccucuagcucccaguguccuaagugucaugaaacagaggguagguuagcaggacccaaaggagguggucagcagagcuucauagaggguuaccuuucagccuugguggaugacaaaguggcugaggggauuucuugcagugguguucugaagaguaggcauggaugcacaaagguggucuuugugaaaggcagagaucauucugguugggaggcagaaaagggaggaugagggaaggcucguacaugggacagagcuuaggugaugaagaugcuguguuaaccaccauuuuguaauuauuaauguggaccugggcauccaaguggcaguacccagcagcaggcgguuaaaaagcaauuccugggcugggcacgguggcucacaccuguaaucccagcacuuugggaggcugaggcgggcggaucacaaggucaggagaucgagaccauccuggcuaacacgguuaaacccugucucuacuaaaaaguacaaaaaauuagcugggcgugguggcgggugccuguaaucccagcuacucgggaggcugaggcaggagaauggcgugaacccaggaggcagaguuugcagugagccgagauugcaccacugcauuccagccugggagacagcaagacuucguguaaaaaaaauaaauaaauaaaaagcaauuucuggcugggcacaguggcucauaccuguaaccccagcacuuugggaggccaaggugggccaaucacuugagcccagaauuucgagaccagccugggcaacauggagaaacccccagguacucgggaggcugaguugggagaaucaccugagccugggaagucaaggcugcagugacccacgauugcaugauugcaccacugcacuccagccugggugacaggagugagacccugugucaaaaaaaaaaaaaaaaaacccacaaugucugaaaugcaggagaaaucgugugcagaaguaaagcagcaggauucauaauuuugcugggguaaacccuaaggcaguuauuuuguuaaauuccagaauuccuuaacucuguuguagaguagcagaucaguucccaggaggugugacuguggauguagaauguuagguuuuuuaacagcuagacucccaagacuguuagauagggagucaguggucagagucucacuuuggacacauuaguuugaggagccguggucagagucucacuuuggacacauuaguucguuggcugcuguuaaaaaacauuaaaaggcaguggucucuccuggucaggcuuagaauggaggugugcggagcaaggcgggaaacuugccugacugagcagggaggcacucagacaccaucacacaucuggcacacaggcuuuucaacacugaggagcagcccugccuaagcugcgggcugguggagugggucaggcccagccagggaagaacacucaucaccuagcagccuggggcauagcacgaacagugaagcuccugguugacccugaaccacuggccaggcucaaggcgggauacccagaguggugacaagccuuuucucuugcagaguuauucccagaaccugugucuuuuggccaaguguuuccuugaccauaagacacuguacuaugacacagacccuuuccucuucuacgucaugacagaguaugacuguaagggcuuccacaucgugggcuacuucuccaaggucagugccugcccaagcugucccugugcccuguccugagccagaucccuucccugacacucaccugucccccuucuccaggagaaagaaucaacggaagacuacaauguggccugcauccuaacccugccucccuaccagcgccggggcuacggcaagcugcugaucgaguucagugaguaugugugcugcggccaggggguaguggacccacuaucggugccucacaggcagaugggccaggcuacugugauucucaacccuggcugugcagcccagccucuaggggaaccagccagaaauaacaguggcacucucccgggguucucuccguucaggcugacugcccugcuuaucugggguagguucucagccccccaguuugcuccuuggccaggguucuaagugccacucagcuuuccccaaaucugacuuacgugcuccugccuggagccaugggcagaagguuagugagccgcuggugcugauguaucugguaacgugugccaugauacgaguacuggggcaaggaccaguggcuaauguccccaguuguccccugagccuugcaggcagguauccaaaaugcugucagcagauagacauaagcauguugucccucgcuccuuguguccagugaggucagucucuuaaagccagaagggacucugaacuucaucacacaugggcucuucagugcccuccccaacccugaggccccuucuucccagccucuuacuccccaucaccccccauucugucugucucaccacucacuuggaauaaccaagcucugaccugagaaacaaggaggaaguucuagcuguugaccuggugaagacacagaggcuuuaccugaucaagguuaugguccauucgagaaauuuuauugguuaaaugaugcccagauggggucacauccucagaacuucucagccugguagcacaaguggaugcuugaagaaacucagucuuggaacucagacagcaauggagacgggaugugagugggaccagcaaggggcuaagguccauuaugagggugaggaagggcuucuagaaguaacaaacaucccaggucccugacuggggagaaugaagacacugaccaagagaugugaagccacucagggcugugcagggucugaggaucucacuggggacggccucccagcggccagcuaucagcacgaguuggagggaaagagccauggugggggucagucacguggcucccaggaauggucuccccgacuuaggaagcaccuuggugcaccuuuucuccuugcauccucacaaccacccagucaggccacucaagucuuacagcaggugacacucccaaggucccagcuaggaggacuuugagaauucaagcauucucaggucuggauuagagacaggaaucugucuccacuuccuuacauggcuagacacagagcccgggauggcaaaggaaaauuggaggccccuucuucccaugagccauuuucucugcauccccugcccauaagccuucacuggccucugaucacccucaugguugacugcagcugcuccucucagugcccucaugcccuccacugugcucagcgcacggaaagagugaauacucaguucuuccugagggaacugaggcacagagaaguggagggcauagaacugccaaguggcagggccaugauaggaacuaggcagccugccuuggcaaccuguguuuuuaaauguugcuuauguucaucugugaccucuuacucacccucuccugcuccauugcuuuaggcuaugaacucuccaaaguggaagggaaaacagggaccccugagaagccccucucagaccuuggccuccuauccuaucgaagcuacuggucccagaccauccuggagauccugauggggcugaagucggagagcggggagaggccacagaucaccaucaagugagccuggcgcugucuaccuggggguacauggcauggcuugucuguuccugggcuuucucucucagggcuccuggggacagauaaagguccucagggaaccugaccugugcucucccacagugagauuagugaaaucaccagcaucaagaaggaggaugucaucuccacucugcaguaccucaaucucaucaacuacuacaagguagggaggcaggcaggggagacaggugugugggaugcagagugcaguccucugugggcugaccaccugcugaacccaucuccucugcccagggccaguacauccucacacugucagaggacaucguggauggccaugagcgggccaugcucaagcggcuccugcggaucgacuccaagugucugcacuucacucccaaggacuggagcaagagggggaaguggugaccagacacugcccacugcagugccaagacggcagcaggacuggggcugauagcccaccccgcccccacugcagcucccacaaagcacucuaagggagauggggcugaggacagcucaaaaaggagaggacaggccuggcaggggcccacuggugcccagcaccaaggcgagcuccgggcucagaccaacuccaaggucagcuggccacaggcccaggccuccucugaagcagggaccagagggagccaggcagcuguguacagugagaagggauccggaugggggagcucuguacagagggcuggugauuguaaaaauuucuuuuguaaaguagaaguuggggguggggugggugcuggcugcaaaaauuucuggcuucucuuaccccuauugcccccggcaauaaauuguuucuauaugccagagccaugcaaaguucuugguggggagggggaaagggcccaugcuggcuuaggggcucuaaggcgcccagacucacaggugcugugaagagcuccuuuauuggggugauggaaucgguuccaaagagcugguuuacugcugugaagggaucgcagcuuugaauuucaagcucugguucucaguccucgggcaccugugcgugaaucugcaacaggagucgccucuacuguuggacuuguaagacagggcggcaagcuggcccccauacccgaggaaggacccagcuguucagaauaaccgcuucuagacaugcuaggaagaguggucagggagcuacgcuucccacacacuacccaguagaauccuccaggcuccgucugcgcaauugugcuccccagcccauccacccgggggcaagacggaacuccucgucuacucaccgcugccgcaaggcugggccaaguuaaggccccacgcacuuuggcauccgggccagggauggucuccagaccccacagggugaagcggcugaaguugg

SEQ ID NO: 18676 - RNA, 9563 nt, Homo sapiens
cacccuccaggcggggccgggacccgggagcuagccgagccaccgggcacgccagccucuucguccucggcgaggcgcgcacuuggccccgacccccggcagcggcugugcgugcagccucuucguccuccgcgcggcgugcacuugcucccggccccugcgccgggcggcggcggggcagcgcgcaggcgcggccggauuccgggcagugacgcgacggcgggccgcgcggcgcauuuccgccucuggcgaauggcucgucuguagugcacgccgcgggcccagcugcgaccccggccccgcccccgggaccccggccauggacggugaggucgcccucugaccccgcgggguggcaucgccggggccgccgcggcuguggcgggagcccccgcgccgcuuuccgccccuuccugcgccgacgggcgcugcgcagggagcggucggccugccggaugguggcgcggggcggggcaggcggggaggggucugacucaguuuccccucuggguggaggggguggcccuugacucagcauccucccugggugggggagcagagggaaccuugacucaguuucccuccacaccguccaugggggcagcucuggcuucguuucccuauuaggggagaacgcaucugauucaguuuccucucuggagggagguggggcgugcccucccucaauuuuccuuaagaaaguacaacaggcccugauucagcuucccucuggagaagaaggauuccuuaccccguuuucccucaagaagcagguguuucugguuccuuuccuccaccccuuaguuucaccgcagguucuagggagcagguccugacucaguuccccugggagggagccuggcuucuccucuccguggagagcagauuccuccuugugagaaugggcauugggugugugcugacccugaucucccuccccuuucagaacuguucccccucaucuucccggcagguaaguggcccccgcggcggucggggaggugcucccugggguagggcagugggggcagccgccuaauggggcugcgguguccccuggcagagccagcccaggccucuggccccuauguggagaucauugagcagcccaagcagcggggcaugcgcuuccgcuacaagugcgaggggcgcuccgcgggcagcaucccaggcgagaggagcacagauaccaccaagacccaccccaccaucaaggucagcacugcgccagggugugcggggaagggacuguggaaccccagcccucuguguuugggagucagguuuggaugucugggccucuguacuuuggacagaucaauggcuacacaggaccagggacagugcgcaucucccuggucaccaaggacccuccucaccggccucacccccacgagcuuguaggaaaggacugccgggauggcuucuaugaggcugagcucugcccggaccgcugcauccacaggugaggucccugcaggcuaggaggcccagcaugaggggacaggaggcgggcuaugaaguagccgcuacaguguuacuccuuucuggacccagggcagaauuccucacuccuugcccugacucagcucugcaaguaaacugccuuugucuugaaauuaucuauuuguacguuuacucuagcagaugaguuccaggggauacggaugggucccuaaucacuucugaauuccugaccccuguagcuggaaggacaagucccucagagucacgucucuuguuugaggaagaaaaccauugaaccagcacucuccccuggaguugacauugcaguugacagagacaggcuguaaaaaaauauacaggccgggcauaguggcucaugcuuauaauccuagcacuucgggaggccaaggcaggaagaucucuugagccuaggaauucaagacuagccaaggcaacauagugagaccccaugucuacaaaaaauaagaaauuagcuggguaugguggcaugcgccuauagucccagggaggcugaggugggaggaucgccugagcccaggaggucacugcugcggcaagcuaugauugcaccacugcacuuggguggcagggcgauaccuugucuuuuuuuuuuuuuuuuuuuuuuuaagaaagagucuugcucuguccccagacuggagugcaguggcgcgaucucagcucacugcaaccuccaccuuccggguucaugccauucuccugccucagcuucccgaauagcugggacuacaggugccugccaccacgccuggcuaauuuuuuguauuuuuuaguagagacaggguuucaccguguuagccaggauggucucaaucuccugaccuugugaucugccugucuuggccucccaaagugcugggauuacaggcuugagccaccgcacccggcccgacacugugucucuuaaaaauaaauaaauacacagauaaauaaacaaggugcugucagaguaacaguuucaguccugaaaauaaaacgaggucauaggauagaaggauaaccuggggugggggaguuaggggagcuggugugugaugacuuuagauugggaggucagggaaggccucccucagcuaagacuugaauggugagaaggaggagagaaguaggaaaagaacauuccaagccgaccaaacaagugcaaaggccuugaggugggaaugaguguccuguguuuagagaguggaaaaggagccccgguggcuguaagcagggagcccacagggaggcuggcaggggcaggggcacggaggugcuugucagcugagugaagggacaggguucguugcagcacaguaggaagccacuggagaggguuaggcauggagcgaugaucuaggggugggcagaguaggaaggagcaggcugggcaaggcaggaaggucugggcucugugagagacagugggacagacgacugggggcgcucaguuuccagaaccugggaauccagugugugaagaagcgggaccuggagcaggcuaucagucagcgcauccagaccaacaacaaccccuuccaaggugagggcaaaccugccugccacacccgcacccucugucacccuccccagcccgccuuuccugcaucucccucacuggccaagacacaguaaagcuggaaucuuggugcccauucaguacucucccacuuuaccacugggaaacugagucccaggaggggacaugacauucaggccacaguggagucagugcuggguucugccuccucuaggacuuguguuucacacacgcaccagcggcccucccagcgcagagcucccugcccccacugauagcaccuauauccccacuuccccugcucuccugaucgccuguuuucuuggcaguuccuauagaagagcagcguggggacuacgaccugaaugcugugcggcucugcuuccaggugacagugcgggacccaucaggcaggccccuccgccugccgccuguccuuucucaucccaucuuugacaaucgugaguagcgagggagacgcaggaaggggagagggugggccugaauaggaggaaggggguuggggugaguguggccugcaagaggcgcucuggcuucauucaaucaucuugcguauuugucuacucuucucugcccagcucuuuguuggcuggggagagagggcaaagaagacccagagcuguccuugagguguagcucuggccuggcaggaagucuagcagagagucugaugggagaugggcauuuucaguauugugugaugagaagguggugugcccacaacugcgauaaugacucuaggaaaugaacucccaggaacaagauaguguucgagaaugaugauucagugauggaagcccacagaugaauugggcugacugaucagcugcagucuuuaguuaaguaaccagcaggaugaauggaaauaaaacgaaucuggagccccaaggaugggaaaccaggauaaacugggggucaggagggaagggcucauugccaagguggguauggacuggccuuaaagauugcuuuggucagguggagaaagagugugaucagauuggcacccacuggacuauaagcuccgggagagcagagagguuuggguuuuguguguggucguauucuugcuuagaucaguguugagugcacaguaggcaaauacuuguugaaucgguuggggugaggagcuaauaagaaggucugacuuuggcuacaaagguguagguggcaagcucugggcaaccuugacucugggcugggcagggaaguugcaucuccugcaggccacccuggggaccucucguggcucaggucauccucccuuguuuucacugccucaggugcccccaacacugccgagcucaagaucugccgagugaaccgaaacucuggcagcugccucgguggggaugagaucuuccuacugugugacaaggugcagaaagguauacaucaggaggcaggggugggcucuugggagcaaggggugaagcugagcagagaaguggagugucagguaacuggcuuuggauacuuccuccugugccucgggggccucaggugggccgaagggugauguaucagaagacaagcaucagaaguugagggggagaccauggaggguuagacacacugacccacacugccaccgcaucuccugcagaggacauugagguguauuucacgggaccaggcugggaggcccgaggcuccuuuucgcaagcugaugugcaccgacaaguggccauuguguuccggaccccucccuacgcagaccccagccugcaggcuccugugcgugucuccaugcagcugcggcggccuuccgaccgggagcucagugagcccauggaauuccaguaccugccagauacagguacacagcugggguggcagcaucagggcagcugggcucugugccgugagagagaggccaagacugcaugucuggggcugugguugagggccagaagcuggagucagagcuugggauccaagaaacuggaauccauuucuugccucauuuaauaauaaugauaccucagacauugagcuaguacuacacaucugccccuauuccaggcacuucacuggauuaccugauuuuaaucucaugacccuuuugaaguaggagauaguguccaacuugccuggguucacguggcuaguaaguagcagagucuagcagagucagcguuggaacccaggccaucuggcuucaggauccuuuugccacacugguugucuugucacuaccauacagcccagccacauuuuggucgagguuugaguguccacuugguaccagggccugugccagguauugugaauacaaaaaaugaguaagacaugcucccugcccuucagagucucagucacuugaggaagacaaaugugcaaaacagauccuuaagucacggaaugacaugugaaauggaggugugcgcagagaagcacgggggcacaguggccuccggggagcuggagacagcugcauggagaagguggcauugaagcuggagaaagacacagaaguguguucuccaggcagguggcccagcaccuggaagggaagggguguuggcaacugcacggccuauucagggccaccuucgugguuugagcugauguugggcagugagcaggcucagagauuggagggccugguuaagcugaaggccucuaagcagagaggugacaggagcagauuuggaaguugacucaggaggccacguguagaagaucagagacagacagacucaaagcagggaggccauucuggaaauguugcuguaguccaggaagagaagaugcggcacaaaccuuacagaaggaauagcagagcaagaucacaucuccaccacuguccucaguuacccuucagcccugcagccguuuugcgucuuacagaccaagcucagucucaccucaggaccugugucuagcuguugccucugcuuggaaugcccaagguuuuaaugcaaguggcucaugccaguccuucccugaccucuaaauuagcccuucccucuacauuuagacuguccugaccucacuuccaguauuguuacaucaccauaucgucccuggaccaccgucacuugagauuuucugguuugguuuuguuuguuuguuugagacagagucucacucuugucgcccaggcuggagugcaguggugcaaucucggcucacugcaaccuccaccucccggguucaagugauucucccugccucagccucccgaguagcugggacuacaggcgcccgccaccacauccggcuaauuuuuuguauuuuuaguagagacgggguuuucaccauguuggccaggguggucucgaucucuugaccucgugauccacccgccucgaccucccaaagugcugggauuacaggcgugagccaccacgccuggccgagauuuucugguuuguauauaugauugugucccucucacuuuuucacuaggaugccaacuuuuugggagcagacaccuugugugcauacucacggccacauccccagugucuagaagggaggcuggcacauaguaggugcuugauaaauauaugucaaguuacuggcggggagugagagaaaagaagauaaucauuccaagguuucuagcuuuggugacagggcagauggcggauggucagggaaugcaggagaaagaaccuaguuuuugagggaugaugagguugucuuugaauugauggaauugaagugcuuuggagcuacugaaauaccacuguaauuagaaagacaguucugaaagcucugacuaaaauaugaaaccauuagagauaagaauaagagucucugcugaagucuuaaggcaguugugccucagcugccccagagugccaagaaauucucgccaggccuggguggaggcugacaaugagccaggaugugagcagugcaggaaggugugagcuggaggcuggggccccccaggucuccucuuugcccagagcauggccccuguacucggccucaccauguggucuuagaggggcagauucagccaacagaggccuccaaaagcugugggauucucagaacugcugagugucacacaucccuucucauuggcagagaagguugggagaaugggucuugggaaagccuggcuccuccccuuccuccugagggaccuuugagagcgucggggacccaccugaggagagcaagucccacuucucccccuuacuuucccagacgaucgucaccggauugaggagaaacguaaaaggacauaugagaccuucaagagcaucaugaagaagaguccuuucagcggugagauggggacugggaaagccagagaggaaggcagcgggcagggaggggacacccuggggcugagaacugaccuagcccuugcccuacaggacccaccgacccccggccuccaccucgacgcauugcugugccuucccgcagcucagcuucuguccccaagccagguaaggauuuccuuuugucccacuggaacgacagguucagcucuguucagcugaggagcaguggagaugaagacuccugggccccauuacagaccuacugaaucagaggcuuugaaaggauggcgcaggaaccagcgacuuccugggaugcuaaugcacacugaagccugggaaccaccgugccacuuaaauucuauauuggguaucuugggaaucagaaguuaaaaaugcagaaucucugcucucaucucucacuugaauugggggaacaaaaaucaccucuaaauuagcaagaugugugugccugugcgaggcucaaaaacugacaagcucugcacuucaggccgcugcucacuuggugcuccaugggcucauugccucucaggacuuaguuuuucagcuguaaacugaggaguccagcuuaucucuccaagugucccuuccucuaaaaggcuggaagaguuucgugggcuugaguagucagggaggacuccaagguggagguguggcuagaacuggacccuacaggcugggucagaugggguaagaggaaggagauaggguguuggcagugacucccuagagagggauugagccugagcaccaugaagaggggcugggguacagaggacgggguggaucucuagggcuuucucugaccccugccucucugucucucuccuccagcaccccagcccuaucccuuuacgucaucccugagcaccaucaacuaugaugaguuucccaccaugguguuuccuucugggcagaucagccaggccucggccuuggccccggccccuccccaaguccugccccaggcuccagccccugccccugcuccagccaugguaucagcucuggcccaggccccagccccugucccaguccuagccccaggcccuccucaggcuguggccccaccugcccccaagcccacccaggcuggggaaggaacgcugucagaggcccugcugcagcugcaguuugaugaugaagaccugggggccuugcuuggcaacagcacagacccagcuguguucacagaccuggcauccgucgacaacuccgaguuucagcagcugcugaaccagggcauaccuguggccccccacacaacugagcccaugcugauggaguacccugaggcuauaacucgccuagugacaggggcccagaggccccccgacccagcuccugcuccacugggggccccggggcuccccaauggccuccuuucaggagaugaagacuucuccuccauugcggacauggacuucucagcccugcugagucagaucagcuccuaagggggugacgccugcccuccccagagcacuggguugcaggggauugaagcccuccaaaagcacuuacggauucuggugggguguguuccaacugcccccaacuuuguggaugucuuccuuggaggggggagccauauuuuauucuuuuauugucaguaucuguaucucucucucuuuuuggaggugcuuaagcagaagcauuaacuucucuggaaaggggggagcuggggaaacucaaacuuuuccccuguccugauggucagcucccuucucuguagggaacucuggggucccccauccccauccuccagcuucugguacucuccuagagacagaagcaggcuggagguaaggccuuugagcccacaaagccuuaucaagugucuuccaucauggauucauuacagcuuaaucaaaauaacgccccagauaccagccccuguauggcacuggcauugucccugugccuaacaccagcguuugaggggcuggccuuccugcccuacagaggucucugccggcucuuuccuugcucaaccauggcugaaggaaaccagugcaacagcacuggcucucuccaggauccagaagggguuuggucugggacuuccuugcucucccucuucucaagugccuuaauaguaggguaaguuguuaagagugggggagagcaggcuggcagcucuccagucaggaggcauaguuuuuacugaacaaucaaagcacuuggacucuugcucuuucuacucugaacuaauaaaucuguugccaagcuggcuagagauccgc

SEQ ID NO: 18677 - RNA, 13551 nt, Homo sapiens
cccagcauggccccgcccccaggcggagccggcgccgggagcgguagcgggagagcggcagcgggaccccagcgcgggcggcggcggcugggcgggagccccagagguacuggcgggagcaggggacgggaggcacuacugucgggcccgacaggggagagguggccuagccgugggcccgggugauguguaugggagugggguccucgccacguucgccgccagcacccucccaacuucccuccgggcuccagcucagucccgagucaauauguccagcccccugucucugaccagccguuccuacucucucugugugacggcuuagccuggccagccagccggugaguggaagcggcggcuccugacuccugguggcggcacugugacccccucccccucaacacugcaagugugugcggggcucccccuuauucugaggcuccucuucuucuuaggcggccuccaccccagucccuggccuggccugggaggaaacaucugucgcgcccccuggcagccgaaauggggucaugaccuccagaugugcugggaaguggccagcuccuccuccuggggcagccaggccuuccggaucugugggggcggggccggcccuuuccccccaccccuagugacacaggcccggaggaauguccuagccucaauggacccugugugaagcuucaggguggggggcagagcccgagaacaccccucaaggcagcgccagagccuggcacugggccacagcaagaggcagcgcacaggcugggugcacacaugcacagaucucacuuccaagcgugcagagcucagcccacaaggagcggggcuugcacagacccccucccucaugcccuccuacuccuucacacacuauagcccaggcccgagcgcugaaugugcccagagcuuggcucauggagccaggggcuacacccgucacacacacacauagcuagcgacacucaccucauucuucucagucucucagcagccuugggaggggacagaaauaauuaaacccaauuuuuuucuuuguuuuuuuggagacagucucacucugucccgcaggcuggaguucaguggcgcgaucucggcucacugcaaccucugccucccagguuuaagcgauucuccugccucagccuccugaguggcugggacuacaggugcgcaccaccacacccggcuaauuuuuauguuuuuaguagagacaggguuucaccauguuagcuaggcuggucuugaacuccugaccucaggugauccccccgccuuggccucccaaagugcugggauuacaggccacagccaccgcacccggccaguuaaccccauuuuagagaugagaaaacagaggcucaaggucagcaugggaguuuauucaggagaaaucaagguagaagcaccugggcuggggagccgacucuugcuugguucuggaggccccagacgaaggguguguggagccccuccuccaccccccuccggcccagccccgcaugauguugcuggaugcugcaugaagacccaccauuagaugccuguacccccaguggagguuccccagcucccuguccucacugccuacuccauccagggcuugccuggguguggcuucccucaaguucucacaccaccauuugcaccugccucuggcgucacguuuccgcacuuagcaggucccuggggcuuugggugucucaaucuugcauccugugagaccuugaaccucagcccaacacccaccccccaaaaccuacgcacacagacagcagugggcaggugcagcccugcuuagggccuggagaugggcagacccaggcucacauccuagcucugacacggaauugcuucaggcaagagcaucuccucuggaccucaucugaccaucugucacaugggguucagaccucccugucugcaucagugagaccagguaggcagaggucccuaugggucccugucauugugacuccucuugcccccaagccugggcacaguagccugcaagaaggugaguuggccuguccuucagggcagggugacuggggucccaugacagcugcugugaccccagcaccuuccucaggaugugggggccuggcagagggcugggcccacaguuggggcuacuuccugugcugaaggaaguccucuugccauuccugcugcccugccgcugccucccugggaacccauguguccuugugguauugaggccuugagguccagggcacugagaucagaccucucugggugaucagcucuccagggacccugaaggaagugggaggggcaaggaggaaggucucuggggacaggacguccucccuuuguuaagugggcaggacccagacaccaguggccccuggguuucccgucccagccaauacaagucaucuguccgguugggcuagguccuggugggacccuuacucugggcccaggccaaagcuaagguguguggguggcgacugggggacccuggcagucccagggcugcccaggcuccaggacccucaggaccaagacccaacagcccagccucuagccuugcccagcuaagcuggggagggggcuggaaacuuuagcccuaggcagacaaggaaguggccuggaaagcggaagcagcuuugauggucucggagggggccggaagccaacacgggugguggaggaccaggcugggggccuggguuccuguuuucugcccaggccccucugagcagcccccuccuccuucagggcaggaacugcugccacaaccucaggcugggcaccaaacacccgugcccgccaaugcggcccagcccccggagagucaggcccacagagcaugcccaugugggccggcgguguggggagcccucggcggggcauggccccugcguccacagaugaccucuuugcccgcaagcugcgccagccagcaaggcccccgcugacaccgcacaccuucgagccgaggccaguccggggcccacuccugcgcagcggcagcgaugcaggcgaggccaggccccccacgccagccagcccccgugcccgugcccacagccacgaagaggccagccgaccugcagccacuuccacccggcucuucacugacccgcuggcacugcuggggcugccagcagaggaaccagagccugccuucccaccagugcuugagccucgaugguuugcccacuaugacgugcaaagccugcucuuugauugggcuccgaggucucaggggauggggagccacucagaggccagcucugggacccuggcuucagccgaggaccaggcugccagcucggaccugcugcauggggcaccuggcuuugugugugagcucgggggugagggugagcuaggccuggguggaccagcauccccaccugugcccccugcacugcccaacgcggccguguccauccuggaggagccacagaaccgaaccucggccuacagccuggagcacgcagaccugggugcuggcuacuaccgcaaauacuucuauggcaaaggugaggaaaggcaguuccagggaguggaggaggggggcugaagaagaggucccugucaccugcagugcacacaguagggcucaugaacuguccauuuccuguaaagucccuggcccugggagggcucaagagcugagcugggguccuccuggaccuacuuucaaccaccuucuuaaggcuaaucccuggcuccucacccccagccagggcuggucccucugccuccguauugguucauccuccaucugguucaaccugccaggcuggggagagauucccuaugggcuuuucuguggggugaaaacucaggccucaaaucccugcauccgugaaccuuguucgcaccagcacugcggagagagggcuccaggacauagaagggagaaugagggcgugguggguggagccaaggcaggauuuaggccugggagcuggccgcgugggucuaggucugggucuggguccaccucugggucaggguugagaucaagauauugagcucggggcuacagaggggcgggacuuagucuagggucaacauuugguggugagaugaagccuagggcggggcuuagugaugcgcguggucgagcgggggcggggcugccagagggcgggaccaaucguuuucuucggcgcggucccccagaacaucagaacuucuucgggauggacgagucgcugggcccgguggcagugagccugcggcgggaggagaaggagggcagcggagggggcacccugcacagcuaccgcgucaucgugcggaccacgcaggugggccgggaucgcgggaucaggacguggguugccuccccgacaccuuguaugcauccugagugcccuuacaccccuuccucagcuccggacacuccguggcaccaucucggaggacgcgcugccgccggggcccccacggggucuguccccaaggaaacuucuggagcacguggcgccgcagcugagccccagcugccugcgccugggcucagcuucacccaagguaccacggacgcugcucacacuggaugagcaaguggugaguggcgggccgcggagcccccagccauacagcuggccccagucugaacccagccugcccagcucccaaaccccuagccuugacccugauccugggcuggguggugaccccagaagagcuggcuuuucagagacagggcaucagaguucaucuggagccuugcgucucaaagugagcucuguagaccagcaguauccacaucauguagaaaugcagauucuggggccccaccccagaccaucugaaucagaguuugcacuuuauuuauuuauuuauuuauuuauuuauuuugagauggagucucgcucugucacccaggcuggagugcaaugguggaaucucagcucacugcaaccucugccuuccggguucaagagauucuccugccucagccuccugaguagcugggauuacaggugcaugccaccacgcccagcuaauuuuuguauuuguaguagagauggggguuuuaccauguuggccacgcugguuuugaacuccugaccuugugaucugcccaccucggccucccaaagugcugggauuacaggcaugagccacugcccuuggcccagagucugcauuuuaaaaagauauuugcagcccuagaugcccuggucugacucaccccacugguccugcaguucccgcaucauuccuggccaauuucccccacagccccugcuggguuuccucuaacauguggugcucacagcuuccuggagcggcuccuuccaucccccacuccaugcugaaagcugcccauuggcugagucuucuccucuguaucauucaacccaucagucauucaacaaacauuucuuagaccuuuuuggugccaggccucagacuggaugcuggggacaggucuagaccaggugcuuugcuugaguagcucacagcugggugggagaaagagacccacagagaacugcugaaacacaggagcaguacuggaacacugaaagggaauguugagggcugccugggccacgacgguagugaugagagcccuuccuuggccaggguuuuccagcauggagaacacaaaagggcucaggcccggauaagcagguguuuucuggucagaaggaauaacuugugcaaaggcuuggagaaugagagcauggcacauuaggcagucaguucagcguggcugggguugggauuguggggaggggcgggggagaagcuugcauuuguucccguggacacuggggagccauggagggauacggugcagaucugagaggggcagcucucuggcugcagcauggggacuagacuguacggggcggggaugccaggcugaaggcuauugcaguugcccaggcuagacacaguggcagcgauaguggaggugaagaggaggugacaguccaggaaggacuggguagucauguggcugacuggaaggggugaagugcuaggauuucccagcuucuuggcccccaggaguggugguuuaaggaggaggagcagggugggggagucacagcaaggugagacauuaggcagccggagaaaaaggcccgggguuugguaggccggucugaaugggaggcggagaugggggugucauccuugcugcagccagggagggggaggagcauggguggagaagaggcccaggcagaagagggcgggguuccuggggcccuaggcaaggugaguuuccagcuauccccagugccaccuauggcugagaggguaccaggaugaggccacaucuggggaccauauggggaguggggggugcaggggguugggaggaaugaaaucgaaguggggacuguaagugcagacaaguuuaguuguagaaaagggaggugaccgcuggaggggagccugugcuguuuggaggaguucagagcaccuugagcugggcaugguuauccaguuauccgcagagggaagagccgggaagagggcacagaaaugggagcauggggggcagagguggugccuggccugcaggggcuggggugggggugccuuggauucaggggugcagaggacaguccagccuugagauaaggaggaugauaauguguauguuuauuggaaggguccuuucugugaaucaccuucucuacugccacaugggaaccagccuccucccaucccuuccuaccugugcacucccaagcacgaggagcacaacagacuguacucaccugacaggcaagggcacaaguggcucagagagggcuggugcucagccccaggccagcgucccauccauucccuaagagcuggugggguggggcugcaggggacugagaccuaugccuucugucucccacccacagcugagcuuccaacgcaaggugggcauccuguacugccgggcgggccagggcucggaggaggagauguacaacaaccaggaggcgggaccggccuucaugcaguuucucaccuugcugggcgauguggugcggcucaaaggcuuugagaguuaccgggcccagcuagacaccaaaagugaggcccaggggcaggaggggugggagcagaucugugcugaaggggugagcacaaauugccuugucacuccuuuguccguacaauccuggggcuggggacuggagaguucuuugggugagcuaaggaucugagucagggcuaugagggccaagcuaugggcugaaaagaggggcugggacugucccucaaggcccaaguacccuacugccugagcuggggcuaaagugguuugggggcacuaccccuccaccaaacacauuccagcagcucagccucguggaagagaggugccccuaccucccugguggaaggggccccaggaccccugggagguguuguacugagcacccccugccugcuuuucacuuucccagcaugccacacaugcuugggccuggagugacaccuguccuccuaggacaccugacccugcccucccucugagaccacuucucauuucugucuucauucuauuucaacucucccauccugaccccccuucacucuggcauggggcuggagccuguggagggagaggaggaggggcacccagggcugaggcccuugaaucucgcuggcugggcauuggcugguggcaugacugguuguccaccugcuguuuggggcacagaggcuccuguguacaggcaggaauggcaaguucaagccacuuagauuccccuuguuuucuccuucugugucccuaacuuccuggccacagcggauuccacaggcacgcacucccucuacaccacauaccaggaccacgagaucauguuccacguguccacgaugcugccuuacaccccuaauaaccagcagcaggugugagggggaccaacguggggguggggcuuccgggaaccauggagggcccugcauggcccaugacguuugagcuuuggccggagcucuguuggccccaacagcccgccccucugguggccccuucccaaagacagaaacacccuaggucuucaccaggggcagugggggagccauuggugccuuggcuuucuccugccugaaugaggagggguuuggggcacagaagaccucaucacgagccccuacuauccaaccccuagcuccuccggaagcgccacauuggcaacgacauugugaccaucguguuccaggagccuggcagcaagcccuucugccccaccaccauccgcucgcacuuccagcacguguuccuaguggugcgggcacacacacccugcacgccacacaccaccuacaggugggcaccggaguggucccaggucucccgugggcauggaguccugccgccccucacuaacgccucccuccccgcaggguggccgugagccgcacccaggacaccccugccuucgggccagcucugccugcuggcggaggccccuucgcagccaacgccgacuuccgggccuuccugcuggccaaagcgcugaauggugagcaggcggccggccacgcgcgccaguuccacgccauggccacgcgcacccgccagcaguaccugcaagaccuggccaccaacgaggugaccacuacgucgcuggacucggcuucacgcuucggccugcccucccugggugggaggcgccgggcggccccucggggcccaggcgccgagcugcaggcagcgggcucacugguguggggagugcgcgcggcgcccggggcgcgggucgccgccggggcucaggcgagcggccccgaaggcaucgaggugcccugccugcugggcaucucggccgaggcucuggugcugguggcgccgcgcgacggccgcguaguguucaauugcgccugucgcgacgugcuggccuggaccuucuccgagcagcagcuggaccuguaccacggccgcggggaggcgaucacgcugcgcuucgacgggucccccggccaagccgugggcgaggugguggcgcgccugcaggugagcuggagugguaaacuggggccccugcgcgcggcggggcggagccugcuuuggaccccucccucccgccgccuuuguccccuacuccugcggaagggaaagucgaggagggcagagccagccccggggcuuggcaaggccggaacuggugcccucggguaagcgacuucuggucuucaucccucgggcgguggcacacgcggcccucggggacuguggaaaguuccguguggccugggacgcaguccagggggcgggcgcuggggcggccccaccucccggcagccccgcccacucgucccgccccguccgcagcuggugagccguggcugcgagacccgcgagcuggcgcugccccgcgacggucaaggccgccugggcuucgagguggacgccgagggauucgucacgcacguggagcgcuucacauucgccgagacggcggggcugcggcccggggcgcgccuccugcgcgugugcggccagacucugcccagccuccggcccgaggccgcugcccagcuccugcgcucggcgcccaaggucugcgucaccguccugccccccgacgagagcggccggccccgcaggucagggugccggggacgcggggaggugggagggccggcaguuggccaccgcgcagucugcgccucccgggucgccaucagcaguuucaggaacccaguguggauaccuuuccuucuggaaagaaucucccgucucuuagcccgucugagccugucucuuccugucucugucucucucucuuucucuguccuuccuuccucucucucuccucucucuuuuuuuuuuuuuugagacgaaguaucccucuuguugcccgggcuggagugcaauggcgugauuucggcuuacugcaacauccgccucccagguucaagcaguucuccugccucagccucccuuguagcugggauuacaggcaugcaccaccacggccgguuaauuuuuucuauuuuuaguagagaugggguuucaccaaguuggccaggcuggucucgaacuccugaccucaggugauccaccugccucgcccucccaaaguucugggauuacaggcgugagucaccgcgcccugaaccucuaucuucauauguagaaugggaccaguuaagcgcguugcucccacugcuuaaaagaucaaauagcagcccccacuaucuuuuuuuuuaaguauuggcacccgcccacccaacacacacacuacacacuauugauaacuuccugugcuaagccagggguaggcaaacauuuucuguaaauggccaaauaauaaauauuuuaggcuuucuggaccaucuggucucugccgcagcuacucugucguagguaaaugaauaaauaaaugugccugugucucgcuaaaacuuuauagacacugaaauuuggauuuuacaugauuuuaacuuaucaugaaauauucuuuugauuuuuccacuaguuaaaaauguaaaauccggaccgggcgcgguggcucaugcuuguaaucccagcacuuugggaggcugaggcggguagcucaccugaggucaggaguucgagaccagccuggccaacaugcugaaacccgucucuaguaaaaauacaaaaauuagccaggugugauggcaggcaucuguaaucccagcuacuugggaggcugaggcaggaaaaucacuugaacccaggagguggaggagguugccaugagcugugaucgcgccauugcacuccagccugggcaacaagagcaaaacuccaucucaaaaaaaaaaaaaaguaaaauccaugcuuagcucgcaguacagaaacuggcacaucugcuuuagaaaagaaaaggaaaaggcacaggcuggauuuggcuacagacaguaguuuugggauuuaagcaauuuacacguguuauuuaaauccucacagcacacuaugagguucguacuauuauccccauuucacagauggagaaauugauguucagagugauuugcuugggauauacaggggcagcacuggaauuugaaccauggucuggaaaaauggccaguaaccaggcagacauuuuucacuguugucaggaugccggggagcucuccugcuccuggaagugagccuggcgggcuggggguggggcuagugaugcaggacgcuggggacuggagaaguccugccugacccugucccaccccacaggaguuuuucggagcuguacacgcugucgcugcaggagccuagccggcggggggccccagauccugugcaggaugagguccagggggugacccugcugcccaccacaaagcagcugcugcaccugugccugcaagaugguggcaguccuccagggccuggggaucuggccgaggagaggacugaguuccugcacagccagaacucgcugucaccacgcaggugcacacucuuggccuucccucuccuccaggccucugggaaagcggcuucccuuucugagccaccccugcucuccccagcucucugucggaugaggccccaguccugcccaacaccaccccggaccuccuccuggccaccacagccaagccaucaguacccagugcugacagugagacaccccugacccaggugagcagaaaccaggcucuggagcccaacagcacaguggugacagugggcaucacugaaucuguauccacuucuguggcacaggacaggccaggcagucccaguggcucugaggacaagggcaacccggcgccggagcugagggccuccuuucugccacguaccuugucucugcggaacuccaucagcaggagugagucuggacccaggagagcaggggagggguuggggggugcuccugggcuucccuagcucagccugcuccuugugcccacagucaugucggaggcgggcagugggacccuggaggacgaguggcaggccaucucggagauugccucuacuugcaacaccauucuggagucgcugucccgagagggugaggccaccagggugcugcgguaagccugggcagugcucuugcccccuuucugaccugcccaccugaucccuuuguccccacaggacagcccaucccagagaguggagacccuaagggaacuccaaaaucugaugcugaguaagcuccccaacuccccacagccgcuuuaccugcccacaugacccccccuucgugccugucugcugggguggagcucuguccugggcucugcugccacauaugccuagaagaccagcggggccccucucauuagcuggggcugggagucagcuggugcacugcccccugccuugguccugcugagucuugacccccaugucuucaggccagagccugggaaccucucagagaaggucucucacuuggaguccaugcucaggaagcugcaggaggaccugcagaaggugaggggugggcugagcuuggggggagucacagggcugccccaggaaaggggcuggcggcucugacuccugucuccccggcaccccaggagaaggcggacagggcggcccuggaggaggaggugcggagccugagacacaacaaccggcggcugcaggcggagucugagagugcagccacacgccuccuccuggccuccaagcagcugggcucacccaccgccgaccuggccugagccgucuggaaccaccugggccccugagggcacuguggucacacugggcccuccucaggaacucucccugcgcagaggcgugucuuagcacugccccccucccuagccccuuauuugguggcggaaguggccuccaccccuucccuguuuguaaauauucuguggagaaaagaggacuucagggaguaaaaaagccacugaugucugugucugaacauguguccaagacagggcagggcaagggguuuugccuccagaggccccagccaaacuccucggaccagucaggacaggcccugggaacacuggcucagagaugggcuggcacucacugaggggucccugaggccaggccacugcuuggcuucucucccauaacguuuauuugguucugcagggaagcagguggccacaccccacagcuacccuggccgugcaucacaaggcccugugccucagugcaggccucacucuucucucugaagccacugagcccccaggccuuguccucucucuacccaccuggccacuucuugcagggcccaauuccagaggcgguggcaucuccgccucaguugacuggggcuguuucuauguccuggaggaaacgggcccuugacccacuucccuccucaccagccuaugguccucucuguuccucgcgaggccaggccuuuccccgaaguggcaucaucaaguccaaacuugggacuuugucuaaauccuuugguuucuggaccugaggcccagauagggcagacuugcccagcaucucaugccuauuccagucccuucccuaggcuggcugaagcuccauggugagaccuaggcccugggucuguuaacuuaggugcuggcaggaugagcuaggcucggagaaacagagcaucugaggaucaggaaggcuucaug

SEQ ID NO: 18678 - RNA, 17962 nt, Homo sapiens
auguggggagacagcuuuugaguuuauuuggcuucuggcuucacuggaucccgaggcuaagacuccaacccuggcuggggcagcaggaaggcauccagagagcccuggccccagaugacccccagggcaggagguccaugcucuaagcccuagggcaggggccgcaguagcaggacuuggucaaaagugcuggugacagcugaggccggccccucuucccugcaccuccccuccucccugcaucaccccagcaggcaauucccugagacaggcucugguccucccaaccagcuggguacaguguugggccccaguagggcaggugagcuggggggaccuacagguuucagaugugggggcgcaggucccccuuccagugugaaggcuuccugugcaguguaguguuccugacccccaaagggggguggggucccuggggaaacugaggcagcugcagaggcugacccagcuccuguuccaguguaugcugugacuccuccuaaggcagcuggagcucgggggaguggccuggcccacucaaggccccgcuuccggcacccacggggccugggcacccaugucuuuggucugugcccugcaguccugggggccccccuggaagggguuggcagguggggagucccagaaggggucugaguccgggaacaagguccagggugcucggcggggugcaggcuguggugauggcaggggagaaggccguggcccagcugacacaaagcuccagggaucaaugcggcugcgaaggggcgagggccgaggucggcugaugaggcccagggguggugaacguggggugccuggggugccaggagcagagcgugauguccccggugggggugagacagugccuccugugaggauauaggaggggcacagggucaagcaacccccaacugcugagguccccaagacacuguccugcucugggccucaguuuccccaugugcacagugaccuacuugacucaacuuccaccgcccuuccugcuccguggugccucuguuuuuuguaauaguuaggagugaggccucugcagcaggcuggccuggauguggaucccggcccugccacuuacuagcugugggagcugugggucccuuaaucucugugccuuaaauuuccucaucuaaaaaugggcauccaggagcgcuuaguucucugguuguuaugacuaaaugagaccaucucgggaaagccuugcaaacaguacuuggcacaaguaaggagccaggaguuugcuacgauuaugauuacauguaugcugugucgcccaggcuggaguccagugucaugaucaccgcucacugcagccucaaccuuucaaggcucacgugauccucccagagugcugggaucacaggcgugcaccacugccuggcccgauuacuucuuuuauuucacagcaggcaucgcccccaccugccuggaccaccugauagcugaacuuagaacucugcucccuacaugcgucuucaguaccccgaaugccugguucaggguccagcugaugacuguggucucggccuugccuccuugcauguccccaccagccacuccucccucccugggaacccccgucucccauaugugaagcaggccggcuucaggccacucaccgcggggcuccuccucacgucgggggcucuuggcugaccgcuggcccacagggauacccagguccagcaacaggggugcaggagugggcggggagucgggcgucuugagcgagaagcagaugagcggggaagggggcggcucggucgggcagggcgcgggcguuggcgugggggguguugucggggacuccccgcgcucgcguccugggccucccggcggcugcaggucgcggccaaggcccagcgaggcgagcagggcggugccgcgcagcagcgcccgcuggaucagcuugggcgucccagagcugcuaccgcgcucugcggggacaggccucuugggcuccucgggcuccaggcuaggccgcgggggguuaccugcgggcagaggcggcacaggugaggguguggcuggugcauauuccgggugagggcccaagaccucuccguggucuuggaacaaggacugaguucugcccucuacuagcaucuucccuggucccacaggucccauggccuccccaucacauacccacauucuggccuuucacaagaugggcacugggaggggagggcagugcagguggaggaagcggcagcaaagcccaauggcagccagcgaccccagacccgaaagauggaugggcagucccaguggaggcaggcuggggccaggucacagugggccucuguggccugccaggggcaaccuccaggcccaggggcauggcaggucccacugacugggaccggcgcccugugcucugugcccaccagcuuccuggcuuggcagcccugccccuucugcccacccacccccgcuccagcuguagcuuauaagaugcacacagucaacucuaagguacauggcagcccugagggcauaaaucccugucucuauucuagaaaggaggaaaaugagguucagaggggucaguaccuugcccaaggucacagcuaauuuacagaguauguauuugugccaggccugagcugaauggcauaggggcauuauguugucugauucucaugccccagggguuccaggcucagagagguugagggcuugugcggagcuguacagccagugaaagguggagccggccucaccccaggcaagggcaguagaaccuuugcucuccaccauuucccagccagacucugcccuagauuucaagacacuaguguccuaccuuccagucuaggguuggccugacuccauucuagaccacuugggcagggauggggaaccccucauuaaggacaagggacucuaggaugggcucucacaagcccugauuuugucagaucccuccuuggcucuagaaacugcuguggcucuccacugucacuaggagaaagucuggccuccuuggcugguccucugaagcccucccuggccuugucccucugccuuuccccuccugccuggagugcagcagcagguuggaugucgggagggagaaauacaaggcugggaaaaaugagcuucuacuaugaaccaggacuuagcucacagucccuucugucagccccaacccuuacucagacucucugccucuuaccucacccaacucccaccccggccacugccacugaagggacaagggaauccuucuaaaaugcaaaccuguuaaagacaggucucugcuuaaaaacuacccaucacuuccagcuucauucacucauucauucaaucaacaucuacugacccaugugccuuggccccuguccgcagccccaguccugagacuccucggcucucaacucuucucggaguucagccagguugccuuuuccuuggguauggugagcugcaugccugcgcacacacuauucacucuggguggcugaccuuucccaccuuggcuuucagugaccucuuaugcaccauccaagaccaacugggaugucacuuccucugugaagcccucccagaaucucccugaaccuacacaguuauugcucacguuaugccucauagaggugcuacuggacuuguuuaugagucugccugcuucaucauaugaggucagggcaguguuuaacauguugaugccuggcucuuaaaaugcaaaucccugggccaggcgcgguggcucacaucugcaaucccagcacuuugggaggcccaggugggaugaucacgaggucaggagaucgagaccauccuggcuaacacggugaaacccugucucuacuaaaaacacaaaaaauuagccaggcgugguggugggcgccuguagucccagauacucaagaggcugaggcaggagaauggcaugaacccaggaggcggagcuugcagugagccaaaaucacaccacugcacuccagccugggcaacagagcgagacuccgucucaaaaaaaaaaaaaagcaaauucuuguuugaugaagaauccauuuuuauaauccuugcaccaaccacgagguuaucauaucacccccacuucgcaggugaagaacugaucauuuacagugaguuuaaacagaagaggggaaaucauguuuaaaaaaaagaaagaguuggccgggugcgguggcucacaccuguaaucccagcacuuugggaggccaaggugggcggaucacgaggucaagaaaucgagaccauccuggccaacauggugaaacccugucucuacuaaaaaauacaaaaauuagcagggcaugguggcacgcaccuguagucucagcuacuugggaggcugaggcaggagaaucgcuugaacccaggaggcggagguuacagugagccgagaucccgccacugcgcuccagccugggugacagagugagacuccaucucaaaaaaaaaaaaaaaaaaagcaagagaggcugggagugguggcucaagccuauaaucccagcacuuugggaggccaaguagggcagaucacuugaggucaggagugcaugacuagccuggccaacauggucaaacccugucucuacuaaauacaaaaauuaggccgggcauggugguucacgcuuguaaucccagcacuuugggaagcugaagcagguggcucacuugaggucaggaguucgggaccagccuggucaacauggugaaaccucaucucuacuacaaauacaaacauuagccgggcauuguggcacaugccuguaaucccugcuacuugggaggcugaggcaggagaaucacuugaaccugggagguggagguuguagugagccgagauugcaccacugcccuccagccugggcaacagaaugacacuucaucucaaaaaaaaaaaaauuagcugggcaugguggcacaugccuguaaucccagcuacuggggaggcugagggagaauugcuugaacgugggagguggaggcugaagugagcugaggucgcaccacugcacuccagccugggugacagaacaagacuccuucuaaaaaaaaaaaaagaaaauagcaagagcaagcugggugugguggcucacaccuguaaugccagcacuuugggaggcugggguggguggacuacuuaagcgcagcccagccugggcaacauggcaaaaccccaucucuacaaaaaauauaaaaauuagccaagcauggcaugcaccuguagucccugcuacucaggaagcugaggugggaggaucacuugagccugggaggcagaguuugcagugagccaugaucaugccauugcaguccagccuggguaacagaaugagacucuaucuuuaaaaaaauaaaagacagaaaugagacaaagggaagagaagauaggguccagcagacaaaaugagagugaacagaaguuccugcagucaauggccugagaaacugagguucugaaggguaagggacuuggucaacauaauccagcuaggauuugaaucugccucuaagcuuccuggcagcaagaguuagcaacucuguuguuuaggagaaagcugcgugacuauucuugacccaaagauagauagauagaggcgaaacugcuuccgugaggucucacagggaggacacagccacguaguuauuggcucuaaggcaacaagcuucacagggcaguugcuaucagcguagcugagugcacccugccaaugugccacuccuugcagccagcucuccagggaccagaacagcccacuggggacagggugagggugugugugacucuccagugguauggcuuaugccggggaccaucucacagggucugggaccucugugaagccccauuauuugauucuuagcuggguuucgggggguggcugugaggucaaugucauguacuuucauggacccagaugaugcguggagugugggauugggcuaggggaaccagaugcucagccagccacugagcugggcagcugacauccuuucagggcaaguggcaauccauuucuucaucagccaggaagggcacugguguugaggccgacauacuuaucaagaacaguaacuaccaugguuuccagugcuuucaugaaaccucagacauguggccuucuggccacacaucugcaauuucauauugugggagcauucacuguaucccugggggcugcggcucucucaguuugcaggggcuggaccaagaaagaaggcauuucagauuucuaugggcacagaugucuacagaaguuaugaugccaugaaauacuucgaggagaugaggaaggcugcuaucucucagaaugcaaagugauuuuggaauaugaagaauuucuuuggguugaauuacuuagaaguuugucacugaucugaacuauucaugaauauaugggcuaauaaguaguuucucuucauaaauaauuaacaaauucuuuggauaaaaaaacauggggcaagcuugagaacgauggggcccaggccccuugugccccugcuucugggagcugagggccagagaguucuguggaacagucaggaccugcuucagccuacacaccuggguugacaggcucucaaguucuccuuuggcccaucuggccugguacaauuuagagcaagugaauucaagaagccuccuuggccuuccagcucucaguucagucccugcaggacagaugcugggggcagugcagcugcuggaguagcaaauggcggggcagauggaggcccagggcucugccucuguggucagacaggcaagagcagaucaaaucccugcucuacugguugccuuacaucaaaccacuuaaucucucugugccucaguuuucucuguuguaaaaugcaggccaauacuacuacuccccucacagaacugcuuggcacauagaagagaaccaacaaagguuagcuguuguuacaacuaucaaguguagcucagggaauggaagaggcgaugggcugggugggaugggaggagugaguuuaaacggcuugcugaacaggacucuucugagagcagcuaagcggguccuacauucuggcugugagcagcaggugugggggcucugaggauggucccuagguuggcacagggacccacaggcaagggaggccauaacucucuggccucacucagagcugggcaguguugagcugagugagcccuccucccugcaaugcuggagcccugccuucugccugacccucuggcuuccuaagcagucuauacgugagaagcccuuucuucaagugaaagcuucugagcucacuacgagagcauuggagcugaagccucucuggguucaaauccucagcuggggguuugagguagguuacuucaccucucagagccucaguuuccuuaucugcaaaaugggguaauaguagccccucuucaucaaugcuuggagggaaugccuggcacaguagggcaguuaccgucauggagaacagaaaggccccgagcuauccuggauguggugagaauggguccuggauccugccugcucggccuucucauucucuucuucaccuacaggcucccagaaggggcucugagaagcacaguguggcugacacuuguuuggcuccaccccacacaggcugauuccuucccccaucuggguccagcuucccuuggguaccaaaugccaggugggcuuccugucuuucuuuucucccuggagccugcuaaaggcacaggggcugccauggggccagggaagaggcuucuugcaggccaggucugagcaaggggaugagacucugggccccgagccgaggccugggcuguaugccgcuugaucgugggccuguaggucagaccuggguuccaggaucggcucugucuugucucagccuugguuuccuagucucuagaaugagagcaaccagggcaggacuccugcuuugccuacuagccuauuguggccuccccaaggugcccacggaaggagcucagccagauccugccgggggaggaaggccacucaccauugagugcuggggguguggaaggagauccuaagggggaugagucaucugaauccagguaccauguggcuucguccaugcgggaccuucuccuggugaugggagggcaaggaggggugcuuuaggaauuucaggacuuggggaaagcaaaugaugcugggucuggggggcacucagguacucaccucccauucugggcuuccccaggcuugggggaacugggaccccaagcccagcaugcucgccgcucuccauugcuugaguccuccagacgucggggggacuggcggccccaugccuggccuggcucugcaggcuccacugcaggggaaaccgaugaaaucggagauaaucuuuauucucccuccaucaucacagucaggcuucagagauaaacuuuagaguauggggagcaggcugggcccuguaccauucccagggugagcuuugggcaagauagauggguuugggucuuggggccaacagugggguggggcaucucaucuagcccuugggcugaaguuugcugcuuaguaauuaguacagacacugacaccaacugccugaguuugauucuggcucuuccacuuauuaacuguguaacaaguuacuuuuuucacuuuucucauccauaaaacuuaaauuaacaacaaaaauaacuaccaaauagaauuauugcaagaaauuaauauuagcaaagcauuuagaaaauuaguaguacauagugucauacaauuauuugacuaaaaaaaaauaaguaaaauuaaugcugcuuggggaguucagagguaacaggcuagaccuaaggcagggagccugggggcggggaggaagaggggauagugagugggcuccgccuccaagaauaaggucugacagagaauaaggagcuggggggcggagaggggcaugagaggugaaguuucuuacacuggauggcucggaaccggggaaaggugggcgaauccccaggcccgaccucgaagacguuucuccuccggucaaggccgggugaggccugcacggugaugcggugcuugaagucugggauuuggguuggggggagcaggguucagguuugugaugaaguagagccaggaccccaaccugcaggggcccaaggccagcucccaggccacauagggagcggcacgauggcugugagacugugaccagccucacugcuuucuugagccccugggucuggauaaggaaagcuacucgucugagucggagaugcccuggcgccggccggccccgcccacuagaccuucccagaacuuucgugaaccccaccccuucccacucccagaccgacaugcaaauacuuccgccagaacccgcccacagacagaaaaaaaacacuccuggcuccaccccucccagccuucaucucacgggcccacccacaacacccuaaaccaaucccagcgcggugagcacacaggccuggcuccacccccacccccgcagccaauggcgggggacgccccggggcccggcccucaccgaguggcaugcugauacgcucgccgccgucgcgcgcccggagcuugcugcgcuugaaugucccgcggcggcggcgcacgugcggucgcucgcgguccaccugcugcagcagcagcgucagcucgcgcucgaacaccucuagcucccacugggccagcaggugcucgcgccgccgcagcugcuccgccugugaccgcugcucgcgcgccgcucgcgucagcuccuccucgcggcucaguaguuccugcgcccgagacagcgaugguggagaggucagccuggcaccaaucccggcagcgcccgccccgacucugccccagggagaucggggagacacucguuccaacgcugggucccuugauuccucgcaccuuuuccuuggcucgcagcucgucgaagagacccuggaucucgcgcuuccagccuuccugcauggaauggaaggagucccgcggcauuucccguaggaccugugccuccagcgccuccaacugcugcaggauggaggcgaagucgggccugcgguggggguccugcgcccagcagucuaggggcacggcgugcagcggggacagaauaagaagggguccguggguggauguguccugggccagggagcucuguaccucaccugcccuccccguccucuuaccggccauaagcugugcgaagggcucggggcagguggaugggaugggcagugugagcuuguuaacagcuacgccauaggccacagcaaggcagucaaugccacgguauggcaccuccccggucagcaguucccacagcagcaccccaaaacugugggcgagacaacaggucuguguucccuuuucucucccaacccccacccccuuacugccacuucacccaaaagcaacuaggagccaagugguuugggucccugucccuggacuuggcccagcccuagauuuaggcagccaccucugcccucugcagccccguagcagcccguccagccccaccaagggccgcaccuccagacgucacugcccuuagagaagguggaggccuugauaaccucaggagccauccaggcguaggugcccgcggcacucauuugugugguuuugugccacucucgggccaggccaaagucggugaucuucagggucuugugcuccaugucgucacucucaaugggcugcagcagcaaaacuagagaagaggggccagauuguggaugcuccaggaucaggugguggggacaggguaagagcugggagcaaacucaucugacggacauccuggcuggguccugggggcacagaggugacuuggucuagaucuugaggaccuacuugaggucagacauuucuuuucuuuuccuuuuuuuuuuuucuuaagauagaguuuugcucuuguugcccaggcuggagugcaauggcgugaucuuggcucacugcaaccuccaccuccuggguucaagcgauuguccugccccagccucccgaguagugggauuaugggcaugugccaccacgcccgacuaauuuugcauuuuuaguagagacaggguuucuccauguuggucaggcuggucucgaacucccaaccucaggugaucugcccgccucggccucccaaagugcugggauuacaggccacugcaccuggccgaggccaaacauuucacacucaaccccagcacucaaaaccauuuaugagcuaaauaauauuuuucauguuucacagaugaggaaaccaagcagggaaaugacuuggcagaggucauacaacaaauacagcagagauuacaaccuggucuguguggcucugaaaccaguguucuagcuuuucccuaauauuacacugaagcaaaacuggcaagguggcagcucuggacauuuauggcuuugauuucaagagagaucugugagucuccugucauuuuguugaggcaggagcgugaaucagaaccccccuuagaguggggagcaagagggaagcucuuggugagaaaagaagcccagcagguaccacaggccccuagugcccacaucacacuguggcaagugcagccacucccaaagcaaagacuccaaaagauaccuaccaaugcagcuggaagggaagagaaagggugggguccaagaaagugaugguucuuggccacaaaggaggagcuugggguaaauguaggcguggauggucagacuuggcaggggcucauggcuuuaacccaaauggggccaccguacuugguacaaagaggagaagcagcaacuugcauaucucucaccaggacaggaauggcucaaaugagagaaguuuucgaggaauagaaagaggacaaagucauagagucaugaagggucugaagggccccucuacuuuucagguuacagccaacugcacuguggaagagaagcaauaucaagucaaccauguuucuggacccaugucagggcacaccucucagcucuccugcccugugugacacggcugucaugggggcagcauagggcacaggggguggggcagaugggaagggcaccuaauacagccuggugagucagggaagacuucccagaggagguggcagaaccagggugcucauuuuucagggcuuaaagcaacaagcccugauccugcugcuggccaggccaccugggccuugaggaggcaucuggcacugcugccagcuguccccgcugccccaccguccucagcccccacagccccuggcugcuuggcucuguuucuguguccuccaccuucagccauuucggcgcuggugcuucucagagcaugaccucuccucaaccucugcccacugccccuggcugacucagccucuuccagguaccagcucccucuccccacuggcaucuuccacauuugcaacuccaggccagacaaauugguucagcagcucuaccugauguccaggugcccuccaugaccaccuuuacuaucccggcaugcccaguagauuuuccugcaauuuuuccuaauccagagaauggucucaaaaucuacccacuccucugagccagaccuuggagcugaguccugaacacuucaucaagcugaggaugacaacaaaacccuccucagauggcugucacgagcaugaaacaagaccacacuuuuaaaguuuuugcaugggggcugccaccuggcagaagcauccuaaaggccaguuguccuaaagcacuuaucguaucuccgcccuccucucccuccucugucacuccuuacugccaacuucaaaacagccucuggucuggcugcuggaggcggggaccugagcauuuagcaagcccccgacgacaagcucauuccaaaggggaaacacagcaggcuggggcaguggguggaguggaaaugggcaccuccccuggugccagggcccaccuuccccuuugaagaccaacacuugcugcuucuuggccugucucuagccacuuguggcaccccagacuggcaaagugcuguuccaguaucucaggccggguggccacucuccaccuuuuucagguggggaaucugaggcccagagaggggcaacaacucacccaaaguuucaggacuucuuuguacuuguggucuuucugcuaccuccccgcuccuggcucugccagcugcuaagccccauccucugcuuucucuccaagcuccucucugugcuuucaacugucccaacucgaacugcuguucuggugucugauguagaucccaggcaugggaggucaggggucacccagaggagaaugggccagagaccccgaaacugggggaagcucucagugccccuuuagggcucccuggccucugauagggaccuggccaccagcucccucccugggcuggccucuguggggcuugggaguggccugggcagcucacaccucuuccgcuuuccucccguggucccuacuucuccuuucugggaggccugggccaggucucccacuugggagggggaguccuuuuggggagaacugggggaggucaggcccaggccgggcuggcuggucaguccugugacucgugggccuggagaauucccccuccucuccccgccaggcuuccucacaaggcccccauuguccaggaaaaucaugccauuguuuccugccugugccccccaccagcccagggacuccccccaccccaauccugcagacagcaacuugggccuaggacuggggucuccgagguuaaaugccaggcucagggaggcugagggcaccuugccugcccuuuaccaccaccucccagacucugagagggaagcaggggaacuagaggggaguaggggagcaguuccaggcuccuuccucccgcaaguccuccaccccaagcucuuuccuccccugcaggcagcugggcuagggagggagcaggggcuggagcagggacaggaagccggcucaggggcagcaggaaacgcaggaagcaguggggaggguggggagcaggggccugggcuauuguuccauuuuuucuggaaagaaaacggaggaaaaacagaagaugggaguccccucccccugugccuucggggaaucccccucagauuggggcagguagcgggggucccuagauaguuagagcccaggguugaggcugagaggugggaaccgcacccuaccagggaugagaagaguggguaggaugguuggcaggccucuccuggcucccccaguccuggcaagaacuuggauaucuggggcucagcacucuguuuccugcaagccccuuguccauggucagcccaggccaggaggcucaaaauauccacguugaccccccucuaagaaugucucaugcuuuuccagugaccacacugagccuggccccuccugcauuuccuacugcugcucuccagccugcacucugggcucuaggaggccccugcuccuggucccugcugugugcuggguccugcuuccaugccuucucucucuaaaugcugcgugcaccaggaaacccucugaagcugucacucacuucucuugggccaugaugggcagcgugucgggggcuugaaaugaugggagauggagucucccuuagcccagcacucccaucccaagcacugauuucaggcuaggcccucuuggcgauccagcccucaaauguccaucuccauggcugaggacccgcuguggguuggggaucgcaggucgggcuugcccaagcuguugagcuguuucacucucccuuuuuacagauucugaaauugaggcuccgaguuggaguaaccagcuagaggucaugaagccagggagggcuaggccagaauuccagcccuggccuuagccuugacugccaaggagggcuucccucucugagauaucuguucuggaggagcugcccaugacgacgggaggggaggacagagcaccaacuccacgaacaugaauuuaggggaggagaagaugaggagcacgagcuuccagaggacuuccuugaggugggagccauggcugggcaggaugcuuauggcccaccugagagauaccaauuucuuaacuuguccaaaccgcagcugcaggcuggggucaaggacuucugaagcuggcgcaggaagacucugcugggugccuggggcucuguuugggggcuagcuugagcccaugggcaccccuggucagcugggacccccuagggugggagcuccuaccugcaguagacccuaagcuaggcucaguggaagguugggagcagguguguaccagagccaugccacccccaaccaugcccccagaaacucacuguuguuggacuugagaucacgguggaugacgggcaccagggccucgcagugcagguagugcaucccacgggcaaucugcacagcccaguugaccagcacauggggaggcacgcgccgcccggccagagcucggcugaggggcccaccggcugcauacuccaucaccaggcacagguugggcuccuccaggcacacagccuugagggcaaugauguuggggugugccagcauggcgaagagccgggccuccuggcgaacgcucucggcugucacacugauguccucaucgggguccuggcgagcugccuucacagccaccagcucaccucgccagcugccccuguacaccuugccaaagccuccaaugccgaucaccuccuccagccgcagcuccuggaagcuggccaccucgcaggggggcgggccgccaccccgagacacauaguuggacgggaagaugcccaccuggccacccaccuggcccgcccaccagcccucgucuccugagauggcugcgucccgggacagcaccuccacacggucacccuuccucagggccagcucauccugcccacugggcucguagucgaacagggcuguccacaccggguuggcauaacccgcugccuuuggagaccccucaggccggccuccuccaccgcccccaccacccccgcugccacugccauuccaugacccuagagggcucuugaggaagaggcucuucaagggcuccauggccgggagccggcgcugggauguguggaggaccuucucugggugcccgugguccccacccccgcuggcugccaaggcccuagucccggaaccugggcauccgggcccuggcccucagccccagacccacgccucucuggggagccaggaguguugucucccggccccccgcaucucgggcuucuggaggagggcacccagggcaguguggucaggccggggggguggggccccggggccuccggcgccucaccauggcuagcuuggagggacccgagcuucccucgguucuggagcaguccugggagccuggcuccggcccccgccaaguguaagguggggccuucaggggcagcgccucaacuccgguugggucuuuuugcgcaggggguggagggagcguccgcaguugggccgagacugccuguuccuggccccgucuccuuuggccccgacggcuccgaccccgcucccuucuuccuccucccuuuguacuuuggccccgggggcgggaggcagagguggaggguggaguuucacuuuuuuccgcucuucucccuccugcaggaaacagcaucagaugacgcgggcggccugcaccgcuccccucccagaggcuccaggcggggaguucccggguaggcgggccaggagaggcagagagggaaagggcagaaccagaucccccaucacagcaggcuuuugagaucuagaaagaaaagcccccagcugcgugcucugcugccuaggguggagguuggucucugcuaaggaugggccaucucugcccucugcauccgcaucggcggcagcaaaacgggguuacagaaccacacuugggaagggggugaacccgagucuggucuuggcugcgaaguugugggacugugcgauccaucgauucugagccucauuauuuucuuucuuuuuucuucuuuugagacggagucuugcucugucgcccaggcugguaugcaauggcgcagucuaagcucacugcaaccuccgccucccggguucaagagauucuccugccucagccucccgaguagcugggacuaccggcgcguggcaccacggccggcuaauuuuuguauuuuuaguggagacggguuucaccauguuggccaugcuggucucaaaccccugaccucgugauccucccgccucggccucccaaaguguugggauuacaggcgugagccaccgcgcccggccauucuuuucauauaugauaugaggacgagaaagcucugccucguagagcuaguuggaugggguggggaagacuggaggacagacggaacuggcugcaccucaagcucuuggaguggauugccuaaggcucucuucuucuccucaccugggaaacaauccgcuucuucauaucccuuccccauuggcagaaaccugagacuuguccagaacuuugcccaggauuggauucagaauagcugagucgcccucacaacuucuggauagggcugccccaauugcuuugagccugucacuuuaagaaagacgacgcuauccuauuucgacuauuccugccuguuacggaagguuguucucuacacccuaggucugagcucugacccggaaguagacgccgcugggagcgaaaucggucgugacguacgagguccagcauuaaagggggcgggccgagaggggcgugcuucgguagugcagaacucucgcugcuacuaggggaguccacgccuccaccuuuuccccgccuccuguaacucauuggaagagcugugcgccaauuacuuugccguuacccaauggcuacucaacugucucuuugguuccgcccagucgucuacccuggguuggcaacgccugggucuacgcaugcgcccaaacgcuuuuacgcucgaacuugcuuuaguccuggagucugcgcacgcccaaagggcaccccucgcguccuaccgcgccaucaccuuucug

SEQ ID NO: 18679 - RNA, 32180 nt, Homo sapiens
cgggcgacaccccuuccacgccccccucccccgcccccgcucccgcucccgggucgcggcgcgaggccccggaagccgggucgccccgcccccgcgcuccugccccggcccccgccccgcgccggagccccgcccgccuuccgacgggggugcggcuccaggaaacggcgcgcucccagcuccgcgcucgccacccgacgcgccccaggcgaccccgcagacucagccagaccacccugcgggccccagcggcggcagcggagagcgcggucccgggucggagccugggacaccuccgcacggacggggcgggcggcgcggacaggccauggggacccgggccgggccagcgguggcgggccagcgggagccccgggccugagaagugggcggcgggguggcgggggccaugaccucgguguggaagcgccugcagcgcgugggcaagcgggcggccaaguuccaguucguggccuguuaccacgagcuaguguuggagugcaccaagaaauggugagugggagggaggcgggggggcucccccgaacuugcugggaccucauccggcccuuugagccugagaggacucugcccccccagcccaaugaccaaaugggcccccaccccagcuugggcccugguuccguucccaggcucggagauucagaagugcccuugcaauuugugggaccccuggaguugggggcgugggcagccuucccugcgcgggggucaggacuuucaggccugagguucugccuguguccacuccuuccucagcugcggucagggcugggggagggaggccgcaugucuugugccagaaaggugguucaggguggcauuggaaaagggaucaaguuuugaggucugcagguggcuagggcuggggcaggagccucccugaccuuacuuaguccagcuaagaacagagauguugcccccuccuccccugccaucuuguugagccagaagaaccccuccaacucccgccucuucagccagagugcugggaggcuggaaacaucuccacaauguccuuaaaaggggaaacugagugcugggaggauugaggagggaggcggggagcagcuuaaaggggccugaggaccuaggagguuguggguccgggaggagaggguugcggagggcaagguggcagggugaggggugauucaccagagggugcaggccccagccuggacuaccaacagguucaggggcaucucguucacaugccgccacccauagcugcccaggccccugcgucacacccuaaauauacgugcuugcuggugucagcuucccuuggcuggauuagggcacagcugugggggccucacccgccaggcggggcuaaauuuaggcuccccaggggaagggcuggggcaggaagggaccaugggguccagggggaggggaguaagcaggaggcuggggucccuugggcagcugccauauccuuggccuugcccacacugggccugcuagagggccauucacaucuuucagcagagccugggagagcuugggggcuggcacuugaacucuggccucuggcuccugcuccagcauccugcgggaggccagggaaacacugggcacagcaggcugagggugccggcagugucaacgcagcugagucacaggcggcuguggguagggccuccugggcugcuuagccuggagcccaggccgggaagcugccccugcccagguugcagcuucccaggagggcgugcccagccugagucaggcugcccagccaagcccugcccucccuaggcacccccuguccgcuuccccuuucugggaaggccccuuaguuacccuugcucugccaucgcuggcaauuugggcuuggggaagggaacuuggcucuggguuggagggcucuaggcucaaccguguaaacuuguuuggcuccaaaccucugugggccucagcauccucaggguuaacagagaggcacuuauccuggcuuggccucagacgaacagugagcugggcaaaccccagcaucacgagagggugcaggcauggggcuggguacaggcaaggccaguucgcgugcugcccugggccggaucguccccucaagcaucaccccuccugggcagcaguugaacaucuaaccccaaggggcccucugcccccaggcccagccaugaguccacucagugccugggaaugggcccugcgcagccaucucuguccucuggcuuugccucugccucuccuccaugucugaccuggcauaugcuguucagcuuagaugucacccccuggaagucuuuucugauugcccuccaggcuccacugucaucaucuugccgaaagcugauccuccuugggaccccugcgcccagcaaagggcuggacauggugggcgagggauggcgguguugguuaaugacaggcugacccucugcugcuucuccggccucacccccaacucucugccccucucucugaugucacccuccagccgcagacccuuggacuugccauucccucuuucuccagauccucacacagcccaucccccugccacucaucucugcccagacacccaaccucaaggagacccccagggguucccucacaucacccuggaguucgcuuguuaauuuauuuuccuucuugacugguagucugcccccaccuccauuguccucaccggaaaggucuugucucucuuuugcccuccucuguccccaaaacugggcuggguuuauggugggcgcuccacaaacaucuuugugcgaagggacuucuuuuaucccucgucuuugucucucccuguguuggagucugcgugugugcacgaugcucacaugugcaucugugucuggcaucucuugccagguccuuguguuucugugugucuuggucucuguaugugccugucccuuucucacuugcugucuuuccucauagucccugccugcccacacugucugggccuuugcccuucugcucuggccccacccuaccuuagcagcuccacccugcacccuguggccccagauaaggggcugcccaggcccucuucuggaggagggggaggugggcagaaggaagacccugagggagcugggggaggaggaagaggagauggggaggcaggugagccugaccaagcagccugcucccuuucucccuccccuucccccucccccaggcagccagauaagcugguggugguauggacccgucggaaccgacgcaucugcuccaagguggggaaggauggcaacuggggauccagguuagggaugggggccggugggaggcugaugggggcugaugggggaguggagugagguucaagcacagaucagaauccacagaggggaggggaagauggugucaagguuggugauagggggugcaggugggagggaagaguuaagauggggggaggacucagauugucccuuguaggcccacagcuggcagccgggcauccagaacccauaccggggcaccgugguguggaugguaccugagaauguggacaucucugugacccucuacagggugagucucuagcccuccagcauggauggcaauugcaacacaggcaguugcaacaauugcaacacaggucuccugguagguuguucauccagauagaagaggaugcggggggugaggccaagaauuaggggggccugcucagcaucacuggcccaggaggucuccuuggaggaggcagcauuuacccaacacaugcagcaugagaggcagcugggaccagaacuuggggugcaucccaggaggagguagcaaccaccgcgugcaccuguaaucccagcuacuugggaggcugaggcacgagaauugcuugaaccugggaggcagagguugcagugagccgagaucgcaccccugcacuccagccucgacgacagaggaagacuccgucucaaaaaaaaaaaaaaagccaccacuaccaagcaccuccugagccagacaagcucugcucccuuugcugcugccccaacaguccuguacucaccagcacccuucuucccaggacccccacguggaccaguaugaggccaaagaguggacauuuauuauugaaaaugugagugucuggagugggcucaggucuggaaucuuggggacccugggacagcacugaugccccuucuccuggucucuccccuggcccacaggagucuaaggggcagcggaaggugcuggccacggccgagguggaccuggcccgccaugcagggcccgugccuguccaagucccagugaggcugcggcugaagccaaagucagugaagguggugcaggcugagcugagccucacucuuuccggggugcugcugcgggagggccgugccacgugagugccuaccugcccuccuugauccuggccugugaccucugacuccacccucaccuuuaaccucugccucccagggacgaugacaugcagagucucgcaagccucaugagugugaagccuagugaugugggcaacuuggaugacuuugcugagagugaugaagaugaggcucauggcccaggagccccggaggcccgggcucgagucccccagccaggugggcucacagccugcuguggaucgagacugccaagaccuggggagggaggguuacccgggccaccagccacuugcugugcccgcccugugaugggaacucauuacugcccaggcagucccaaccaacccagcagccucaauugucccaaccuggcugcuggucccacgauagccuuggucuucagcugaguccuggaggauggguucccaaugucucgcugggcuccuggguccucuccucaucccuuuguggugcuugccaggcccguaccugacccaggacagcugggucagaagcccggcuccugaucccucaccaccagcccuccugggccagcuggggcuuccucauuccucccugcugcuuguccaggcuuuuucucuguccacuguugagguucucucucucuuucucuccacaucugugggccugucucuucucgcaggccggggcggugcccugaggccagggcguuucccagguaggaccugcacuguaguugggggagggggucaggccuguggggcccugcccugggcugacucugcccuucuccccucuccuaccauucccagaucccucucgagagcugaagacgcuuugugaggaggaggaggaaggccaaggacgaccccagcaggcaggugagacccaggcugggguuggggguggagacuggaccccaggucacugggcccaggccacagugucccccucuuucuucucaguugccagcccuucuaaugcugaggauaccagcccagccccugugagugcuccugcacccccagccagaaccucccgaggccaggggucagaacgagcuaaugaagcggggggccagguaggcccugaggccccaaggcccccggaaaccucaccagagaugaggugagcuuuggaaccagccucaccccccauugcccccugauaggagcugcaguccucacccccaccaaccugccuccagggccccaacagucugaaggguggcggauggugcugagaguuggggccaaagcagccccccaacucccccuccugcucucuucucaggucuucaaggcagccagcccaggacacggcccccaccccagccccucggcuccggaaaggcucugaugcccuccggcccccagucccccagggggaagaugagguccccaaagccucaggggcuccuccagcaggauugggcucugcuagggagacccaggcccaggcaugcccucaggaagggacagaagcccauggagcuaggcugggcccgagcauugaggauaaagguucuggagacccuuuuggaaggcagagacucaaggcugaagagauggacacugaggacaggccagaggccagugggguggacacugagccaaggucaggaggcagagaggcaaacacuaagaggucaggagucagagcuggggaggcugaagagaguucagcaguuugucaaguggaugcugagcagaggucaaaggugagacauguggacacuaagggaccagaggcgacaggggugaugccugaggcaagaugcagggggaccccugaggcuccuccaaggggcucucaggggaggcugggagucaggaccagggaugaggcucccucaggccugagccugcccccagcggagccugcagggcacucugggcaacuuggugaccucgagggggccagggcugcugcaggccaggagagagagggugcagaagugagggguggagcaccugguauugaggggacaggccuggagcagggcccuucuguuggagcaauaagcaccaggccccaggugagcagcuggcagggggcccuguuaucaacugcccagggggcaauauccaggggucugggaggcugggaggcagaagcuggggguucaggggaccuggaaacagagacugaggugguaggguuggaggugcugggaacccaggagaaagaaguugaggggucaggguucccagagacuaggacacuagaaauugagauauugggggccuuggagaaagaagcagcaagaucaaggguccuggagucagagguugcugggacagcacagugugagggacuggagacccaggaaacagaggugggggucauagagaccccagggacagagacugagguauuggggacccagaaaacagaagcuggggguucaggaguuuugcagacaagaacuacgauagcagagacugagguacuggugacccaggagauaucuggggauuuagggccacugaagauagaagauacaauacagucugagaugcuggggacccaggagacagagguggaagcuucuaggguaccagagucagaggcugaggggacagaagcuaaaauauuagggacccaggagauaacagcuagggauucaggggucagagagauagaagcagagauagcagagucugacauauugguagcccaggagauagaggugggacuuuuggggguucugggaauagagacuggggcagcagaaggugcgauauuggggacccaagagauagcaucuagggauucaggggucccaggguuagaagcugauacaacagggauccaggugaaagagguuggggguucagagguuccagagauagcgacugggacagcagaaacugagauauuggggacccaagagauagcaucuaggaguucaggggucccagggcuagaaucugagguagcuggggcccaggagacagaggucggggguucagggaucucagggcccgaggcuggaauggcagaggcccgaguacugaugacccguaagacagaaauuauaguuccagaggcugagaaggaagaggcucagacuucggggguccaggaagcagagacuagaguugggagugcucucaaauaugaggcuuuaagggccccagucacucagccaagaguuuuaggaucccaggaagcaaaagcagagauuucaggaguacaagggucagagacucaaguucugagaguccaggaggcagaggcugggguuugggggaugucagagggcaaaucuggggcuuggggggcccaggaagcagagaugaagguuuuagagucuccagagaacaaaucugguacuuuuaaggcccaggaagcggaggcuggggucuugggaaaugagaaggggaaagaagcugagggaagccucacagaggccagccugccugaagcacagguggccaguggggcaggggcuggggcgcccagggccucuuccccagagaaggcugaagaggacaggaggcugccgggcagccagguagggaugggggccgccgagggcccagucugcugcuucccacuaaccuggggcugagcgaacggcggcucugcauggacccaccugguggaaugggaucgggugggguggggggcucagcuugaaggagcccccucauccccuccucucucaggaugcccuggcucucuuaccccaucuucccugggccgcauggagcuggacaccucuaagcugauuuucugggcugacuuugagguguggcugcuggugaccucugaucuugucugggggccacugaccuuuuaggugaccuuggcagauaacccuggaucuagaaacccuuuuaccuggccccaaggcucuagccaguggucucuggugaccccugcaagcucagagauggggcuguugugugccaggcaugagcuuccccaagaggcagagggcauacaucccauuuauacauucccuaagcccaccccuguguccucaggcaccaccugcccuggucagcuccagccagucccugcuggaguggugccaggaagucaccacuggcuaccguggcguccgcaucaccaacuucaccacauccuggcgcaacggcuuggccuucugugccauccugcaccgauucuacccagacaagaugugagcugccagaggggugggaacgaaugggggagccaucagggagggcaguguggacccagccucugaccagcacacucucugcagugacuaugccucgcuagacccacucaacaucaagcagaacaacaagcaggugagauggggugggggacugccuggagggaaggagggucuggagagccaggcucucagugucagauuuggagaaaguggacugccgggcccagcaguggcuucuggaaguucugccacuuuuuaccccuuuggucauuaaauuguuuguuuuccuuauuuucguuuguuuguuuuaaagcguuuuuccucccuuagaugguuuuuccaaaaccacccuuugguaacgggguggacggugugccguugcuaagcaacgcgagggcgggccuuguugcuggauuucccucgcuaggagggggcgguguugcuaggcaaaacccggggugccaaucccggggacccccuccguggggcggcacugcagcguugccggguggcgcgggccaccgccgccgcugaccccgagugcacccuuccccuaggccuucgauggcuucgcggcucugggcgugucgcggcugcuggagcccgcggacauggugcuacugucggugcccgacaagcucaucgucaugacguaccugugccagauccgcgccuucugcaccgggcaggagcugcagcugguacaacuggagggcggcggcggcgccggcacguaccgcgugggcagcgcccagcccagcccgcccgacgaccuggacgccggaggccuggcgcagcggcugcgcggucacggggccgaggggccccaggagcccaaggaggccgcagaccgcgcagacggggcggccccggggguggccuccaggaacgcggucgcgggccgcgccuccaaggacggcggggccgaggccccccgagagucgcgacccgcggaggucccggccgaggggcuggugaacggggcgggggcaccgggcggcggcggcgugaggcugcgacggcccucggucaacggggagcccgggucggugcccccgccccgcgcgcacggcuccuucucccacgugcgcgacgcggaccugcucaagaagaggcgcucgcggcugcggaacagcagcucguucucgauggacgauccggacgcgggagccaugggagcugcggcugcagugagugucaagguccuucuuucuucccccgccgcagcgcggggucccgggaagaugggcagagaacgggcgagcccccaaggggccccaaggacagagcuggcgcgagggugacgguuucagaguggcggggcucggcuggacccaggaggggcuaucugaucagagggacccuggugcuguggaagaguccucuggugugguagugagcuccucauuaggggacgcauuugagccaaggcccaccaggcaggguccccagcuuugcggccagccugggauaagugcugaggguuuuuagugcuuggcacuugguguggggaaucaggcugcagaaguucccggagcauccacguuccuggcacucugcccagugcuugguaggcuggaagguggguuugggcauuucuuucccugcagguggcucaucguuaaccagcagccacccugccccaugagcugggugcagacuaucuguacucaagggggauucuccagggccucccagccccaggacucuggcguacaucuuuaaccccagaugcuggagaccagucuccucuuuucuuacaauggaagguuggagaugugagaucgugagggcccgugucccugcugucauccccuauggguuguaggucaucuccuagagugucgugucacugugcugaaggggacauggucccagaaagagcagggauuugcucagugacccacagcugcuggaguccaggacacgggcuuuccagcuggagucccagcacugccccauccugccugucaaccaaggggcagcucugccaggcugcugcaaaccuucagcuguccaggaaugaccccugcauuugaaggaaaggagugaauucauugggaaagucuuucuggaagaagccaccauuugagcuagguugauaagauggccagguuuuucccaggugaaaaaugagugggguucucaaauggugggaacugcauuagcaaaaauguggcagcaggaaaguuuaggccucguuuagggaacugccagccaucucccggaagguccauaaguggcaaugaggccaggcugagagcaggaguccuggguguagggucagaggcacaagcauugagccugugagugagagacagagggcaugggugacacccaccuguggaagaugugauacgcaggagucaagaggacaaggccagcuuuggcccaucuguuggccucauuaaugugugucaguggcucuuuaaaucuuaaaggggaggugcccccucugggcccaaguuccagcaucugguguuuccaagucaggccuucccccagcucuugucucacaggagauaucugacccauagggcuggaggggacuccucauuggccaccccccucccccaugcccauugugugcagugggagguggucuggccuggcccggcccuugggagcucccaaaguccuggucuuccuggaggaggggccaggcaugaggguauugaaagaggaauuugaggccgggcaccguggcucauacuuguaaucccagcacuuugggaggcagaggugggcagaucacgaggucaggagaucaagaccauccuggccaacauggugaaaccccgucucuaauaaaauacaaaaaauuagccgggcauggugguacaggccuguagucccagcuacucaggaggcugaggcaggggaauuguuugaaccccggaggcggaggucucagugagccgagauugugccacugcacuccagccuggcaacagagcaagacuccgucucaaaaaaaaaaaaaaaagaggaauuugaguuagacaugaggaagcacuggaauucccacgaggccuggcaugcggaagcucugcgcugcugaggcuggauuucuccacucuccugcuucugccugucccgucagcucagcacucuuuaugugccuggccugcccauggacucuuaggguguguaugaaagcauuuugcaagguggcauugaggcccccugcaaguugcugucaaaaaaggggagauguguguuucccuagauuccuuucuagaagcccugcagcucccaggucacacagggcugggcuuucucccauuuuacauacaaggacacaaacagaggccccaagggugugacuggccccaaggcacacagcaaguugguggccaagcuugggaacaaacugcuggguuagacaacccugggcccuagaccagacccuuuaggagccucaucucugacccucaguuuccucaucuguaaaguggggagggucguggucccugccucacagggcuguugggaggauucagugagucagugcacauaaagugcuuuaagugcccggcacagaaacacuugguagauauuagcugcuguuauuagucaguguaccuugacuguauuuuuugggcccagcucuguauaagggggagacaugggaaaccagcagcugugacggggugaguggggguuggagcugugaugggggaggccaugggagcagcaucugcccagccuggggaucagaggaggcuucuggagacauggaagucagggagggaggcgggaagagugugggggccccggcaggggggucucuggaggaaguagggcugggcugggucguggaggucacguugguaccaggcagcccaagauggaagcugacuccaggcugagaaagcuauuuugggaacugaaagucggccacuguggccagggggcggugucuaggcguggcucagggugguaggaacauugaggcuggggccgccugaggcuuuggcaugaggcuggggggcugaggagagaugugaaacaguuacaccgggggugaaggugucagagaggccucucaguuucagcuugagucagcaggcaggccauggugguggcugguggggaagucaccacugccccaggccagagaggauugccucugagccagggauguccagggcugccucugagagagguacaggugggaguggacacgggcaggucaaccacugucccugccccaugaccccgacacaggucagaugacccagauguggggggccagggcaggagcaguugaggggccaggcuaucagcugagucgaaaguuggggacccccagggcugacagucccaacaagucacuaggggcgggcagguacauggggucagcccugcccuuccaagcuaaaauucaaagauccagccagccuggcuuguccugugugugugagcaugcagcagccgcuccugggugugggaacugaaaaggcagcagggcacccccuuuuggccaggagguggaggugcuggcucaggaggguccaggucuggggagcccugaggacagaaggggagggagccugguggggccucugcaggaggcagggcugggcugggucacacggauggggccauguggggcagugcaauggucacugcauggggcccuggccaugacggagaagccagcacuaggugacagaagucagagguggccugagggaauuccauggaagaggagucgaggccgggcgugguggcucacaccuguaaucccagcacuuugggaggccaaagugagcagaucaccugaggucaggaguucgagaccagccuggccaacauggugaaaccccgucucuacuaaaaauacaaaaauuagcugggcgugauggcggguggcuacuugggaggcugaggcaggagaaucaccugaaccaggagguggagguugcagugagccaugauccugccacugcacuccagccagggcgacagagcgaaucuccaucucaaaaaaagagaguagggaggaaaggccugggcugggcccuucacaggcucucauccugugaggccggagcucagcccagccccaggaggggaauugggaggcucggagccuggguguggaugggcccagggccacagggccaggaaggaugaaggcuguggccuuugcuugaggaggcauuucucuuggaaggaggugggcccggggguucugugcaugcaggacuagaggaggggcaggggcgggcaggagcuggggucaaggaccccuccuccccucuguaugaguggcucuggcuggccccaggcccaggcuggugggaaaccccucccagcccucacuggccccuucuuccacaggaaggccaggccccugaccccagcccugccccaggcccacccacagcugcagacucucaacagcccccuggugaguagcaggaguggugaccaucucaguucaggcugcucacaaagccuggacuggggacuuccuggggguggguggugguuagggggugccuuaucaucaucucugucugcaggugggaguucccccucggaggaaccacccccaagcccaggggaggaggcugggcugguaaggagggcuaagugggaggagcugaugggugagcaccaccuauucagggccugggcugaguccacccuguucucugccuuuuccacccccagcaacgguuccaggacacaagucaguacgugugugcagagcugcaggcccuggaacaggagcagaggcagauagaugggcgggcggcugagguggagaugcagcugaggagccucauggagucagguggggcauacaucuagggaucccuuccccaacacaugccacuaggucuguccagcccugcagcuguuccugaccuugggaggagcugggaggaggcacggcuggcaucagcguucccauuuuacagccaggcaugcugaggcccugaaguggcuuccucgaggcacacaguucuggcuucugggaugucacaagggagcaaacccccucccccaacccccagcugcccuacccugacacggggcagggggcaggccuggugacugucccuguccaaugcaggugccaacaagcugcaggaggaggugcugauccaggagugguucacccuggucaacaagaagaacgcucucauccggaggcaggaccagcugcagcugcugugagugcuggccccgggccaggagagcagagggacucuuagcuacuuugguuagaguucuucacuacuuucuuauuccuacagagaucuuuuugacaaacgauuccucuuccaucuuacuguuuuuguccuaaacaaauugcuguuuaaaguguaaaacuggccaggcacggugucucaugccuguaaucccagcaccuggggaggccgaggcaggcggaucaucugaggucaggaguucaagaccagccaacauggugaaaccccaucucuacuaaaaauacaaaaauuagccaaguaugguggcacgcgccuguaaucccagcaacuuggaaggcugaggcaggagaaucgcuugaaccugggaggcagagguugcagugagccaagaucagaccauuacacucuagucugggcaaaagagugagacucugucucaaaaaauaaaaauuaaaacaaaaauuaaggguaaaacucuuaaauuagaacuauuuuuacuaauaagaaaaccggccgggcgcgguggcucacgccuguaaucccagcacuuugggaggccgaggcgggcagaucacaaggucaggagauugagaccaucuggcuaacacagugaaaccccgucucuacuaaaaauacaaaacauuagccaggccugguggcgggcgccuguaguuccagcuucugggaaggcugaggcaggagaaucgcuugaacccuccugggguugagagauugcagugagccgagaucgugccacugcacuccagccuuuacaguaaggaaaacagaagcccagagagaucugaucugguucccaugugggguccgaagccacucugcggccauugccuuugucauccugcaggguggagacagcuuugccucccuuuugcguuugggauuuuucagaauaacuguagccagugcuuccuguuuaugaguacuguucauccaaauaauccuucggggguccuucuggggggugugugggaggagcaacacaaacacccagcaauuggagaaaacagaagaaaagcgauaauguggucuggagacuagaggauagcucugcggucagcccugcccucgggaacugcuggggaggugggauggggucagggaguggccagagcccugggcacucucucccuacgccccuuuuccugaacugccacccccccgccacccaccccccgccaccuuccagcauggaggagcaggacuuggagcgaagguucgagcugcugagccgcgagcugcgggccaugcuggccaucgaaggugggacaugggcucaggggccgggaggcaagacagagccaggguggaggcggcacagcccugggcccgcgccuccugacgcuuagccgcuucgacccucagacuggcagaaaacguccgcucagcagcaccgagagcagcuccuacuggaggagcuggugucgcuggugaaccagcgcgaugagcuaguccgggaccuggaccacaaggagcggaugugaguggcgcugggcggcgcugggaguugggaggguccgggacuugcucccgcagagggcugcguguggaccccgcccaacggagcgcugacucgaacccguucuccccagcgcccuggaggaggacgagcgccuggagcgcggccuggaacagcggcgccgcaagcugagccggcaguugagccggcgggagcgcugcgugcugagcugaggccgccggcccggguggcccauaacuucucgcguccccggcguccgccgccgccccgggccugcgcugcggacgacccggccgucccggaggccgcgcgcguguccgcuaggggccgccggcgcccuuccccguacagggcagggcggauccccgaccccacgggcggggcggccgccguauuuauuugucaccgagggugugugcgcgcucgcggcgggugcgggguccuccccgacggcacggccgggccggcggccucggggagagggaugccugggcacuaccgccccgcgcuggcuugcccuccuguucuccagagcaauaaaguuggacgagacuaccccagcgccggccuuuucuccgcuccaccugggcucucaauaggcggaggggagugcgccgaggcugaggcgggcggcucugccauccuaagccggaaggugcgguuucgagguucccagggccagcggaggcuggaccucggccuucccgggaugguggccgguggcucagggaagucccauucgaaauaguugaaaauagccgaagucguugcucauuuuaugauuaacaguauccucugaggccucccgcccacccucaccgcggcuccaucuccagauucuuccccagccacuccuggcugcuuccuccucaggugccgccaccuuacggagcugaacucggucaccugacgcuucagcaagcaggggcuuguccugaagcuggggccgcgggcggcagggugcucagagccaguucauccugcccuaggaugccaccuugguccucagcagucacaggaccacugggucugaagaacuuccccauggcacggaccugcggcagcucagagaaggucuccacugccagcagcauggccaagaguccuagaagcaaguaaccuggggaggagaaggugcuggggcagcgccuggguucuggugaugcuccccgcccaccucccagcgcagugacuugcccuggcaacuggcaccacucacccccuucucaacgcugccaccagagcucuucgacuaccccucccacgccgugcccuggagugaggucccuccaccugcaaggcccagccccccagugauuuaugggaguccuaguccaggcuccucuucccccuucccccacacgcuguuagguggcuggacuuaccaagaagugcgagcuggcccaggugguaaaucacggggugcaggcugcggccgcggccgggcagcaaguccuccaggccaauggugcugagcgagcugaagcagaaguagacggcccccagcaggcugcagucgcccugaaggccccacagcaccagcgcuggcagcagcacaaagcugcuggccaccagcagucccagugcaacugccugcagcagcgcagcccuggccggugacagcugccaguggaccgcuacccaggcacgugggcggcugagcacaggcagcaggcaauggcgcaggguggccacgagagcuaaggaggcuggcagccccagggcugcauagaccaugcagaaggccuuuccgccuggcgauaguggggccauguggccauaaccuggagaagagagagucaguggacagugagagcucugagugccaugucugcuggggucccugccuaccccaauacugccuuccgcagaaggcugcccucugguggccuugaacuggccaggcccagguucuagcuggcucugcuccucuucgucaggggaucccuuacccucucuaggccauucuuuucuuuuuuggaaaaugaaaggaugaaagaagacaguuccucaggccuuuuguagcugggacaauucugagaacugcgcugcccuuaacagauacucccgauuccacagcugguggaauaucauccacucuuuccccaaaugugugucauguccugugugccaggcuuuguacugggaucugaaucagcccaggcccugccccuucuggugggggagucgggcaggcaaaucaugaagggcugcaaagaggcagcaugggcgagagagggcaugugccaggcggggaggggugggagugcggggugugcugggagaacaggaucagcuaauacagagcugcaaacgcacaugccuaccggagccagaugggagacaaacaggagugguggggacagggguacacuggaaagugugagcuguauccaaagggcaggccccauucugcuccagucaggauguugccuugcagggauucuggcucagugugaguggguuuccugauuuuccaaaagaaguuggaaauaugagcugggcacaguggcucacaccuguaaucccaacacuuugggaggcugaggcagguggaucacuugaggucaggaguuugagaacagccuggccaacauggcaaaaccccgucucuacuaaaaacacaaaaauuagccgggcaugguggugcaugccuguagucccagcuacucaggaggcugaggcaggagaauugcuagaacccgggagguggagguugcagugagccaagaucgcaccaccgcaccccagccugggugacagggucagacaccguuucaaaaaaaaaaaaaguuggaaauacaaauuccaauucaaaaaauacugagacacuuuguggggcaaaaaauacgaaaacccagggcugugggucucauugcugcuuuucccugggccugugcccacgcgauuucucugcaggacucccucaucccugucugugcccuccugauccacaagcaucucaugccgacuuccuccccuaucuucccucacucccccacccgaggccaugguccugaucuguccuucccagguucauucuauuugcuuccauccaagaauccaucccacuguauuguauccccuaucuggccacaggcuguggcaucugggcagcucuccugggucucaaagggugccuggggugggacuggggaggccacacccuuccuggcaguugaaguggaggcaccaguugggguguguugguggggagccccagcugugaugucaggccucacagggccugggcuccaucuggcucuuuggggcugaaggaagggcugcaugaaccccaaagcccccagggagccauggccucuuggagccgcaccccccgacuuggcugccuggcucucuuaccugugguggugaggaugcuggcagcgaagagcagggcugagggaaggucccagguccugcccucugagcuguugcccaggguggagaccccaugggccuggguggccagggcagugcccagcagcucuuccagagcuccggguggcaggcaggcccuaugcucugccuggaaggcugccagcucugcccugagcucagccugaagccugcaugcaggaggccccuccagggccuggaacaccacagccccaagccccagggccagcaagugggccacaaccaggagcccguaucgggaccagggccuuagaccccccauggcaggccgcuggggugcugugggaacuggcggcuccaccucaggcaccugggaggggcugggcagggcggggccaggaggaggugcuguguggguggcugggacccggcugggauggcugggguggcuggggugugaacaggagggaggugagcugcaucacccuucccagguccuggaggcaagacauuugcccauuucacagcagcugggaugguggggauggguggaggaaggcggcugcggugaggggaggaggcggaggaagcugaagccuagagaggaccucacacuuauucaagguccugcucacucaggcacccauaccacauucauucauucauucauucauucaagugcuuagggaagaggacaggcacagguccuuuccuuccugguguuuacacaagaaaccucuuagcaaagaaacauggcaaccucacauugucaugaguuccaugaaggaaacacccugggugaugggagagcucugcggggagcggggggguuaucucacugggaaagcucugcuaaggaggugauauuucagcuggggaguaagaggccagugaagguaggaaugagcuuggggugugagaggaacagagggcuggcuguggcaggggagaguugggggugaaggggggauaaggacacaggcccuugaggauaaaugugguccagggagaccuacgcugggcuacuguaggcgucauggauggagugauuuuggccugggugguguggugggagaggaaugguggcagcugggaaggaucaggugggggugggagguggggagaggacuccagggugcccagagcacccgggcagaugauacccuugcgcccgauugccaguucuuccugagaacgcuuugugccugcccuccugacucccugccccugaacugcagacacagagucugggcugccauggggcaccugggagaggggaagggggagccuggguuccaacuccucuaacgucagaggggcugaggacagaggccaaggaagggacccagcccuaggguauggugugggagugccagagcccccauggcagugugaagagaauggacagaggccgagggagggacccugcccuaggguauggugugggagugccagagcccccauggcagugugaagagaacugucaggggugccagaugccauggcaagucaccauacugggagguggguggaacuuacuacucuuuuuuuugagauggagucucgcucugucgcccaggcuggagugcaguggugcaaucucggcucacucaaccuucgccgcccggguucaagcuauucuccugccucagccucccaaguagcuggggcuacaggcaccugccaccacgccugguuaauuuuuguauauauauauauuuuuuucaguagagacgggguuucaccauauuggccaggcuggucucaaaauccugaccuugugaucuguccgucucggccucccaaagugcugggauuacaggcgugagccaccaugcccggccuaugguuuuuuguuuuuuuuuuuuuugagacggagucuugcucuguugcccaggcuggagugcaguggcgugauuuuggcucacugcaaccuccaccuuccagguucaagcaauucuccugccucagccuccagaguagcugggacuacaggcaugcaccaccacaccuggcuaauuuuuguauuuuuaguagagaugggguuucaccauguggccagguugaacuccugaccucaugugauccgccggccucggccucccaaacugcugugaugacaggagugagccacugcaccuggccgagaagagccuugaaugacugaccaaggcugguggauuuggucccaggagaggcaugcaguacaaggcauccaacugccuauuguuggggcaucaggacaccaggguuguaugauagguugggucaccugguuaccuccaagaaaggugacaggcuacauguggggagacagcuuuugaguuuauuuggcuucuggcuucacuggaucccgaggcuaagacuccaacccuggcuggggcagcaggaaggcauccagagagcccuggccccagaugacccccagggcaggagguccaugcucuaagcccuagggcaggggccgcaguagcaggacuuggucaaaagugcuggugacagcugaggccggccccucuucccugcaccuccccuccucccugcaucaccccagcaggcaauucccugagacaggcucugguccucccaaccagcuggguacaguguugggccccaguagggcaggugagcuggggggaccuacagguuucagaugugggggcgcaggucccccuuccagugugaaggcuuccugugcaguguaguguuccugacccccaaagggggguggggucccuggggaaacugaggcagcugcagaggcugacccagcuccuguuccaguguaugcugugacuccuccuaaggcagcuggagcucgggggaguggccuggcccacucaaggccccgcuuccggcacccacggggccugggcacccaugucuuuggucugugcccugcaguccugggggccccccuggaagggguuggcagguggggagucccagaaggggucugaguccgggaacaagguccagggugcucggcggggugcaggcuguggugauggcaggggagaaggccguggcccagcugacacaaagcuccagggaucaaugcggcugcgaaggggcgagggccgaggucggcugaugaggcccagggguggugaacguggggugccuggggugccaggagcagagcgugauguccccggugggggugagacagugccuccugugaggauauaggaggggcacagggucaagcaacccccaacugcugagguccccaagacacuguccugcucugggccucaguuuccccaugugcacagugaccuacuugacucaacuuccaccgcccuuccugcuccguggugccucuguuuuuuguaauaguuaggagugaggccucugcagcaggcuggccuggauguggaucccggcccugccacuuacuagcugugggagcugugggucccuuaaucucugugccuuaaauuuccucaucuaaaaaugggcauccaggagcgcuuaguucucugguuguuaugacuaaaugagaccaucucgggaaagccuugcaaacaguacuuggcacaaguaaggagccaggaguuugcuacgauuaugauuacauguaugcugugucgcccaggcuggaguccagugucaugaucaccgcucacugcagccucaaccuuucaaggcucacgugauccucccagagugcugggaucacaggcgugcaccacugccuggcccgauuacuucuuuuauuucacagcaggcaucgcccccaccugccuggaccaccugauagcugaacuuagaacucugcucccuacaugcgucuucaguaccccgaaugccugguucaggguccagcugaugacuguggucucggccuugccuccuugcauguccccaccagccacuccucccucccugggaacccccgucucccauaugugaagcaggccggcuucaggccacucaccgcggggcuccuccucacgucgggggcucuuggcugaccgcuggcccacagggauacccagguccagcaacaggggugcaggagugggcggggagucgggcgucuugagcgagaagcagaugagcggggaagggggcggcucggucgggcagggcgcgggcguuggcgugggggguguugucggggacuccccgcgcucgcguccugggccucccggcggcugcaggucgcggccaaggcccagcgaggcgagcagggcggugccgcgcagcagcgcccgcuggaucagcuugggcgucccagagcugcuaccgcgcucugcggggacaggccucuugggcuccucgggcuccaggcuaggccgcgggggguuaccugcgggcagaggcggcacaggugaggguguggcuggugcauauuccgggugagggcccaagaccucuccguggucuuggaacaaggacugaguucugcccucuacuagcaucuucccuggucccacaggucccauggccuccccaucacauacccacauucuggccuuucacaagaugggcacugggaggggagggcagugcagguggaggaagcggcagcaaagcccaauggcagccagcgaccccagacccgaaagauggaugggcagucccaguggaggcaggcuggggccaggucacagugggccucuguggccugccaggggcaaccuccaggcccaggggcauggcaggucccacugacugggaccggcgcccugugcucugugcccaccagcuuccuggcuuggcagcccugccccuucugcccacccacccccgcuccagcuguagcuuauaagaugcacacagucaacucuaagguacauggcagcccugagggcauaaaucccugucucuauucuagaaaggaggaaaaugagguucagaggggucaguaccuugcccaaggucacagcuaauuuacagaguauguauuugugccaggccugagcugaauggcauaggggcauuauguugucugauucucaugccccagggguuccaggcucagagagguugagggcuugugcggagcuguacagccagugaaagguggagccggccucaccccaggcaagggcaguagaaccuuugcucuccaccauuucccagccagacucugcccuagauuucaagacacuaguguccuaccuuccagucuaggguuggccugacuccauucuagaccacuugggcagggauggggaaccccucauuaaggacaagggacucuaggaugggcucucacaagcccugauuuugucagaucccuccuuggcucuagaaacugcuguggcucuccacugucacuaggagaaagucuggccuccuuggcugguccucugaagcccucccuggccuugucccucugccuuuccccuccugccuggagugcagcagcagguuggaugucgggagggagaaauacaaggcugggaaaaaugagcuucuacuaugaaccaggacuuagcucacagucccuucugucagccccaacccuuacucagacucucugccucuuaccucacccaacucccaccccggccacugccacugaagggacaagggaauccuucuaaaaugcaaaccuguuaaagacaggucucugcuuaaaaacuacccaucacuuccagcuucauucacucauucauucaaucaacaucuacugacccaugugccuuggccccuguccgcagccccaguccugagacuccucggcucucaacucuucucggaguucagccagguugccuuuuccuuggguauggugagcugcaugccugcgcacacacuauucacucuggguggcugaccuuucccaccuuggcuuucagugaccucuuaugcaccauccaagaccaacugggaugucacuuccucugugaagcccucccagaaucucccugaaccuacacaguuauugcucacguuaugccucauagaggugcuacuggacuuguuuaugagucugccugcuucaucauaugaggucagggcaguguuuaacauguugaugccuggcucuuaaaaugcaaaucccugggccaggcgcgguggcucacaucugcaaucccagcacuuugggaggcccaggugggaugaucacgaggucaggagaucgagaccauccuggcuaacacggugaaacccugucucuacuaaaaacacaaaaaauuagccaggcgugguggugggcgccuguagucccagauacucaagaggcugaggcaggagaauggcaugaacccaggaggcggagcuugcagugagccaaaaucacaccacugcacuccagccugggcaacagagcgagacuccgucucaaaaaaaaaaaaaagcaaauucuuguuugaugaagaauccauuuuuauaauccuugcaccaaccacgagguuaucauaucacccccacuucgcaggugaagaacugaucauuuacagugaguuuaaacagaagaggggaaaucauguuuaaaaaaaagaaagaguuggccgggugcgguggcucacaccuguaaucccagcacuuugggaggccaaggugggcggaucacgaggucaagaaaucgagaccauccuggccaacauggugaaacccugucucuacuaaaaaauacaaaaauuagcagggcaugguggcacgcaccuguagucucagcuacuugggaggcugaggcaggagaaucgcuugaacccaggaggcggagguuacagugagccgagaucccgccacugcgcuccagccugggugacagagugagacuccaucucaaaaaaaaaaaaaaaaaaagcaagagaggcugggagugguggcucaagccuauaaucccagcacuuugggaggccaaguagggcagaucacuugaggucaggagugcaugacuagccuggccaacauggucaaacccugucucuacuaaauacaaaaauuaggccgggcauggugguucacgcuuguaaucccagcacuuugggaagcugaagcagguggcucacuugaggucaggaguucgggaccagccuggucaacauggugaaaccucaucucuacuacaaauacaaacauuagccgggcauuguggcacaugccuguaaucccugcuacuugggaggcugaggcaggagaaucacuugaaccugggagguggagguuguagugagccgagauugcaccacugcccuccagccugggcaacagaaugacacuucaucucaaaaaaaaaaaaauuagcugggcaugguggcacaugccuguaaucccagcuacuggggaggcugagggagaauugcuugaacgugggagguggaggcugaagugagcugaggucgcaccacugcacuccagccugggugacagaacaagacuccuucuaaaaaaaaaaaaagaaaauagcaagagcaagcugggugugguggcucacaccuguaaugccagcacuuugggaggcugggguggguggacuacuuaagcgcagcccagccugggcaacauggcaaaaccccaucucuacaaaaaauauaaaaauuagccaagcauggcaugcaccuguagucccugcuacucaggaagcugaggugggaggaucacuugagccugggaggcagaguuugcagugagccaugaucaugccauugcaguccagccuggguaacagaaugagacucuaucuuuaaaaaaauaaaagacagaaaugagacaaagggaagagaagauaggguccagcagacaaaaugagagugaacagaaguuccugcagucaauggccugagaaacugagguucugaaggguaagggacuuggucaacauaauccagcuaggauuugaaucugccucuaagcuuccuggcagcaagaguuagcaacucuguuguuuaggagaaagcugcgugacuauucuugacccaaagauagauagauagaggcgaaacugcuuccgugaggucucacagggaggacacagccacguaguuauuggcucuaaggcaacaagcuucacagggcaguugcuaucagcguagcugagugcacccugccaaugugccacuccuugcagccagcucuccagggaccagaacagcccacuggggacagggugagggugugugugacucuccagugguauggcuuaugccggggaccaucucacagggucugggaccucugugaagccccauuauuugauucuuagcuggguuucgggggguggcugugaggucaaugucauguacuuucauggacccagaugaugcguggagugugggauugggcuaggggaaccagaugcucagccagccacugagcugggcagcugacauccuuucagggcaaguggcaauccauuucuucaucagccaggaagggcacugguguugaggccgacauacuuaucaagaacaguaacuaccaugguuuccagugcuuucaugaaaccucagacauguggccuucuggccacacaucugcaauuucauauugugggagcauucacuguaucccugggggcugcggcucucucaguuugcaggggcuggaccaagaaagaaggcauuucagauuucuaugggcacagaugucuacagaaguuaugaugccaugaaauacuucgaggagaugaggaaggcugcuaucucucagaaugcaaagugauuuuggaauaugaagaauuucuuuggguugaauuacuuagaaguuugucacugaucugaacuauucaugaauauaugggcuaauaaguaguuucucuucauaaauaauuaacaaauucuuuggauaaaaaaacauggggcaagcuugagaacgauggggcccaggccccuugugccccugcuucugggagcugagggccagagaguucuguggaacagucaggaccugcuucagccuacacaccuggguugacaggcucucaaguucuccuuuggcccaucuggccugguacaauuuagagcaagugaauucaagaagccuccuuggccuuccagcucucaguucagucccugcaggacagaugcugggggcagugcagcugcuggaguagcaaauggcggggcagauggaggcccagggcucugccucuguggucagacaggcaagagcagaucaaaucccugcucuacugguugccuuacaucaaaccacuuaaucucucugugccucaguuuucucuguuguaaaaugcaggccaauacuacuacuccccucacagaacugcuuggcacauagaagagaaccaacaaagguuagcuguuguuacaacuaucaaguguagcucagggaauggaagaggcgaugggcugggugggaugggaggagugaguuuaaacggcuugcugaacaggacucuucugagagcagcuaagcggguccuacauucuggcugugagcagcaggugugggggcucugaggauggucccuagguuggcacagggacccacaggcaagggaggccauaacucucuggccucacucagagcugggcaguguugagcugagugagcccuccucccugcaaugcuggagcccugccuucugccugacccucuggcuuccuaagcagucuauacgugagaagcccuuucuucaagugaaagcuucugagcucacuacgagagcauuggagcugaagccucucuggguucaaauccucagcuggggguuugagguagguuacuucaccucucagagccucaguuuccuuaucugcaaaaugggguaauaguagccccucuucaucaaugcuuggagggaaugccuggcacaguagggcaguuaccgucauggagaacagaaaggccccgagcuauccuggauguggugagaauggguccuggauccugccugcucggccuucucauucucuucuucaccuacaggcucccagaaggggcucugagaagcacaguguggcugacacuuguuuggcuccaccccacacaggcugauuccuucccccaucuggguccagcuucccuuggguaccaaaugccaggugggcuuccugucuuucuuuucucccuggagccugcuaaaggcacaggggcugccauggggccagggaagaggcuucuugcaggccaggucugagcaaggggaugagacucugggccccgagccgaggccugggcuguaugccgcuugaucgugggccuguaggucagaccuggguuccaggaucggcucugucuugucucagccuugguuuccuagucucuagaaugagagcaaccagggcaggacuccugcuuugccuacuagccuauuguggccuccccaaggugcccacggaaggagcucagccagauccugccgggggaggaaggccacucaccauugagugcuggggguguggaaggagauccuaagggggaugagucaucugaauccagguaccauguggcuucguccaugcgggaccuucuccuggugaugggagggcaaggaggggugcuuuaggaauuucaggacuuggggaaagcaaaugaugcugggucuggggggcacucagguacucaccucccauucugggcuuccccaggcuugggggaacugggaccccaagcccagcaugcucgccgcucuccauugcuugaguccuccagacgucggggggacuggcggccccaugccuggccuggcucugcaggcuccacugcaggggaaaccgaugaaaucggagauaaucuuuauucucccuccaucaucacagucaggcuucagagauaaacuuuagaguauggggagcaggcugggcccuguaccauucccagggugagcuuugggcaagauagauggguuugggucuuggggccaacagugggguggggcaucucaucuagcccuugggcugaaguuugcugcuuaguaauuaguacagacacugacaccaacugccugaguuugauucuggcucuuccacuuauuaacuguguaacaaguuacuuuuuucacuuuucucauccauaaaacuuaaauuaacaacaaaaauaacuaccaaauagaauuauugcaagaaauuaauauuagcaaagcauuuagaaaauuaguaguacauagugucauacaauuauuugacuaaaaaaaaauaaguaaaauuaaugcugcuuggggaguucagagguaacaggcuagaccuaaggcagggagccugggggcggggaggaagaggggauagugagugggcuccgccuccaagaauaaggucugacagagaauaaggagcuggggggcggagaggggcaugagaggugaaguuucuuacacuggauggcucggaaccggggaaaggugggcgaauccccaggcccgaccucgaagacguuucuccuccggucaaggccgggugaggccugcacggugaugcggugcuugaagucugggauuuggguuggggggagcaggguucagguuugugaugaaguagagccaggaccccaaccugcaggggcccaaggccagcucccaggccacauagggagcggcacgauggcugugagacugugaccagccucacugcuuucuugagccccugggucuggauaaggaaagcuacucgucugagucggagaugcccuggcgccggccggccccgcccacuagaccuucccagaacuuucgugaaccccaccccuucccacucccagaccgacaugcaaauacuuccgccagaacccgcccacagacagaaaaaaaacacuccuggcuccaccccucccagccuucaucucacgggcccacccacaacacccuaaaccaaucccagcgcggugagcacacaggccuggcuccacccccacccccgcagccaauggcgggggacgccccggggcccggcccucaccgaguggcaugcugauacgcucgccgccgucgcgcgcccggagcuugcugcgcuugaaugucccgcggcggcggcgcacgugcggucgcucgcgguccaccugcugcagcagcagcgucagcucgcgcucgaacaccucuagcucccacugggccagcaggugcucgcgccgccgcagcugcuccgccugugaccgcugcucgcgcgccgcucgcgucagcuccuccucgcggcucaguaguuccugcgcccgagacagcgaugguggagaggucagccuggcaccaaucccggcagcgcccgccccgacucugccccagggagaucggggagacacucguuccaacgcugggucccuugauuccucgcaccuuuuccuuggcucgcagcucgucgaagagacccuggaucucgcgcuuccagccuuccugcauggaauggaaggagucccgcggcauuucccguaggaccugugccuccagcgccuccaacugcugcaggauggaggcgaagucgggccugcgguggggguccugcgcccagcagucuaggggcacggcgugcagcggggacagaauaagaagggguccguggguggauguguccugggccagggagcucuguaccucaccugcccuccccguccucuuaccggccauaagcugugcgaagggcucggggcagguggaugggaugggcagugugagcuuguuaacagcuacgccauaggccacagcaaggcagucaaugccacgguauggcaccuccccggucagcaguucccacagcagcaccccaaaacug

SEQ ID NO: 18680 - RNA, 3024 nt, Homo sapiens
gcucauuuuaugauuaacaguauccucugaggccucccgcccacccucaccgcggcuccaucuccagauucuuccccagccacuccuggcugcuuccuccucaggugccgccaccuuacggagcugaacucggucaccugacgcuucagcaagcaggggcuuguccugaagcuggggccgcgggcggcagggugcucagagccaguucauccugcccuaggaugccaccuugguccucagcagucacaggaccacugggucugaagaacuuccccauggcacggaccugcggcagcucagagaaggucuccacugccagcagcauggccaagaguccuagaagcaaguaaccuggggaggagaaggugcuggggcagcgccuggguucuggugaugcuccccgcccaccucccagcgcagugacuugcccuggcaacuggcaccacucacccccuucucaacgcugccaccagagcucuucgacuaccccucccacgccgugcccuggagugaggucccuccaccugcaaggcccagccccccagugauuuaugggaguccuaguccaggcuccucuucccccuucccccacacgcuguuagguggcuggacuuaccaagaagugcgagcuggcccaggugguaaaucacggggugcaggcugcggccgcggccgggcagcaaguccuccaggccaauggugcugagcgagcugaagcagaaguagacggcccccagcaggcugcagucgcccugaaggccccacagcaccagcgcuggcagcagcacaaagcugcuggccaccagcagucccagugcaacugccugcagcagcgcagcccuggccggugacagcugccaguggaccgcuacccaggcacgugggcggcugagcacaggcagcaggcaauggcgcaggguggccacgagagcuaaggaggcuggcagccccagggcugcauagaccaugcagaaggccuuuccgccuggcgauaguggggccauguggccauaaccuggagaagagagagucaguggacagugagagcucugagugccaugucugcuggggucccugccuaccccaauacugccuuccgcagaaggcugcccucugguggccuugaacuggccaggcccagguucuagcuggcucugcuccucuucgucaggggaucccuuacccucucuaggccauucuuuucuuuuuuggaaaaugaaaggaugaaagaagacaguuccucaggccuuuuguagcugggacaauucugagaacugcgcugcccuuaacagauacucccgauuccacagcugguggaauaucauccacucuuuccccaaaugugugucauguccugugugccaggcuuuguacugggaucugaaucagcccaggcccugccccuucuggugggggagucgggcaggcaaaucaugaagggcugcaaagaggcagcaugggcgagagagggcaugugccaggcggggaggggugggagugcggggugugcugggagaacaggaucagcuaauacagagcugcaaacgcacaugccuaccggagccagaugggagacaaacaggagugguggggacagggguacacuggaaagugugagcuguauccaaagggcaggccccauucugcuccagucaggauguugccuugcagggauucuggcucagugugaguggguuuccugauuuuccaaaagaaguuggaaauaugagcugggcacaguggcucacaccuguaaucccaacacuuugggaggcugaggcagguggaucacuugaggucaggaguuugagaacagccuggccaacauggcaaaaccccgucucuacuaaaaacacaaaaauuagccgggcaugguggugcaugccuguagucccagcuacucaggaggcugaggcaggagaauugcuagaacccgggagguggagguugcagugagccaagaucgcaccaccgcaccccagccugggugacagggucagacaccguuucaaaaaaaaaaaaaguuggaaauacaaauuccaauucaaaaaauacugagacacuuuguggggcaaaaaauacgaaaacccagggcugugggucucauugcugcuuuucccugggccugugcccacgcgauuucucugcaggacucccucaucccugucugugcccuccugauccacaagcaucucaugccgacuuccuccccuaucuucccucacucccccacccgaggccaugguccugaucuguccuucccagguucauucuauuugcuuccauccaagaauccaucccacuguauuguauccccuaucuggccacaggcuguggcaucugggcagcucuccugggucucaaagggugccuggggugggacuggggaggccacacccuuccuggcaguugaaguggaggcaccaguugggguguguugguggggagccccagcugugaugucaggccucacagggccugggcuccaucuggcucuuuggggcugaaggaagggcugcaugaaccccaaagcccccagggagccauggccucuuggagccgcaccccccgacuuggcugccuggcucucuuaccugugguggugaggaugcuggcagcgaagagcagggcugagggaaggucccagguccugcccucugagcuguugcccaggguggagaccccaugggccuggguggccagggcagugcccagcagcucuuccagagcuccggguggcaggcaggcccuaugcucugccuggaaggcugccagcucugcccugagcucagccugaagccugcaugcaggaggccccuccagggccuggaacaccacagccccaagccccagggccagcaagugggccacaaccaggagcccguaucgggaccagggccuuagaccccccauggcaggccgcuggggugcugugggaacuggcggcuccaccucaggcaccugggaggggcugggcagggcggggccaggaggaggugcuguguggguggcugggacccggcu

SEQ ID NO: 18681 - RNA, 4325 nt, Homo sapiens
uugcuucaguuccaggccucgggaggcagcgaggagacagacugggacaccgagcaugcagaaggggaguggucuugaaauacgcggaaagggagaaugcaccccuccuggccagccuugccgggcgaagugagaaguacugaggccugagaaggcuccacgcgugcgcaaagggccgcucgcugugauuacugggguggcgaugguugugaugacgccgcugccccgccugcgccgaaagggaaaccccaggggaggcggaggccagcggggauuucugaagccaagugguccccuucauccacgacggacaggaagggcgacccccugaggccacuuccaggucuugcgaccggaggagaguuaccaaggagacgcuccucccgaggccucgcgcgucggaagcuucuguccccuggauuccgguugacggacgcgucccccgagcagguucucgguagcagccgacacgccccaccccgggcacagcgaggucugaggaccacgcuaaggcgucacguccgcccugauccgcggcagcuauggaacgggcggagccgcagcggagggcgcuccgcuuugacgucacuuccugugagcccggcggugacaacggcaacauggcccugaacggagcuggugaggaccugggcggcagggguuuguggcugugagguacgggaggcagcccacuccggcaagacccccagucccuaugccucucuuccccagaagucgacgacuucuccugggagcccccgacugaggcggagacgaaggugcugcaggcgcgacgggagcggcaagaucgcaucucccggcucaugggcgacuaucugcugcgcgguuaccgcaugcugggcgagacgugugcggacugcggggugaggcgagacucgggcgagugaccggggauggguccgcgggccaggccacucagcccuuccccggcccuccccucuggaccccauugccggcgucucauuccggccccgugugcuuuuugguccguagacgauccuccuccaagacaaacagcggaaaaucuacugcguggcuugucaggaacucgacucagacguggauaaagauaaucccgguaagaguaaaaaauaauccgggagaggggccggauaugcuuaggggggaagcgugguuaaguggugauagaggcccgagaacaguagggcugagaggugacaguggagucucugggugggguagaaguaaaauuauuucuccuuuaggcucuaaagaggacccuuaacucaauaagagcaccaagcaccuccugugugccagccacugcgcgagagucugagcucaaccaggcccaguacugauggagaauugaagcuagggcauaaaugugauacaaaguagaaaguggaugaguugccuuauagagggacagggaaaacaccucaagcacagaaagagcagagcagaaaaggagauggcucagggcugaggugggccaggcauccugaccauuccacccacuuucuccucuuuuuagcucugaaugcccaggcugcccucucccaagcucgggagcaccagcuggccucagccucagagcucccccugggcucucgaccugcgccccagcccccaguaccucguccggagcacugugagggagcugcagcaggacucaaggcagcccaggggccaccugcuccugcugugccuccaaauacagaugucauggccugcacacagacagcccucuugcagaagcugaccugggccucugcugaacugggcucuagcaccucccuggagacuagcauccagcuguguggccuuauccgcgcaugugcggaggcccugcgcagccugcagcagcuacagcacuaagagaagccccugagaaaaacccucuagaaaaacagcuguuccucugugugguuuguuuuuuuccugguuccaagugugcaugccagccccagcuccacucaccuuuuuccagcuuuuggccucuucaccucuccacucugcucuccuugacgcccugagaugaguugagcuuguuucuucucaguuuccccagucaggaugagggaguagguagaggacuaugugaugccccuuuucuaaggaagaagccauagccuuuucaaagguagcagccagagggguggacccuagccuugucucuggcagcaccucugcagccucuuccgccaucugguguccauuccccaccuggaagugagguuuuguguuccgauccccuugauagauuccccuccuuccccugagcauccugacccuaucagccuaucccaucucaugcccaccccagguacucagacaccgacaggaguuuguggugaccccagcgucagguggcacguuaggcaccaaguguggacuugccagucuccugacuccacuguuagaucauuuuccuugggugugggggcggggcggggcgcggcggggagacgggguagcaaaaagaaccgugaagaaaccacgccugcccccuucagccuuuuccccccuccgccgcauuuuuccaucuccccuugagugaguggaugucccguugccuuuucucagcuuugcgcgacguggucccacaaccguugccuuuuuaagagaggcccggcccauccagaggggguggggcagaggcggagucugaggagcuggggaaggaacaaagcgaggccugcgggcggcggcugggcuccggcggggccgcggggugcggggccugcgggcggcggcccgggcggagcguuggagggaaggagguggcaucgccguccgcgccggccccggccaugaacgggcugcccucggcagaggcgccgggcggggcgggcugcgcuuuggccgggcucccaccgcugccgcgcggccucagcggccuccuuaaugcgagcgggggcucguggcgggagcuggagcgcgucuacagccagcgcagccgcauccacgacgagcugagccgcgccgcccgcgccccggacgggccccgccacgccgccggcgccgccaacgcgggacccgcagccggcccgcgucguccugucaaccucgacucagcgcuggccgcgcugcgcaaggagauggugagugggugggcgccgggccagcugggcggggggcugacgcggaggaacgcaggggacugggacaggcggccugggucucagaggacuugcaggcaccaguuggguugcaaggguuaugguaacaauaauuagugauaguuaccaauuauggcaguaguuaccauauauuuucaaauguuuugcugacguuacuucauuucauccggcuaaauggauaaccccauuuuuugggugagggucaugacuaaaguugcauagcuugcagguggugccugauguccacaaaaacuucguuuaggaaggugcggggaagaugggcuggggcccacuauuccagggggcggggcugggcugggguggccuggaccccaacuccagcccacccucaguugucugcagguggggcugcggcaguuggacauguccuuguugugccagcuguggggccuguacgagucaauccaggacuacaaacaccugugccaagaccugagcuucugccaggaccugucauccucccuccauucggacagcuccuacccaccggaugcgggccugucugacgacgaggagccucccgaugccagccugccuccugacccgccaccccuuacugugccccagacgcacaaugcccgugaccaguggcugcaggaugccuuccacaucagccucugaagggcuggggggcagggggcaugcacccaugcaaaaggcucagaaacucccccuccggcaagcccucagacuucggagccugcgccuuccccccuaccgccucaccucacaggagggccaggcauguauuccucagaggcgaaacugccaaacucuuucuccugucuuggguuggcuggcacuggggcgggcaucuaggguacagccucugcucauggcacugggccuccaguucuuccacaugugugcacccccagcuuggccaacccucagccuugcgguggggcccgaagcaucuucccuuccgcuuggcgucucugggauugggaugagugccuggcucccaucuccuccucaccuuuuguugcuaucggcagcugcuggcucaggggcaucccaccuccgggcucuggguuccucugcccuggaagggcuccaggacccgucccaauaaccacccacggccaggagggccaaggccccgugcuggauauuuaaauuuaggggccggucuccagggcgcguagauaaauaaauacacucagcgucguugug

SEQ ID NO: 18682 - RNA, 20895 nt, Homo sapiens
gacggaacccuggggucuccuggcaggccccacaguaaggccugggcccccgcacguugcagccuuuccuuccagaccagcggacaagccuggucuggaacuaugcuccucuccagccauggccaaccugaagacccccacccccagccgcugccagccccugcccuggggcucugcugugccccucuccagccccugggcccucggacagcgcccccguccucccggcuguuagccugggaagggggccaggcccugagcucagaccuuggcgauuccagagugucugaggcccagagccagccccgccagcacggccagacgaaaggaaaggggggagguggcagggugggcaccaggaagccauuccgagggggcuggcagggaagcuggguucuagcuuuguucuuucugcuccucuucuggaccccacagacuuccuccugggaccuccgugagcccuggccaaaggcuguccccacccuuuagcccuuuccucagaggggauuggaccagcacuaacgagaaguuacuuuggggcccugagacccccacguuugcaagggaggcugggaaagagcuggaaggccugggcuccggcuccacccggccuccaucgucagugugacccggcagggccaccucucucccucagccucgguaucucgcucuacgcaggccuccccgccccgccccgcccggaggaauccgcggccggccagacggucccaggugagggcccucuggaaagggcccagcgcggccgcggguuccggcgggggcgggcaucugggguggggacuguccccgcgccaccccccagccuccgccagccugcacacccucgcuucuccaggcggcagaggcgacgcuuuaaacaacaaaaaaaaaaaaacugugucccuggcccggggccagcgucccagccccccucgccgccgccgcgccgcgcuccagccagggaaaacaacugcucacuucucccugagcccuccccgcgcgcucccugccuccccgcggccgcgggagaggagcccggccagggggaggcgcggagcgggccggccgcccggccuuccucucccucgcuccuccucuccgccucaacuugcuccggccuccucgcuccugccugaguucggggccuggucugggcuucguccuggggcugggaaguuucugcgcuccccgcuguccagucugcaucuccgcgccucccgccgggcccccgcgguccccucccgcccgcuucccccgcugcccucccucgcugcccccuacccucucccggggcucccggcccucuacucccuucgggcgcgggccccucgccccgcccgggcgcgcccccccucccccggguccugcggccccggaugcccgggccccgaggggcugcuggcggccuggccccugagaugcgcggggcgggggcggcggggcugcuggcgcugcugcugcugcugcugcugcugcugcugggccugggcggcagggucgagggggggccggccggcgagcggggcgcaggcgggggcggggcgcuggcccgcgagcgcuucaagguggucuuugcgccggugaucugcaagcggaccugucucaagggccagugucgggacaguugucagcagggcuccaacaugacgcucaucggagagaacggccacagcacagacacgcucacgggcuccggcuuccgcgugggugagggccgggggcacggcugggggcaggggaaggacaggcaccaggcccggugggagagcuaguggggucuuggccuuagagacugggggcugaggguauaaagggcagagauccgagggccugggggaccaggggccucagggaacuugggaggcuggaacucugggggccagaguuggagggcugcauggaggccuggacuuugaagcuuugcguuaggguuggggccuaagggguggggaaaugcagagguccuggaugacacuggcuucccagaaggugcugaguucugagcaggagcacacaggguuuuugaggaaugugagccggggacaggaagccucagagaagggcuaaauauucccgcaagaagcagacuugcuggaagaaacaagaaaagucuuuacaaaaugucuaaaguagggccugccagaguagacaccugcauucccugggaggaggagcuaaggucagggcuggggaugggagccggcuacuggcaaggucugaguagggaggguguugaggccuaaaaguagggugcaggccugaagguagggacuaguucgggguucucagccucuccuuuuccaaugccuccccauaagcuccuaacauccugccucagaggcccucagggccccccucauccucccccaagccccuacacccuccccaguucagcuuggaguccacccccuccccagcaucucucuuuaaagggccaggccuggggcucagucauccuccugcuaggccccgugggccaggcucggggaggugucccagcaguaauuacccuccuggacaggguaauuaggccaggcccaggauggcaccagcaaaacagccccucuuacacauuccuauauucacucucccacucacagagcuaaggaaccccacucauguggcucaaauuugucaugagauggggugugcgugcgugugucugugcgcauauugccccugugucuggggucaugccaugggcauggcguggcacacugugaaguacccgucuuuguguugucuugggugugugucucuagucgcuguuagagaguaugugggaauguuuuuguuuuuguguuuuugagauggaguuuugcucuuguuacccaggcuggagugcaauggcgcaaucucagcucacugcaaccucccccuucuggguucaagugauucuccugccucagccucccaaguagcugggauuacaggcaugcgccaccacgccuggccaauuuuuuuguauuuaguagagauggaguuucaccauguuggucagccuggucucaaacuccugaucucgagugaucuaccugccucggccucccaaagugcugggauuacaggugugagccacugcgcccggccaaauguaugggaauguuuaugugaaccuguguuggugucaggaugagucucugugugugugugacaagaggacugugggugugaguguacguguguccaucucccaggcucccuggccauccugcccaggcugcugucuccaucugugcugcccacaucccccaggcucggugcccaggccacagugggcgggugucauugggaggucacucucaccgcuaugagugacucacuggcagaaaggaaaaagagaauccuaccuccccccgcccaggacacaccccucugcucugugaggccuggccccaagaggccaggcaggaugggcugggcugggaugugcuuagccugacccugagggccauggauaugggcugucccugugaggcccuucuggcauccaggagagcagcacccccgcccuccugcccuccugcccugggaagugagggcagccauggggugggcaggagaagggcuggggcuuugggaugagucagagccccaaggcugguaguagcacagguugaaggugaguaugggacagaaacagacagaggucccauccucucccucagucauucuuucauucauucccccgaacccccugugggacccagagcugaggccagccuggcccugccuuccagagcacccucuauaaggaggcagacagacaagaacauagccaagcaggugccaggcagagcuggccagugggugguaaggcaggagagggagcucaggggggccggauaggaggaaagccucccuccugguggagacacugagcuaggaaggaugagaucugcauauauagagaggggggggaccuggggcccuguuguggagggaagggcauggaugaggccaggaggcaggaggcaggcacauuugcaagagggagauggguccuggggugugcaguacacagggaaggagcagagggggaugggcugaaaagguucugguccauggagugagcuucugccugaggcagguuucucugggacacugagauuguggaccagcaggagaggcuggaagccaaggaggggucuggguggccaggccugggccagggcaggagcaguggcccuagggaggaggggaggcagguucaugggacauuagaggcuguaacugggcaggggagagcaggagggacggagccgucggggcucagcuguggaugccugguggccaggugaagaggagguggggaggcaggaugcugacuucugacaguauguccugggcagaggugccugagagagcccuggaaaggcugggggcugugucugugucuugagauguggacaucuuuggcaguggugaggugggcgccccaggauggugaagagggagaggguggagagcaggcagagaggacugaggccugaaggagggaaggguuuaugggagaagaggaggaggcgccagggacggagccaauaccuuuggaaggcucaaggggaaagccagaucaccauaauuauuugcuaccacuuauuaagcacccuuuguguaccaggcccugggguaagcauuuguacagcccuuaccucaucuaacccacacaucucuacagaugaggacgcuggggcacagggaggggacgugaguugcucagggucgcacagcuggcacauggcuuagcgaggauuuaaauccuggacuugagacuccagaacccaacauagguguaaggauguuggggaaccuagagagggcaguuucccuauguaggauguaucucaaaaccuggcuucccaagaggacagagccaguggguggcaaggaaguagggaggaggggaaagagacaggaugugggugagggccugaccccacucuucuccccaguggugugcccucuccccugcaugaauggcggccagugcuccucgcgaaaccagugccugugucccccggacuucacugggcgcuucugccaggugcccgcaggaggagccgguggggguaccggcggcucaggccccggccugagcaggacaggggcccuguccacaggggcgcugccgccccuggcuccggagggcgacucuguggccagcaagcacgccaucuacgccguccaggugaucgcugacccuccugggcccggggaggggccuccugcccagcacgcagccuuccuggugccccuaggcccgggacagaucucagcagaagguaccaggcaacuggcaaacccgggaaggucgccagugggugggcacuaggguggccagggcagggcagguucagcccuggaggagcucagcgcggugacccgcggcgcggugcgggcagcccugaggccaccgcgcccgcccccagugcaggccccgccccccguggugaaugugcgcguccaucacccgcccgaggccucaguccaggugcaccgcauugagagcucgaacgccgagagcgcagcccccucccagcaccugcugccgcaccccaagcccucgcacccccggccgcccacccagaagccccugggccgcugcuuucaggacacucugcccaagcagccggugagugaauccacagucgggaucugccuuuccuucucucaggguugcucugccccaacucacucggauagcagaaaacugaggggcgggggaagaggaaaaggcccaacccuaacaggcggcaccggggcggggugcucugugaccccaccucccccuccuuccccuaguguggcagcaacccccuccccggccucaccaagcaggaagacugcugcgguagcaucggcacugccuggggccagagcaagugccacaaguguccccagcugcagugugagugcuugggcucagggggcguucccuaucugguggccccuccccacccaccccacccaucccugcagugggaguccccaggucaccagauuccucucuacaucugcugugccccuccccaguucccuccucacccuccccugccaagcuauccucucucugcagacacaggagugcagaagccagggccuguacguggggaagugggcgcugacuguccccagggcuacaagaggcuuaacagcacccacugccaggguauggccagcuaggagauucugugggcuggaggggcaggccagccaucacuggggguggggagggucccaaggugggcgagagaggagguggggcuggggcaagacccugagguucuuggagcagccugcugucaccccauggccccagaccagaggggccaaacuuccacuuaccacagacaucaacgagugcgcaaugccgggcgugugucgccauggugacugccucaacaacccuggcuccuaucgcugugucugcccaccuggccauaguuuaggccccucccguacacagugcauuggugagaccuggggcucagguuccugggaggucacaaggcaugggugggagcaaggaucagagaucgcaagagaucagagugggguuaaggguugacugcaggaggaacaaggcccagagccaauaggaucagggaucagcaggguccggggucacaugagaucugccauuagcagucacauggggucagggauuacauagagucagagucaugcagaacauaggcuugaugaguaggaguggugaaguccaggauagcuagaaucgggagucaauggggucaguggucacauaaguuucaggggucacaugaguucagggucauauggggucagagaccacaugggggaucaaggguugucugggccggagaggcaaggucugcagcagcugggcagagggacgugggcaaugugcaggcucagaugcccaugccccccacuggccccugcagcagacaaaccggaggagaagagccuguguuuccgccuggugagcccugagcaccagugccagcacccacugaccacccgccugacccgccagcucugcugcugcagugucggcaaggccuggggcgcgcggugucagcgcugcccaacagauggcaccggugagucaggguuacccggggauagggguucauagguccaugcaccuguccaggaaaugcucacuuuugugucugcugucuugacugcagcugcguucaaggagaucugcccagcugggaagggauaccacauucucaccucccaccagacgcucaccauucagggcgagagugacuuuucccuuuuccugcacccugacgggccacccaagccccagcagcuuccggagagcccuagccaggcuccaccaccugaggacacagaggaagagagaggucuagccugaccccuucugaucccugacccaugccaagccccuaggccugaccccuugacccgugauccacagaucugaccucacagucuaacccccaauuccuuaucccugacccauccacugaccucccaccugacccucugaccccugacccagauauuugacccugagcuauaaccuccuaagccuucuacagccugaccuguaacccaaggccauucaaccugaucaugugacuacuaugcaaacacacccuaaccccagaaucuaaccccugacccuugaccuggagacaugauuguugaacucccagagacccuaacugcaaauacucagcugcugaucccagaucugacucccuucucccgccccaacacuucauggccccaucuucuucccuuuuaggggugaccacggacucagugaguaugagaacccagaugggaggggugggcaggcgagggacaggagggcucaugcugcugucacccgcagccggugagugaggagaggucagugcagcagagccacccaacugccaccacgacuccugcccggcccuaccccggugagcugggcacuguagggaugaguccucaagggcuaaaucacugggugggcggggaguucacaguuuaaguacucggggacagucaagcugggguggggcgccgggccaagacugaaguggaaagggaggcuucagucaauaucgucucugaccagagugcacugccgcccgcagagcugaucucccgucccucgcccccgaccaugcgcugguuccugccggacuugccuccuucccgcagcgccguagagaucgcucccacucaggucacagguaaggcccgcccagcaaagccaccccugccuaggccacgcccccacuuuaguuuucucuccucccucccgcccccaggcauucccuagcgcuaauaggcuagcguguauccagggcugggcacuggggaagccuggugagcaccagagaucccacugcccuaaacgauccagguagcauggugguuagcccauucugagggauuucauucauucaacaaauacuuauuaguguuacaggucuuuuagaauuugucuagcagguuucccaguuuuuuuuuguuuuuuguuuuuuguuuuuuuugagacggagucuugcucugucgccaggcgggagugcaguggcgcaaucucggcucaccgcagccuccgccucccggguucaagcgauucuccugccucagccucccgaguagcugggauuacaggcaugcgccaccacguccagcuaauuuuuuuuuuuuuaguagagacgggguuucaccauguuggccaggguggucucgaucucuugaccucgugaugcgcccgugucggccuuccaaagugcugggauuacaggcaugaaccacuguucccagcccauaaccaucuuucaaaaucuguucagaaagccuucuaucauugccacccuacuuauuaucacaacccucagaacuccuuccuucuacucugauuuuuuuauuuuuauuuuuauuuuuuauuuuuugagauugagacggagucucgcucugucgcccaggcuggagugcaguggcgcgaucucggcucacugcaagcuccaccucccggguucacgccauucuccugccucagccuccugaguagcugggacuacaggcgcccaccaccacacccggcuaauuuuuuuguguauuuuuaguagacaugggguuucaccauguuaaucaggauggucuugaucuccugaccuugugauccgcccgacuuggccucccaaagugcugggauuacaggugugagccaccacgccuggcccugauuuaguuuuucauagcauuuauaagacauaggagauucugcuuauugaucggcuuguugccugucugcucugcgaggacaggaaauuuuugucuguuuuuguucaugcaauaucccuagcaccucaacagugccuggcacauaguaggugcucaagaaauauuuggguuccuuucuuucuuuuuauuuguuuaguuuguuuuuugagacagggucucaccuugugaccuaggcuggagucaguggcaggaucauggcucacuacagccuugaccuccugggcucaagugaucuuccagccuuggccucccaaagugccaggauuacaggugugcgccaccaugcucuuuuuuuuuuuuuuuuuuuucccggccuggggaguuuuccugugaaaacugggaaacuguggcagggugcaguggcucacggcuguaaucucagcacuuugggaggcugagguggguggaucacgaggucaagagauugagaccauccuggccaacauagugaaacccagucucuacuaaaaauccaaaaaaaaaaaaaaaaaaaaaaaagauuagcugggcgugguggugcaugccuguagucccagcuacucaggagaaucacuugaaccugggagauagagguugcagugagccaagaucgugccacugcacuccggccuggggacagagugagacuccaucucaaaaaaaaagaaagaugguuagaaaugccagagacaugaggaagggaggggcauucagguugggaaaaggauaucacaagggaaguuaaguugggcaaaggcauggaagcaugaaacacugguggaggagggagaacccacacacaggccagugucucugaaccaggggaaguccagugcacugagccuugucaaggaggcuugaguuuaaugccagaggcuaugggcagugucugcaggauuuugagcaucauaauugcuagcucagacugagcagucccucugugccagguacugucugaagaguuuuacguucuaaauaccauuuaaccuucucauacucugcaaagugagcguuguuagccucguuuuccagaugagaaagcugagccucaaagagguucaguaaccugccccaggucacacagcugagccguguucaagcccaugccugugugggcuucaaaagcacaagggaacugccaacccagcugaaacccugauccuccaugagcuccuaggguuagggcucaggugggagauggcuguucuugggggcuuugggaauguggacaaggccccucaaaggaggggcuguuaaggaagccuaaggagagguacuccaggcaaagagaacagccugcaaagcccacuggccaggugaguuuggggcagagcagaguucacuguuauggcccaggcugcauggcaggagugagggggaaggggugugggaaaugaaacuggugagcagugaggauccaaaggaggggagaggcuggaggcagggaguccugggcuuggugacaaagagagugaggggggugguuccuggaucugacugccugugcacagcuuuggcacuaguuaggauucccaggaaaccagcuccugcuagucuugggaggggguaaucaacccuucuggaauagggggucgggucccuggggcaagggcuuauggagucacugggcuagaggacacuggugugaccgaggcuauagaguuuaagguauugaggcgacuggggagaaaggaguuuuagucccuugggugggaguacugggacgacugaggggcccugaggggaugugguuugguuugaggugaguggggucagggucuuggagugaaccgggaauggaaguauccgggccuggguguggggugauacggcugucaggggccuggaguccuaguuuggagcuuucuggggucuugauauugggguuaucuaaaagagagaaauaggacauccuggaguuggaguaugggcguacaggaaccugaggucauggugugacugggguguugaggucugcccuggggauauggcagaaggugagcgcucccugcucugccgcuugaccuggccaugcccgcagagacugaugagugccgacugaaccagaacaucuguggccacggagagugcgugccgggccccccugacuacuccugccacugcaaccccggcuaccggucacauccccagcaccgcuacugcgugggugagcgcagggcaggcggcgggcaugcagguggguggggggggaccccagauaacgacgcuuccuuugacuuuucuuggccuacccguucuucucagaugugaacgagugcgaggcagagcccuguggcccggggaggggcaucugcaugaacaccggcggcuccuacaauugccacugcaaccgcggcuaccgccugcacgugggcgccggggggcgcucgugcgugggugagcgccgccagggcggaggcggcccugggugggacgggcucuccuccagaccgccguguaaucccuccccuugcccgccgccuccuacacccccuucguggccccuuccucccgcacagaccugaacgaaugcgccaagccccaccugugcggcgacggcggcuucugcaucaacuuucccggucacuacaagugcaacugcuaccccggcuaccggcucaaagccucccggccuccugugugcgaaggugaggggaccccauucagaccaaagaaggagcuccuuagcugucucuccaccugggguggggcuggggugccugcauuuuuuuuuuuuucccccgagacggagucucacucugucgcccaggcuggagugcgguggugagaucuuggcucacugcaaccuccgccucccggguucaagcgauucuccugccucagccucccgaguagcugggauuacgggcgccugccaccacgccuaauuuuuguauuuuuaguagagacgggguuucgccauguuggccaggcuggucucgaacuccugaccucaggugauccacccgccucggccucccaaagugcugggauuacagccgugugccaccgcacccggccuguaugcucggcucugggccucucagagguugggguccgggagccucguugaucugugugggaggaagucccugcuguggacgcugggagccgggccacccgcguuguccccagauggguccucuuccuucucccucccgugcagacaucgacgagugccgggacccaagcucuugcccggauggcaaaugcgagaacaagcccgggagcuucaagugcaucgccugucagccuggcuaccgcagccaggggggcggggccugucgcggugagggcggggcccggagccgaguggguggggccgucaggugccucccccagucuggcuccgcugggggcggggcgggguagcgguggugauuggcgucugggggcggggccuuccgggaguagaggcugcccucucaaccccgcguuccagggaagagacccacacccccgcgaggugcgcgguccgccuuccgguggggcagaguccgaggcuaggucuuuccgccgcagacgugaacgagugcgccgagggcagccccugcucgccuggcuggugcgagaaccucccgggcuccuuccgcugcaccugugcccagggcuacgcgcccgcgcccgacggccgcaguugcuugggugagcgccagcacccccgccccgggccuccgccgcccccuacgcgcugaagccggggagcgggucacgcugucuguaaacaguggguggaagguggcucauucauccccaggugacucugcucacucauuuucucaacgaacuuugccaaggaaggcaccacuagaauuuccacguaggaagggucucgggguagagcucgaagcugcguuugcaaagcauguuacuuaaauuugaaggaaaaaagauaucaaagaaugagggcagacgauaguacuccccccugcacuccuguuuauuauacgccaagaggcggggcugggggcugggacucauugaaaacuggagaaggaaagacagacuguagcaugcagugcugggccuggauggagcugggcugcuuccuggagacacagcgggaugggaggaaggaggccugggucaucuuaaagaaucacuaggaauugggcaagaaaggaggagaggaacagcauggcaggcacagggguuggcacuggcagaucagaggugagacagagggugggguguuggggaacuguaaggaaugaucaggcuaugggggcugaggcuggccggggagggacagguccccaucccuuggagggcccccuaaguccugccugggagguugugcuucacccagaagguguuagagggcaccugcagcauuuuaaguguaagagugacaagauuugccauuuguuuuagaacguucccugcugcugauuguggagggaggucuguugcagagacuuagggcggagacagugguggacaggaugaguggugggcucaggauggccaugagacgaugauauuggagaaauauuagaccuccuggguuuuuuaacuggaugucaagugaaagcgagggugauaacgaccccuccccguuuccaguuugggugagugaggggguagugcugcucacugggaauggguccucaugcgugggcauguuugggagggaaaaugcugagcuccacauuggacaaauugaauggauugugccugugagccucucagcaggagaugccagcauacccaccuggaaugauggaccauggaccgggggagcuauggagucuugggugggccugcuuagccaacccaagguggguuggguaagcagagcaucuagcagagccuuguggacacugacaguucaggggcaggcugcggaaggcguuggaggagauggugggggagggauggcaggggcgccugaggggcaccaucugggaagcuggggaggacauauuuccagggaaggaggaggaugagccaagugcaguagagagguucuuguaaaauaauaacuggugagacaauaagucuuaggacaagacuuaggggucugcccccuaauccuacauggaaauccuagugaugccuuccuuggcaagaaggucccugguagccuuggcaggguagcuuuugggauaugauagggacagaggccagagauaugugggcagaaagugaagaagaacaagaccuggggacucuugcucuuccaaaguggggcuuugguauaggcugaggaggugaugccaggagaguggaccaggagacgagggcagcagggucaggagaggagggaggagagccagcggaagggacaucucuugcuguaacaggagcaggaggggaauggauguagauaacgauguucaguggguuaagggggauuaccuuuaauucucucaauacacagugaagggccuggguugaguaggggacucaggagaacaguggcgguuuggaaguaucccagggcauggggcugccuaggggcuuuauggaagucaaagcuuuagaggagucagagagggaggugccagccacacgaggcucuguuggacugaggcugaagccuguggguauguuccagcaugcucagcuugguggcugcuccagucccacuccgcacccaggauccacaggccacagcucugaccagagacugggcauugccagacagugaggaggaaggagagguguuuauggaucagggacgggaguccuagggaugauaagcccugggcuccagcugggaacuaucagagucugggggugucaggcaagcucggaggacugagagggaggccaccaagcccugugagagagaagguggaggugaggacuugagaacaguggaaagaaggcagccucugagggccccaggguggagcagaucugagugaugaaaauccccuugggacccugagagugaggggaaggucacggaagccgagagauccaggaaugugaggucagaggcugaccugguuguccacgcggauguucgaaacucccaggauggagagaaaaacagagcaggaggaaugaggaaggugggugcugacagccacaggaggacugaggcugcaggaggccggcggcaccucagaggccgagcucaggcuuggaggggucugggaugugggcaacaacuggcuccaucagagaggccucaggaaagugugucccgggggagggucaaguuccuuuacugcaugagcagaagaaagugggaagaacaaggauagggaguuuauccccagaggaaaaagggagccauggcaggugagggaagggugggagcagcagugaaagcggcuggggcagggagagagggcgggggaggcuggggaggcucuuuagcaucagaccuggccuagggacccuggcagcaccugaccuggucgucagggcacugugugccacccagaagcagggugaggccugugcuucugagugcugcuggccucagcucuggugcuccaggccaugcgcagaagugagaaaacaguaguagaaacccaagaccacccagccugguccucugacacccccuaugcccugcagauguggacgagugugaggcuggggacgugugugacaauggcaucugcagcaacacgccaggaucuuuccagugucagugccucucuggcuaccaucuguccagggaccggagccacugcgagggugagggaucuuagagcuggggugcugaccugucccucccuaccccaggacccccaccccccaggguccaguccuaauccagaucucaguuggggcauaggggcgugggacugacccagggcucugggagaaagcuuuggcugccucaggcugggguuggugaucagccccugagauucuccaccccuuccauccccuacagacauugaugagugugacuucccugcagccugcauugggggugacugcaucaauaccaauggcuccuacagaugucuuugcccccaggggcaucggcugguggguggcaggaaaugccaagguaugggggacuggcugaggguuccugagggauguggcagggagcaguaauucccuagacacacuguggccuuucuccauccauccauccacccauccaaccauccuucauccauccauccauccaucuauccauccauccauccauccauccauccauccauccauccauccuucuauccauccauccuuccauucauccuuccacucacccacccauccaucugcucagccuuccagucuuucaccuagaauaacaaugaucacaguaaacaugacaguuagugcuaucguggugcuuacuaugugccaggcacucuguuaagcucuuuacagauauuaauguauuggucuuccccaucaacucacccauacacaugcauucauccaacaaaaguuuaggcugagugcaguggcucaggcugggggcgguggcucaugccuguaaucccagcacuuugggaggcugaggcgggcggaucaugagguuaggaguucaagaccagccuggccaauauggugaaaccccaucucuacuaaaaauacaaaaauuagccgggcgugauggcgcacgccuguagucccagcuacucgggaggcugaggcagaagaaucguuugaagaugggaagcggagguugcagugagccgagaucacgccacuguacuccagccugggcagagagugagauuccaucucaaaaaaaaaaaaaaaaaaaaaaaaaguuuauugagcaccuacuauuuuccagguucugugcuuuguacuagguaaucaacaaucacccagggcucccagcuaggggaggccaacauguaaacugauucugacaguucaggguccugggugccaagaaagguauagacuaaugauuaauugcaauggggaggugaauguugaacuggacugaaacguaaguaggaguucccuaggcaugggaaaggcaaggcacgagaagucauuccaggaccaaagagcaguaauugcaaagcauagagaucuggaaggagcuaguuguguuuacagaggaggggagggugcccugagcacagaguuggggaguggaggguggucuagaguaaggcgugaugagaccuaaagguaucggaagcucaauugcauuugaggccuuuccauuugggcuucugauacuuuuagguuuuguaagguuagugggagccacugaagguguuaugaaggacagcagcuaauguccacaugcacauucagacacaugcacagacacagcagacuuccugcuguacauacuuugaaaccaaaguggaaauucagguucugaacuugugugaggcccuugaggugcagccccagggaaagaggggcuggguuuccagcugcgcuacucuugccccgcagacauagaugagugcagccaggacccgagccugugccuuccccauggggccugcaagaaccuucagggcuccuaugugugugucugcgaugagggcuucacucccacccaggaccagcacgguugugagggugaguguccucccagcuccucccucggacuggacaacuccccugagcugcagcugggauucagagauguguccuggccccacccuccuaaauuuggggaaccggaagaaaucucuuuuggcugggggagucugguggggccagacgaugaaggguccagaacaccacguugagaacagagccaacucucaggaggaggcuaaggggagccagggaauguggggggaaagaccuguggugggugggcaggguggacagggccaaggggggucugugcacaacccugagcugccgucugccccucagagguggagcagccccaccacaagaaggagugcuaccugaacuucgaugacacaguguucugcgacagcguauuggccaccaacgugacccagcaggagugcugcugcucucugggggccggcuggggcgaccacugcgaaaucuaccccugcccagucuacagcucaggucaggagccgggcaggccccuucccagaucuucaguuucuucaucuggaagccaaaugugggaaauggcgcccccuggcaguugggaaauaggcggcgggcugcagcccuaagcccacgcgcgcgcucaguccugccucuucccuccccacggccgcccugccccugcagccgaguuccacagccucugcccagacggaaagggcuacacccaggacaacaacaucgucaacuacggcaucccagcccaccgugguaagcgcccugcggcuccgcccgccccgcgcccucucaccccggguugggcucgcccggaucccgccgggacucgcugggucagcugcccgcgccggguaagccccgcccgcaccuuccucgcaggccccgcccuguaggccccgccccuccuguaggccccgcccggggauggcuucgcuccgguggugcgcccagcccacgccuccgggcugcagcugcgggaccggagcggccaguguuugucaccccgcagacaucgacgagugcauguuguucgggucggagauuugcaaggagggcaagugcgugaacacgcagccuggcuacgagugcuacugcaagcagggcuucuacuacgacgggaaccugcuggaaugcgugggugagcuccgccccccggcggccguggggaagcggcagggagacacgcgccaccgcgcccaucccgggccugccccugcuacccacgcuuuuccucccugcagacguggacgagugccuggacgaguccaacugccggaacggagugugugagaacacgcgcggcggcuaccgcugugccugcacgcccccugccgaguacagucccgcgcagcgccagugccugagcccggaagagaugggugaggcccgggccggggagugggguacgcgggaggggcggggcccgggccgagcugugacggcccccacccacccccucgcuguucguagacguggacgagugccaggacccggcagccugccgcccuggccgcugcgucaaccugccgggcuccuaccgcugcgagugucgcccgcccugggugcccgggcccuccggccgcgauugccagcuccccgagagcccggccggugagggcgaggguuggccuuggccgaucccggggcccuguccgucacguggcccccgcgcaggugggguggggcggaggcgggcgguuccugccuugggccccuccccugaugccaggugucuuccgcagagcgugccccggagcggcgcgacgugugcuggagccagcgcggagaggacggcaugugcgcuggcccccuggccgggccugcccucaccuucgacgacugcugcugccgccagggccgcggcuggggcgcccaaugccgaccgugcccgccgcgcggcgcggguaaggcagucggggaggaguuggccgggagcgaggaugggggccagggcccggggacccggacgucgcugaccaguucugcuccucccagggucccauugcccgacaucgcagagcgagagcaauuccuucugggacacaagcccccugcuguuggggaagcccccaagaggugagugcugccgggucgggcgguggcgggguugguagccuuuggccggggcucaguguugaaguccauauuguuccgggccacgcagaugaggacaguucagaggaggauucagacgagugucgcugcgugaguggccgcugcgugccgcggccgggcggcgccgugugcgagugucccggcggcuuccagcucgacgccucccgcgcccgcugcgugggugagccgggcuucgggggugggggcaggggcggggccgguggugaggagccgccuggaggcucagcgaagccgcaccugucgcccucaccuucagauaucgacgagugccgagagcugaaccagcgcgggcugcugugcaagagcgagcgcugcgugaacaccagcggcuccuuccgcugcgucugcaaagccggcuucgcgcgcagccgcccgcacggggccugcguuccccagcgccgccgcugacgccgccgacgccgcccucggcccagaccucggugaucacugagggauuuccgcgagcucggccucacuucugccccgacuuguggcucggacccagggaccuucagggcccgcagacccucccggcgccuugagacccgaggcgccccuaccggccccccuccccgguuagcgggcgguuguaaggucuccggcgggcgcugccugccuuccucccagaggguguuuccuagaaacugauaaaucagaucgugccucuuuacccuuggcuuucgaagcaaauugauguucacgucugacgugggcgcgggcugcgcagggcggcgccagaccccagccgccucccaggggcuagacugagcccggcacaaggggugugaaauagaauuuauuguggcucugauuauguacacgugagauggccuggcugggccggccgggcucacaugguuuguacaauaaauacaucuguggggcgggcucuccgcagccgggaagggccaccgccacgguucaguccagcuuccgggcucccagcuucauggggcccuuggccaccuuccucucggcgcguuuggccuccaucucccgccgccgcuccucgcgcuucuuccgggccagcucagccuugaccugucc

SEQ ID NO: 18683 - RNA, 2270 nt, Homo sapiens
auuuuguaaaaaguuccagcaggcuguggacagcaggaauaggcuguugagggguugggcacagggucaggugcuggacacuagaacaggacuccacuccgacauuccggguacacagaacuucccagugggaagagcuagccacacaguggcagaagcuuggaaaacaacccaucccagcccuacgcucucugaaugugaccuugggugcaagcuggguuuguaugaacuuacuggcauuuuuaacaagacaguguguacgggagcauuucaacugcaaagaccacugaacuggacacugucggcgugacaguaucaaguaaccauuaggcagagcaaaacguaaauaaaaguacucugugaugggguagucagucagaugggguggggucggcuagggggcagugaggacaacuagaugccgagguagacagaccaagaccagcuuucuguguaaugcaaagucaaauuaaauagacgugaguggauggaaagacguaccuuauucuugcauaagaagacaacggcaugaagacaucacagggaagguuaagguaaacaugcagccuggaauagccaggagaauucuggaaaaguagaauaaugagguagggcuucccuucgcuauuuugaagugcagauuacacuauguaaaaccauuaggaacuggcacgugaauagacagaucaauaguuaauagcuguauuagccagaaaaugguguaaggacaacaggcuaacuaacccugucacuuguuaugcuaaaauuaagucuagauagaguccuccaaaauaaaaauaaaaagaguuaggagaaaacaugggguuuaacaacaacaacaaaaucuucagcuggauuagccuuuucaaacuacucacaaaauccaggaaccauaaaagaaaauuaguauauauauauguauauauauauguauauauauauauauacauauauauauauauacauauauauauaaacuaaagagcaaaauauuacaauaaaacuuaaagauuagugagaaauaggaauguauuugaaaaggguuaauuuccuuaauauguaaagagcucuuauuauuaaucaguaaguauacaacccaauagaaauacaaauccaaacuacaauuaaauacuauuuuccacuucucacauugacaaauaaccaaguuuaagggcacagccugggugaagguguggggaaaugucaaugggaccaaccuccuugagguggaagcuggggguguccaucauauuuagaaauuuacacaugcugugcccagaauuccuccugaggaaacuuuucucucacagauauacuugcccauguacauaaaaacccauguacacagauaugcgguauagccuuaucuacaguaaaaauugcugaaacaacuuaaugguuccccaaaaagggaauggguaauucaaacacggcuaccacacagauguugaaaagaccaaggcagacaugaauacagauaugcggugcuuaccuagauguacuaguaacucaacaguccacagugcaagacaggcugugugguguacccacgccuguacagcuuuacacauacacagguucucuggaaagaaacugcagcaacuggccaugacgguggccucugugggaagggaggcuggggguuagagaaagaugccacugaaucacccacaggguuugaaguucaaacaugugcagguauggcuuugaacaguuuucacacaucuauucauaggugaaauuaacuggaaggaaacuagcaaagcauuugccuuuggggucagcacaggagcagaggcccaggcagggccuugcuuugacacacagaugaugggucacacaguugucaccuugacagaagaguaacagggacagcacaccagucacucuaggagcugaggccagaggaacucagguauuuccuucuagagguaguaaguccaccgaggcagaugccaagccggguggugccucgcuguguacaauguucugcucccugugccccuaugagugacccuaugagguaagagccagagccgggcucacaccugagcuccuggcauguggcggcccuuuagaagacagaaagugugugcuuagccccugaagcagccacgcugugcccagcggagggcaggcgcagacagcacuccuucccagaccaggaugccacuuaagauuucaacaaacuaaacagacaagugaauaaaagaucauuaaauaccacuuuuuacaaaugucacagacgcuuuccuagaauaguuuguuuu

SEQ ID NO: 18684 - RNA, 3842 nt, Homo sapiens
acaauucuaaugaguuuagaacucaaacuuuauuugugcuguaaaggggaagaaaagugauuaguaauuauguacaugacguaacagaauuaguucuuaccauacagagcaacauaccaguacuuucaaccaucuacuuuuacaguuucaauuucacaacagcauacccgagacuacuuccccauacaugcgugacuaauacacucuaaaucccaacgacaguaauuguuugcaucauccccaagucauugguuaagaacugaacuaccaugucaacauauuuuuaaacauuuaaaaaauggaacccagaagacagaaagaucccaacgauaaaaauaaccaugauuuuuaaaauuucaagugaaacuuaaagggaagaaggaaaugauaaaaagccauugguauuacuuuaccaauucaauagacgcagcucagaaccaagcaggguuuucagaucacacauguaguaaaggcaccucgcccacucucuccccacaauccccauccccuucccuuuuuaggucuuguuuuccaaacugauuuuaggugauaguuuccccucuagucuuggcucauuuaaaaagcacaaacauucaaauuaaaaauacaauaaauuauucauucuaaccuuagcaaagguacauggauucugucuaccaaauauuaauuuuacagugaccacaaaagguuauuugguuguuacaaagacuacaauuugaagauacuagauaggcaaaaauuuugccauuauuaauaucgaccaaacacagaaaagacaacagauguguuucuaaggcacgauuuacauacuaaauucccuugaaauucaaugcaauuucacuucgcucaugauuuucaaucacaagacaccugugacaaaugaggaacaaauccagaagagcccaucuaaucucgucuuaaguggucccuuaaauacguuaaaagcccacaauauaggcauuuacaaggcuuuucuaagacuuccagcuccugaaaaaaucacaccuucacaguuucaaaucaaccaccuaaguugcuaaggggcagcgaaggaugcugaucugcugcguaugcaagucugacgcccaucuuucaagugacuaauucacuugauaacacccacaccccaaacaaaacaacccucugaaacaggcugucuuggccaccaggaggaagcugguaaagacauuuccccugccugugagauggcaucacacaccccucccuuugguucucggaaaacuggugacucugugucaccuguuuucaguuaacacuucuucagucuuccccaccuuguagcaaagcaaaacaauuuuuguuuguuaguuugucuguuugcacuuaaaguucuaagcacuuuggaaaguuucuaagcaacuucucacuuccaagcaacaacuuaaccaacacuaacaacuuacuauuauuaauuaguauuuucuuggcucacccacgcacuaaauuccccaaagccccagagaauucccuucaaccugcauuuccuaccacccccaccacccacacuguaucucuaaccaacccucuccccuucuucacccucaucccucccaguaccagugccaagcugcauacccccaucccccacacugcaacgcccacgggaccggugccaagcuguccccuucuccccgucccccacaacucccaccucaggguccucuuacuagaaugccaagaaaguauuaugaaaucuaacgaaguaaaguucaaguuuaaaaaaacgaagcaagaacaaaagagcacuaccgguguacccaccauucccuucuccuaguaaucugcaaugcaaucacaaugcccaaacuagaccugccauuucucacacacagauuuaggaaugaccaacuuguacccucccagcguuuagcacaacacaaugacacccuuaauuugacaaucugcuuccucuaauauauccccagucuaaggcauuuaaaauuaaacagcucuucaacgccccaaguuauuucaucaggcuaagaacuucuccgagaaacgcacaagaaggcaggcaaacagguggguaggugagaggucacggggcuccaucugcaagcuccaucuacaaggcaucaaucugcguuguggcaucaacguuaaaauguucuacagcuuagggaucuucuugaagcaagguuccaagcacaaaacuaguaugaccggaggcucaauuuagaagaugcagcaucugaaaaccuuuaccccaggaaaggaggggugccugcuggcauucaugggcucuggaacaagcauuuauucaaagcugauggccccucgagccggaugcaucugcuguggacuuuuuaagauugccccccauaagcucaucugcaaacuuuaaaugguagccuccugaauacagggcuuccugagcaaggccuggaaacagaacauuggagaacuuccuccuccuaagccucuggaaauucaaucugcaggcaucaauugaggcgggcucucuccuccagggucuccccuccugcaaugcuaggacucacacuggccagggacuccaugucucccgguuccaucugcucgccaugaggaacacuauaguaacaaaccacgguccaugaagcauuuuuguaacuuucagcuggauggcugcaggcccacccaagggugcacauucacuccccacccucucugcaggcaagcaacaccgauccgccccaccccagccucagcgggaaggccucucuuccuccaccauuaccaacaauaccgacuccaacagccacucggcuuacugucccgggcuuaccagaugaccagguaauguuuuaagugaauggauaaguuaaagggaggaagaagggguggagugagcucacaagaagaguuuagcgccaaaccuagagaaaaguccaaaaggagcacugccaccuggaaaauaaagcguuggucaauguuguccccaacacccgagcagcgugccucgcaguccccgccugucaaacaugcuaggugccgcaccagucaccggugaggauggcgccuuaacuccacaucacuccucagaccaccccucaccuccgcccaggggccuggcuucgcacccagaccuggacgcuccaccaggcugggcccggccugggccccgucccaggccgagcgaaaauuacauaccacccugggccagagcggucagccccgucgagcuaaguucaguuccacaagaccaggccucauccccaggcggguucacagcccuuggucuggaaaaaaaggggcugcuggcauggacaaguugaagauuagcccucccggcccuccugcagcccugcacccacugccugccuuccugaucauuuccagggcugcugcggccuauuccuccugacuccuccaccccuucuaccucucccugccuuccuccuuccacacagaccagcgcacccgggcucgcucagcuaugcaagagcggcgcccucccagaggucaaguucccccuccaccaggcaguagggacagccuggccuggagcguggcuguucugccugggggacccugcggauauuuuccaugcagccugccccacuguggucccccuagaccuagucuccuugccaagcuuccuucucgcacccccagcccgcccccucgucucaucuaacucagucaucucucccugucuguccccugaagcccugagcuagccacuuccucccccacaacuacacccaggcgcgcaucccucccugucgcuaacuccggcuggacuugccacaacuuuugcuuuuauagcccucagccgcgucaccggggucauugcucaacgggacgauuccuccacggccaccggcaaaaaagucccu

SEQ ID NO: 18685 - RNA, 1710 nt, Homo sapiens
uccgccuauuauuuuaacaaaguccaugcugccagaaggcaagccuaccucgaaacaccuggcacauucacaagcuaccaaagggaggagggugaacaggcucugauacuuggaguagaggcccaagcuuccucucccacgguuuuccaccgggaacgaagacaaagccaagcccugugcagccacaggaagucccaggaagcaccugugagacccgcacacccaccucggagggucccagggcugggaaagcccuccucucaggggcucucagcucaucugggacaagacagagccccugcuccccggagggcaagcugggaccagagaagccaagcacccauaucagucaccuuuccaaguguccucgauaaagaagagagugucccguguggcccaggcuuuccugggcaugcgccagcccccagaggaauccauggcgccaccugggaaggagcgcacagcagagguacccagggcacuuccuggcguugccccagcacaacucagaugaacaaagaccaaacuaaaaccugaagacccagacacagggaggggaggucagguccggucaguccccuaggggagcugcuugggcuccagggagugcccaccaggggauuuucaguuuuucacagacugugagugugggucuggaggccaggugguccacaggauagccaccucccagcagugacaucaccaaaggcuaucagaaaggcaugcucuuucugguaucucgugccugcaaaggagaccagaacgaggggcacaggaccccagguagggcccugccuggcucccuccauuccugauucaaccagggagguguggugggggcccucaccguguuucugucccgguucaauccagggaggccccuccuacccuccucagagugguggcccagccugguauugggggauggagcaccagcaggaggaaggugggaaacuggucauccaaguccgggggguggagcacuagcaggaggaagacggagacuggucacccaaguccagggaagaggccaaaggcacacacuggagcuucaggucccaaaccucaauccuugguccucuaccacuggagcugccacugggcacuucagaacagggacacugcccaucuugaggugggcacaaaggcauguuucuaggugaggguggcagcugcagcuugaucggaugguccugagagagcagcagggcccagcauccgggggaagggagggcaggcugcagaggagcccuacaggaggcccuggccagcuuugcacagcccgggcauggccccgggcccaaaagucacuucuccguggucugagaaaccugcugaggcagcccuccccacguggugacccaugagacuguugcagccggcgccugccccucaggaggacagugccgggccagggcccccagucgcccuccuccugccgggugcagcguccucagcccugcuccaggcugucgccgggcugcaccacgguguagcuccccuggcccaaggacagcugccggcugaagaaggauguggugcgcuucggcuucacucgccugauccccuugccugcgagggaaugggagggcacacugagcagaggcgcugucccugugugagggggcucaggcccaggaagccagguucuggcuccagcgcgacggcuccuuccagagccuggucagacugagcuccccucauccgagc

SEQ ID NO: 18686 - RNA, 4142 nt, Homo sapiens
ccugccaccucucuaguuuaaaccacccuucucugucccuggacaccugcgcagaaagccuaggagcugguuccacccaucacucaccagguuagguauuucaggcaagucacacccucucaggccucaguuuuccucuuuuguuaacugagggugaaagugggguuagauuagaucagcggcucuuaacuuuugaggggucgugggcccuagaguccugggaacgcuaugcaguuuccucagcaaaaugcuugcauccacaacaugcaagacugcagcagcugcugggcuggggcugcgagaccagcgaaaagcccugacuugggggggucucgggagucucugcagucuccccacccacacccccggccuccgcgccgaauccuggccccccaacuucuugcagcccgugaagcaggaucucaggguccuggggguggggagagggggcugccguccugcucgcagccucugccgcccucuccuggguaaggugacacaugggcgcuuccaggugggugggcugagagccugggggagagaacagggauguccaccucucuaaguuuccagguucaagaaaccccagaacguuagagaaagaugggcucccacaauugcccaaccccaucccauaggaugcacgcaugcggaaagucgggccgaacggggcagggacuuacccaaggucacgcagcgagcccggucccccugcguuccccggggagcgcugagccgggacgcggcggugggguggggaaggggaguggcgcggcccugcggggugaggcugccguuugcugaguguccggcaggggucugcucgcugccagcccggccccuccucagagcagcugccgcagcccgagguaaucucggccccgcgccggggcuggcugggaacggcgggagcagcugcggucgcgcggagcgaggggagcuggggaccgggcgggcccggggcugcgggaggcggcgccgccgcacaaucgccccggaaugcccgccagggcgcgcguggggugcggccguccggcccugcaacucgagcugcugccccugguuaaaaauacccccugcccggcccucccccuccguuccccgcggugcccuuccgccgcgccccagcccccccauccccccccgcgcuggccccuccccggggacugcucugccuuuuacuaauuuguccucucgcggaauuggcccccggccugcggagggaggggcggggagacaccgugaguaagagauagucagagaccgugccggagagauaagggagagccgagaggaagcgggguaggagccccaggaggaggaggaggagaaggagagagggagggcggagggcggaggggcggcgggaggagggcggggaggagcgcucuuccugguugggcccugcccugagcugccaccgggaagccagccucagggacugcagcgacccccaaacaccccucccccagguaagaagcuggguagccgagccgggauuccuugacccuggccacugcuccugggcugaggggcugccccagcacggucccuucucgggggccucugcguuccuggagcaggggugggggcuggcggagcggcacagcccaggcgccugucccagccuggcucaccgcuguccccaggggcugggcuagggcccaccagcucugauaucgagccugcugcgggggccugaggagggggaccccgaccgucugggguuuucagcccacggcaaggggccggugcaccaggagcuugguuaguuuggggaggggguugcaggccugugaacaggaucaaagaggccuucccugcugugucccaccugcccaguuccuugugcugucuggaggcuccgcccugccccaccugaccugcuggcucacuacagagcugcaagccccugacaaugggauccgggaaaggagagguggccggcacgccugggaacugggaaaucccuuuccuggauucacugggagcaccgggagguggcugagaacccuacuucugugaggggagcagugaggcagggaaacccuagguuuggggauggauaagcaggggcaggagagcagagcuugcaggcaggagcccagguucuagucuugggaaggccuggguucugagcaggcccaucuguccggcaggaugucggaggagaucaucacgccgguguacugcacuggggugucagcccaagugcagaagcagcgggccagggagcugggccugggccgccaugagaaugccaucaaguaccugggccaggauuaugagcagcugcgggugcgaugccugcagagugggacccucuuccgugaugaggccuuccccccgguaccccagagccuggguuacaaggaccugggucccaauuccuccaagaccuauggcaucaaguggaagcgucccacggugagaggggccauccugggugggacucggcuaagccagauccuggaugaggaguagggaugggacuccaugucccugguggggaauggggucugggguggccuggugccaauuucugggaggggcuggccgaggaacaggacucugggucucucguaggaacugcugucaaacccccaguucauuguggauggagcuacccgcacagacaucugccagggagcacuggguaggcccccagggcgucgggucccggguauuuuuuccacaguaguuccccauucccgcuccuucaggcucugccccaaccccucccucuugcaagcccaggcaggaucuggcuaucagcgcuggggcugguuugcccagauuccugggucuuuucugcaagcugaggggaguuaaguggcacccuggccaaggaaccccagauucucccuagcacccgcuuccccccccggggcagguugguagagcaggcuaaugugcaucccuccugccccaggggacugcuggcucuuggcggccaucgccucccucacucucaacgacacccuccugcaccgagugguuccgcacggccagagcuuccagaauggcuaugccggcaucuuccauuuccaggugagggcuccccuggggaggaggggcagcaggcacugggggagaugcggaaggaugacccacaauaccugcaguuagggccacacccuguggggccagcccucccucuagcagguauuugaccucucagugccaucucgggucugucaugugugaagugacugggcugggcagguauuucggcuggcaguuuuccuaggugguuguauguaucagguggaaagugcuugaaagaacagaaagacuuuuguguuauauccugugggacaaauuccacuccucccggaggucggucucaguugccccaucugagaaaggaguguucgcuggggaaaacagaucagcacguguggccuucuccacgugucaagccuccuaucccccaacuccuccugcgcuuuggcaaggucugacugagcccagcagaaaagaaagacucgggauuaagucuacguaaaccagcuuuuccugacggugugcccagggcccauuuuucaagucacaccaaucaauucucaaugagcugccuuugggagggacaugcccagcaacccuggaugagacucuccagccuuggaggccccagcccugcccgaaggacucuuggguguucccuccuucugccugguuagagagccccuuacccuacucuguccuugcccgccuugcgcggguggagguggcccucggaacccagggugcggaacccacagugcggauccacuuuggcccagcgccacacccaccugcuccagucugcaggggcgcagucucgcccccuucccucgcuccuccaauccgcuccucccuggccuccgauuggccaguucaguacccgccacccacacucuccgcaaccugggcuccuagggccgccuccaccccgccccgccccccguuguccuggccccgaccccucagaugguaccucgaguccuuggucgcuucugaccccagacgccuucggccccgacccugcccugggaaacguggccuuuguggcaucucagaaacaaagcccgugauugugagaaccaguccugcccaucuugugguuguaggaucuggaugccacauuuucacugcucauc

SEQ ID NO: 18687 - RNA, 9381 nt, Homo sapiens
ucuuauugggccgcguaacuuaucgcaaccaaucaguggcagccacgggacccaacucacucccacacaacuugugggggugaucauggagaagacaaauuuuuguuuuccgcauccaguucucucagagagcaccguauuugucaaacuguugugacucucccuaaauguuuaagaaaacauuucauuccccucaggcuuguauagucugucccuggccuacuccccgcuccaggugguacagcccgcaagcggcuccccuucccagcugcucgcggggccgagucccccaguccgaggaggccacucagcgcaggagccauaccaucugugacuaauaaauaauagggggaccuccgacuccccccuguugccuuauuaccuuccgaccaccucucggaccucuugcccagcccuuccccguagacaucaccccagauacgguggugacaccauugcuaugggcccacguagggcgcagugcgagccagggcaggacgcacuugguacgacccacgccgcgccccgcgccgccggaagugaggugucugacccccgaaguuccgguucgcaggggguggggaguguuguuaaccggaggggcagccgcagucgcgcggauugagcgggcucgcggcgcuggguuccuggugaguggggcgaagucuggcccgaguugugguuggggucgggacccgaaccuuccccuugaggucuccggagucggcacgccccucagccccgccgcacgcuuucggccugucagcuggccggagaccucagacgccggugcggccgcuuugcucaagccugggcccugccugcgacgcccgcaacuccuggugcucacaggugcgcggccgcgagggcgacccggcuccucccgucccgcugcugcucucucccgucccgcuguuuuuguggugcucugaguugacacuacuccgggggucgggggaccccaggauuccaggcugacguuccccgcccgcucccgcagggcgggcguccgaacugcccacccuaacacagcugucaccggcgcugucgccugcccagccugcuauccucugugccuuggcugcucucagcccuggcugcgcauucccgccccuggagcagauuucugcuguugccucccaccccaucuucuccaccggagggucagcggugcagcucccccuccuccaacauugcagcuuuuccucaucaccucccuagaggaggcggcuuggcaggcagcguggaaagagcccuagauuugaagcaagacugacccagguuccaggccuugcgucagugugaucacuuaaccccuucgagucuaauuuguaaaaugggguagcguaagcuauucuuugucugaugauuucgagggcgaaaugugauuucccccccacuuucuccuaugaauugaggcugugccaggcaccgggcuauuuugcacagcacgagcaucacauaaguuauuuucuugccccaugcaggucuccgggccagggcaauguuccgcacggcagugaugauggcggccagccuggcgcugaccggggcugugguggcucacgccuacuaccucaaacaccaguucuaccccacugugguguaccugaccaaguccagccccagcauggcagugaguucagggcucagggagggaggaacucccugggagggaaggaggagucugccugggcaaggggcggggcuagaggucagguaaguagggaaguagccgccagcugccuaacuuugaauaaacugugaugaggauguggaggauccugcaugaugagucccaaggagaggaaagcagaaagugaccucaaaccacagccucuccccacuccuagguccuguacauccaggccuuuguccuugucuuccuucugggcaaggugaugggcaagguguucuuugggcaacugagggcagcagagauggagguaagaugucggcugccccaaaggugagggcagggugcugggaaagaauguuugguauccacauuauucccugccuggcccccagcaccuucuggaacguuccugguacgccgucacagagacuugucuggccuucaccguuuuucgggaugacuucagcccccgcuuuguugcacucuucacucuucuucucuuccucaaauguuuccacuggcuggcugaggaccguguggacuuugugagucaaggcagggaguucuggagcagguggaagccagggaguagccagcgggcaggcuuaaggagcagggagggcuagguugaggguguggggugagccccaggccuccugacaggccucuucugugcucugccucagauggaacgcagccccaacaucuccuggcucuuucacugccgcauugucugugagugagauucaggggaggggaagggaggacuggaacgugaaccguggaccuguacuccagagcacaggcuaccccccacagcuguacaggaaagauaauuuaggaaguuaauuugcauagucucugugcuguuccacucuagggcuucucaacugccugggcccucagcccuuugccuucucaccugcagccugggcagccccaacaacucccccucccccaggaaguucccagagggccagguucaguggagugugcccaccugacuagaucgcuggggccauggugggcuugaggguggggcuguccuagagcauuaaacagcuguugggcccugggcugacccccccacccugcauguguggggguccccacagcucuuauguuccuccugggcauccuggacuuccucuucgucagccacgccuaucacagcauccugacccguggggccucugugcagcugguguuuggcuuugagguaaaacuggcuugggagguugagaggacaagcccgaggugaccccacaugugccuugaauaacccaacagacccuuccucagcaccugcuauguggccaaccugugcuggccaccaaggggcagugaucagauauggcuccugcccuccacacgcucacuccuaggugacuggggagacgcacaaagaggcuaggacagaggaggagccccaaccuggggcucaggagaggguuccuggaggcucgugccggagcuagcugguaauggacaggagaggauuaguuccauggacaacuggaggcgugucccuggcagagagagaauguguucagugacaacagcucauauuuguugagugcgaauuucacaccaggcccuaugcugagcuccugaccugcaucucuuauucagcaagacaauacuguuauaaaggaacaguuaauuaugucauuuuauagauaaguaaacugagguucacugaguugccaaaagucacagcuaguaaguggaggggcuaggaggacccugggugugucuagagccugugauuguaccacugcaccugcugugcagaggccuuggggagcaaugugggugcagcaagggggagcuauguguuuacaucccccucgucccccucucccuucaguaugccauccugaugacgauggugcucaccaucuucaucaaguaugugcugcacuccguggaccuccagagugagaaccccugggacaacaaggcuguguacaugcucuacacagagcuguuuacaggugagaggggccugggccucuccugaucuggaccagcauccuccacucugccuccuggcccugugaccugcugcuuucugcauccccuccccucaggcuucaucaagguucugcuguacauggccuucaugaccaucaugaucaaggugcacaccuucccacucuuugccauccggcccauguaccuggccaugaggugagcccggcccugucccccgauccuccugaccugaucccgucccuucuccugcuuucacugacuguccuuucagacaguucaagaaagcugugacagaugccaucaugucucgccgagccauccgcaacaugaacacccuguaaguaggcuugucauggcugcugucccaagcucgguccugggucccucugcuuccagcucuggaccugauacagccccugucauccuaaccagguauccagaugccaccccagaggagcuccaggcaauggacaaugucugcaucaucugccgagaagagauggugacuggugccaagagacugcccugcaaccacauuuuccauaccaggugggaggggcccuggggagccugcacagcaggcacaggccccagaaggcaggccccuagggaccugcugaccucugccuggccuugacccgcagcugccugcgcuccugguuccagcggcagcagaccugccccaccugccguauggauguccuucgugcaucgcugccagcgcagucaccaccacccccggagccugcggaucaggggccacccccugccccccaccccccaccacucuugccucagccccccaacugugaguauccccuugucuggccacccggcauaccacuggauacuugcccugggcuggauguggaagaugcugggaaauuggagagucccugcccuccagaaucucagucugggccagggagggauuaaaagaugagaaauagaugcuugcagucagugugaccagugcugggcugagggccugugggaauaggacagagcucucaauagccaggcccccugccugggaguugggucuguguccauuuggcccuuuccuuaccuccgucuucucucugcagucccccagggccuccugccuccuuuuccuccaggcauguucccacuguggccccccaugggccccuuuccaccugucccgccuccccccagcucaggagaggcuguggcuccuccauccaccagugcaggugagccuuuggguacugugacagccagggggcggcagggauggaacacucacugacuucguuccugcucuucagcagcccuuucucggcccaguggagcagcuacaaccacagcugcuggcaccagugcuacugcugcuucugccacagcaucuggcccaggcucuggcucugccccagaggcuggcccugccccugguuuccccuucccuccucccuggauggguaugccccugccuccacccuuugguaagcugggccacucucuggguucuucuugggggugagguuggugucuggccccagcagcccagacugagccucucucucuccagccuuccccccaaugccugugcccccugcgggcuuugcugggcugaccccagaggagcuacgagcucuggagggccaugagcggcagcaccuggaggcccggcugcagagccugcguaacauccacacacugcuggacgccgccaugcugcagaucaaccaguaccucaccgugcuggccuccuuggggugugucuguacaggggaagcagaguggguuuggugggucaggaguggagcugccaagagguccccagcagugguucuuggccuuugacaccugccaauucaggcugccuaucuacaggcccaccaagggucuccaggaguucuugguaacuccuggugccuuuauuucccacuccagaaagcaugucuggaucuaaguaggagugauguuuauucgagagcugacuuuagaucuuauuccuuuauauuuuucuaaagucaaauuauucagaauuugcagugcuuuaguucaucacaugauauucuucugagauguggugacacuuagauuggcaauugcugcccccaaacugagggagcgaauaauaggaagucacuuggagccauccuggcucaaguucaagcgcuggucccaucacucauuuuugaccucucauuauuugaauaaaggggucuuaauucauauucauaagugauguguacugccagauacacaccuauaaucagcacuuuggaaggcugaggcaggaggauuguuugagccuaggaauuugagggugcagugagcuaugauugugccacuaaauuccagcuuuggugacagagccgagacgcugucuuuuaaaaaagugacauguacauaaugccuggcaucuagcagugacagcacaggcuuggagaggaacuugaguccaaggcucgagcacuguggcuuauugagugaguccccuauaaggugccugacuccccaggguggagacugcaggguaagagugaacaggucaacagucccugccugcaagcaccuuacagcuaagggauagaaucauuuggcccuugaguccagucacccugucugaguucauucagcauguucacuuguguuugccaggcacuggggccacaagggcacaucauucuauacucuguucugcaaggcucaccaagggcaggagaaucugcccaaccuuggaugccaaggccaggcccgccucucgucccuucucuucccaggcccccccggccugccacuucagucaacuccacugaggagacugccacuacaguuguugcugcugccuccuccaccagcaucccuagcucagaggccacgaccccaaccccaggagccuccccaccagccccugaaauggaaaggccuccagguaggugugauuggccuccagccgggggagcagggaacuucucuagguuccacuuccagucucucuguccccagcuccugagucagugggcacagaggagaugccugaggauggagagcccgaugcagcagagcuccgccggcgccgccugcagaagcuggagucuccuguugcccacugacacugccccagcccagccccagccucugcucuuuugagcagcccucgcuggaacauguccugccaccaagugccagcucccucucugucugcaccagggaguaguacccccagcucugagaaagaggcggcauccccuaggccaaguggaaagaggcugggguucccauuugacuccagucccaggcagccauggggaucucgggucaguuccagccuuccucuccaacucuucagcccuguguucugcuggggccaugaaggcagaagguuuagccucugagaagcccucuucuucccccaccccuuuccaggagaaggggcugccccuccaagcccuacuuguaugugcggagucacacugcagugccgaacaguauuagcucccguucccaaguguggacuccagaggggcuggaggcaagcuaugaacuugcucgcuggcccaccccuaagacugguacccauuuccuuuucuuacccugaucuccccagaagccucuuguggugguggcugugcccccuaugcccuguggcauuucugcgucuuacuggcaaccacacaacucagggaaaggaaugccugggagugggggugcaggcgggcagcacugagggacccugccccgccccuccccccaggccccuuuccucugcagcuucucaagugagacugaccugucucacccagcagccacugcccagccgcacuccaggcaagggccagugcgccugcuccugaccacugcaaucccagcgcccaaggaaggccacuucucaacuggcagaacuucugaaguuuagaauuggaauuacuuccuuacuagugucuuuuggcuuaaauuuugucuuuugaaguugaaugcuuaaucccgggaaagaggaacaggagugccagacuccuggucuuuccaguuuagaaaaggcucugugccaaggagggaccacaggagcugggaccugccugccccugucuuuuccccuugguuuuguguuacaagaguuguuggagacaguuucagaugauuauuuaauuuguaaauauuguacaaauuuuaauagcuuaaauuguauauacagccaaauaaaaacuugcauuaacaauuggugggguuugugucacagaaucgaucaaaucagugucgggcuccuugcuguggcuguacacuugaaaauggaauggaaucuccaggagugaggguuuccauggaagccagcacuauccuuggggacaccacugaccauuaacagauuaggaagaugugcccauuuuacacacagagaagcagcccagaguucagugcccugcuucagggcagagaccaaguuggggagucaggaacugaaagcugucuuagccaguuugggggcaggguggggucucaggccuuuggccccugugacuccaaguauaaggcauauaugaaggcuagugagcugggguugggaugggauggcagggugaaaggucagcauauuccugccugcaaaccccuccccagccuugauugcaggucagaaggcugcagggggaugucccuaugcuggcugugaguucccagccacucccuuguggucaggccagcaagucuggucugcaauggaacagugaccaagaacgugccuccuaccucucuaucagagcccggggcuaacgugggcacucugugccccagugccagcacuguacuuugaacagaagaucuccaagacccaugcccgagucaucuguguucuccaucaccugcaccaaacaagaucuggccuagagcaaaggcuuggggguauuugcaacagugagcuucggagggccaaggaaacaaagugcccaguggcucugcccugugcuaccuuccccuaaacugggguugggcuacugcuuccaccaaauaacaacuagaauuugaauugcugagcccaaggaaagaaaaacaaaacaggccaagguggaccaggcacauggcucaugccuauaaucccaacgcuuugggaggccaaggugggcggaucacuucgagucaggaguuugagaccagccuggccaacauggugaaaccccaucucuacuaaaaauacaaaaauuagcaggcugugguggugggcgccuguaaucccagcuacucaagaggcugaggcaggagaaucccuugaucccagagguggaaguugcagugagccaagaucaugccacugcacuccacccugggcaacagagugagacuccgucucaaaaaacaaaaaagaacaggccaagauaggagggagagaaagcugcugacgccccccauuagccuggugaucccuauuuggucucccacauuaggcacucucccccagcauguacauagaguuguuuucuccuuuaugcaagcaaggccugaccccaaaguccuuuagcccuaguuucuguauccccugucucaggggcuccaacacccaccucccuccuccugaggcccccuagacuugauccacagggcaugcugacaagcaggcugcucggcugggccucagaagccuuucuccaagagccaggcuuuaagcuccuggucaaaguagcccuugauccguaggguaccugucaccucauugaccugggugacaggugucuuccccagcagcgggcucagaaaaucuuccacgucuuucugcagggccu

SEQ ID NO: 18688 - RNA, 9381 nt, Homo sapiens
aggcccugcagaaagacguggaagauuuucugagcccgcugcuggggaagacaccugucacccaggucaaugaggugacagguacccuacggaucaagggcuacuuugaccaggagcuuaaagccuggcucuuggagaaaggcuucugaggcccagccgagcagccugcuugucagcaugcccuguggaucaagucuagggggccucaggaggagggagguggguguuggagccccugagacaggggauacagaaacuagggcuaaaggacuuuggggucaggccuugcuugcauaaaggagaaaacaacucuauguacaugcugggggagagugccuaaugugggagaccaaauagggaucaccaggcuaauggggggcgucagcagcuuucucucccuccuaucuuggccuguucuuuuuuguuuuuugagacggagucucacucuguugcccaggguggagugcaguggcaugaucuuggcucacugcaacuuccaccucugggaucaagggauucuccugccucagccucuugaguagcugggauuacaggcgcccaccaccacagccugcuaauuuuuguauuuuuaguagagaugggguuucaccauguuggccaggcuggucucaaacuccugacucgaagugauccgcccaccuuggccucccaaagcguugggauuauaggcaugagccaugugccugguccaccuuggccuguuuuguuuuucuuuccuugggcucagcaauucaaauucuaguuguuauuugguggaagcaguagcccaaccccaguuuaggggaagguagcacagggcagagccacugggcacuuuguuuccuuggcccuccgaagcucacuguugcaaauacccccaagccuuugcucuaggccagaucuuguuuggugcaggugauggagaacacagaugacucgggcaugggucuuggagaucuucuguucaaaguacagugcuggcacuggggcacagagugcccacguuagccccgggcucugauagagagguaggaggcacguucuuggucacuguuccauugcagaccagacuugcuggccugaccacaagggaguggcugggaacucacagccagcauagggacaucccccugcagccuucugaccugcaaucaaggcuggggagggguuugcaggcaggaauaugcugaccuuucacccugccaucccaucccaaccccagcucacuagccuucauauaugccuuauacuuggagucacaggggccaaaggccugagaccccacccugcccccaaacuggcuaagacagcuuucaguuccugacuccccaacuuggucucugcccugaagcagggcacugaacucugggcugcuucucuguguguaaaaugggcacaucuuccuaaucuguuaauggucagugguguccccaaggauagugcuggcuuccauggaaacccucacuccuggagauuccauuccauuuucaaguguacagccacagcaaggagcccgacacugauuugaucgauucugugacacaaaccccaccaauuguuaaugcaaguuuuuauuuggcuguauauacaauuuaagcuauuaaaauuuguacaauauuuacaaauuaaauaaucaucugaaacugucuccaacaacucuuguaacacaaaaccaaggggaaaagacaggggcaggcaggucccagcuccuguggucccuccuuggcacagagccuuuucuaaacuggaaagaccaggagucuggcacuccuguuccucuuucccgggauuaagcauucaacuucaaaagacaaaauuuaagccaaaagacacuaguaaggaaguaauuccaauucuaaacuucagaaguucugccaguugagaaguggccuuccuugggcgcugggauugcaguggucaggagcaggcgcacuggcccuugccuggagugcggcugggcaguggcugcugggugagacaggucagucucacuugagaagcugcagaggaaaggggccuggggggaggggcggggcagggucccucagugcugcccgccugcacccccacucccaggcauuccuuucccugaguugugugguugccaguaagacgcagaaaugccacagggcauagggggcacagccaccaccacaagaggcuucuggggagaucaggguaagaaaaggaaauggguaccagucuuaggggugggccagcgagcaaguucauagcuugccuccagccccucuggaguccacacuugggaacgggagcuaauacuguucggcacugcagugugacuccgcacauacaaguagggcuuggaggggcagccccuucuccuggaaaggggugggggaagaagagggcuucucagaggcuaaaccuucugccuucauggccccagcagaacacagggcugaagaguuggagaggaaggcuggaacugacccgagauccccauggcugccugggacuggagucaaaugggaaccccagccucuuuccacuuggccuaggggaugccgccucuuucucagagcuggggguacuacucccuggugcagacagagagggagcuggcacuugguggcaggacauguuccagcgagggcugcucaaaagagcagaggcuggggcugggcuggggcagugucagugggcaacaggagacuccagcuucugcaggcggcgccggcggagcucugcugcaucgggcucuccauccucaggcaucuccucugugcccacugacucaggagcuggggacagagagacuggaaguggaaccuagagaaguucccugcucccccggcuggaggccaaucacaccuaccuggaggccuuuccauuucaggggcugguggggaggcuccugggguuggggucguggccucugagcuagggaugcugguggaggaggcagcagcaacaacuguaguggcagucuccucaguggaguugacugaaguggcaggccgggggggccugggaagagaagggacgagaggcgggccuggccuuggcauccaagguugggcagauucuccugcccuuggugagccuugcagaacagaguauagaaugaugugcccuuguggccccagugccuggcaaacacaagugaacaugcugaaugaacucagacagggugacuggacucaagggccaaaugauucuaucccuuagcuguaaggugcuugcaggcagggacuguugaccuguucacucuuacccugcagucuccacccuggggagucaggcaccuuauaggggacucacucaauaagccacagugcucgagccuuggacucaaguuccucuccaagccugugcugucacugcuagaugccaggcauuauguacaugucacuuuuuuaaaagacagcgucucggcucugucaccaaagcuggaauuuaguggcacaaucauagcucacugcacccucaaauuccuaggcucaaacaauccuccugccucagccuuccaaagugcugauuauagguguguaucuggcaguacacaucacuuaugaauaugaauuaagaccccuuuauucaaauaaugagaggucaaaaaugagugaugggaccagcgcuugaacuugagccaggauggcuccaagugacuuccuauuauucgcucccucaguuugggggcagcaauugccaaucuaagugucaccacaucucagaagaauaucaugugaugaacuaaagcacugcaaauucugaauaauuugacuuuagaaaaauauaaaggaauaagaucuaaagucagcucucgaauaaacaucacuccuacuuagauccagacaugcuuucuggagugggaaauaaaggcaccaggaguuaccaagaacuccuggagacccuuggugggccuguagauaggcagccugaauuggcaggugucaaaggccaagaaccacugcuggggaccucuuggcagcuccacuccugacccaccaaacccacucugcuuccccuguacagacacaccccaaggaggccagcacggugagguacugguugaucugcagcauggcggcguccagcaguguguggauguuacgcaggcucugcagccgggccuccaggugcugccgcucauggcccuccagagcucguagcuccucuggggucagcccagcaaagcccgcagggggcacaggcauuggggggaaggcuggagagagagaggcucagucugggcugcuggggccagacaccaaccucacccccaagaagaacccagagaguggcccagcuuaccaaaggguggaggcaggggcauacccauccagggaggagggaaggggaaaccaggggcagggccagccucuggggcagagccagagccugggccagaugcuguggcagaagcagcaguagcacuggugccagcagcugugguuguagcugcuccacugggccgagaaagggcugcugaagagcaggaacgaagucagugaguguuccaucccugccgcccccuggcugucacaguacccaaaggcucaccugcacugguggauggaggagccacagccucuccugagcuggggggaggcgggacagguggaaaggggcccauggggggccacagugggaacaugccuggaggaaaaggaggcaggaggcccugggggacugcagagagaagacggagguaaggaaagggccaaauggacacagacccaacucccaggcagggggccuggcuauugagagcucuguccuauucccacaggcccucagcccagcacuggucacacugacugcaagcaucuauuucucaucuuuuaaucccucccuggcccagacugagauucuggagggcagggacucuccaauuucccagcaucuuccacauccagcccagggcaaguauccagugguaugccggguggccagacaaggggauacucacaguuggggggcugaggcaagaguggugggggguggggggcaggggguggccccugauccgcaggcuccgggggugguggugacugcgcuggcagcgaugcacgaaggacauccauacggcagguggggcaggucugcugccgcuggaaccaggagcgcaggcagcugcgggucaaggccaggcagaggucagcaggucccuaggggccugccuucuggggccugugccugcugugcaggcuccccagggccccucccaccugguauggaaaaugugguugcagggcagucucuuggcaccagucaccaucucuucucggcagaugaugcagacauuguccauugccuggagcuccucugggguggcaucuggauaccugguuaggaugacaggggcuguaucagguccagagcuggaagcagagggacccaggaccgagcuugggacagcagccaugacaagccuacuuacaggguguucauguugcggauggcucggcgagacaugauggcaucugucacagcuuucuugaacugucugaaaggacagucagugaaagcaggagaagggacgggaucaggucaggaggaucgggggacagggccgggcucaccucauggccagguacaugggccggauggcaaagagugggaaggugugcaccuugaucaugauggucaugaaggccauguacagcagaaccuugaugaagccugaggggaggggaugcagaaagcagcaggucacagggccaggaggcagaguggaggaugcugguccagaucaggagaggcccaggccccucucaccuguaaacagcucuguguagagcauguacacagccuuguugucccagggguucucacucuggagguccacggagugcagcacauacuugaugaagauggugagcaccaucgucaucaggauggcauacugaagggagagggggacgagggggauguaaacacauagcucccccuugcugcacccacauugcuccccaaggccucugcacagcaggugcagugguacaaucacaggcucuagacacacccaggguccuccuagccccuccacuuacuagcugugacuuuuggcaacucagugaaccucaguuuacuuaucuauaaaaugacauaauuaacuguuccuuuauaacaguauugucuugcugaauaagagaugcaggucaggagcucagcauagggccuggugugaaauucgcacucaacaaauaugagcuguugucacugaacacauucucucucugccagggacacgccuccaguuguccauggaacuaauccucuccuguccauuaccagcuagcuccggcacgagccuccaggaacccucuccugagccccagguuggggcuccuccucuguccuagccucuuugugcgucuccccagucaccuaggagugagcguguggagggcaggagccauaucugaucacugccccuugguggccagcacagguuggccacauagcaggugcugaggaagggucuguuggguuauucaaggcacauguggggucaccucgggcuuguccucucaaccucccaagccaguuuuaccucaaagccaaacaccagcugcacagaggccccacgggucaggaugcugugauaggcguggcugacgaagaggaaguccaggaugcccaggaggaacauaagagcuguggggacccccacacaugcagggugggggggucagcccagggcccaacagcuguuuaaugcucuaggacagccccacccucaagcccaccauggccccagcgaucuagucaggugggcacacuccacugaaccuggcccucugggaacuuccugggggagggggaguuguuggggcugcccaggcugcaggugagaaggcaaagggcugagggcccaggcaguugagaagcccuagaguggaacagcacagagacuaugcaaauuaacuuccuaaauuaucuuuccuguacagcugugggggguagccugugcucuggaguacagguccacgguucacguuccaguccucccuuccccuccccugaaucucacucacagacaaugcggcagugaaagagccaggagauguuggggcugcguuccaucugaggcagagcacagaagaggccugucaggaggccuggggcucaccccacacccucaaccuagcccucccugcuccuuaagccugcccgcuggcuacucccuggcuuccaccugcuccagaacucccugccuugacucacaaaguccacacgguccucagccagccaguggaaacauuugaggaagagaagaagagugaagagugcaacaaagcgggggcugaagucaucccgaaaaacggugaaggccagacaagucucugugacggcguaccaggaacguuccagaaggugcugggggccaggcagggaauaauguggauaccaaacauucuuucccagcacccugcccucaccuuuggggcagccgacaucuuaccuccaucucugcugcccucaguugcccaaagaacaccuugcccaucaccuugcccagaaggaagacaaggacaaaggccuggauguacaggaccuaggaguggggagaggcugugguuugaggucacuuucugcuuuccucuccuugggacucaucaugcaggauccuccacauccucaucacaguuuauucaaaguuaggcagcuggcggcuacuucccuacuuaccugaccucuagccccgccccuugcccaggcagacuccuccuucccucccagggaguuccucccucccugagcccugaacucacugccaugcuggggcuggacuuggucagguacaccacagugggguagaacugguguuugagguaguaggcgugagccaccacagccccggucagcgccaggcuggccgccaucaucacugccgugcggaacauugcccuggcccggagaccugcauggggcaagaaaauaacuuaugugaugcucgugcugugcaaaauagcccggugccuggcacagccucaauucauaggagaaagugggggggaaaucacauuucgcccucgaaaucaucagacaaagaauagcuuacgcuaccccauuuuacaaauuagacucgaagggguuaagugaucacacugacgcaaggccuggaaccugggucagucuugcuucaaaucuagggcucuuuccacgcugccugccaagccgccuccucuagggaggugaugaggaaaagcugcaauguuggaggagggggagcugcaccgcugacccuccgguggagaagauggggugggaggcaacagcagaaaucugcuccaggggcgggaaugcgcagccagggcugagagcagccaaggcacagaggauagcaggcugggcaggcgacagcgccggugacagcuguguuagggugggcaguucggacgcccgcccugcgggagcgggcggggaacgucagccuggaauccuggggucccccgacccccggaguagugucaacucagagcaccacaaaaacagcgggacgggagagagcagcagcgggacgggaggagccgggucgcccucgcggccgcgcaccugugagcaccaggaguugcgggcgucgcaggcagggcccaggcuugagcaaagcggccgcaccggcgucugaggucuccggccagcugacaggccgaaagcgugcggcggggcugaggggcgugccgacuccggagaccucaaggggaagguucgggucccgaccccaaccacaacucgggccagacuucgccccacucaccaggaacccagcgccgcgagcccgcucaauccgcgcgacugcggcugccccuccgguuaacaacacuccccacccccugcgaaccggaacuucgggggucagacaccucacuuccggcggcgcggggcgcggcgugggucguaccaagugcguccugcccuggcucgcacugcgcccuacgugggcccauagcaauggugucaccaccguaucuggggugaugucuacggggaagggcugggcaagagguccgagagguggucggaagguaauaaggcaacaggggggagucggaggucccccuauuauuuauuagucacagaugguauggcuccugcgcugaguggccuccucggacugggggacucggccccgcgagcagcugggaaggggagccgcuugcgggcuguaccaccuggagcggggaguaggccagggacagacuauacaagccugaggggaaugaaauguuuucuuaaacauuuagggagagucacaacaguuugacaaauacggugcucucugagagaacuggaugcggaaaacaaaaauuugucuucuccaugaucacccccacaaguugugugggagugaguugggucccguggcugccacugauugguugcgauaaguuacgcggcccaauaaga

SEQ ID NO: 18689 - RNA, 1620 nt, Homo sapiens
aaugcgaugacugaacuaaguggcuuuuuuauuagagaaagccagaauuacaaaagacuuaagaguuggcauuggggcccuucuucuugccaaaggugggcacaacguugacaaagcgccgguuguacugcauccgccgcuuagcccgaccugucuucuucuucuucuucuccuguuuggccaccuggagaagggaagguuaaucaggcccugguuccugucuuccacaccuagcaucccuucccucaggcucaucuccagggagggagaaggcaaaccgaguaagagcccagggacuugguuuagcugugaaaggaaaaaaaguccuaacaccaugaccacuaauacucucacucaccuuaggagucugaccucucacuuuuccagcacgggccagggaaccauggacuuuaccuguagugggaaaggaaggcaccagcagguaagagcaagaaggugccacccagcagaaccccucuuuucucaauucaagccuuuaaagagaagcugcgcccaauagguaaugagaacaaaguugcagauauuugaccuugaaaucuuaaguuucauuucaggaucuuccagcuucuaauuuuauagagcacuuugggggcccuggucugaccuaauuuuaguguggaagcugauaaccagacuaggaucucgugaugugacugaaauacaacuacacucuggcucagucucccauggacgucuguguucaacaugagggauguaaacaggaagaaucacucugaacugaagacagugagaaguacucuauuaccauaggugugacacucagcugucaggacuaugcaccccacacucacuagacgcuuaccgguacuucaaagaacauuccucucucacucaccuccaagcaugcggccugcuacuuccaggguagucagggccuccaccccgcacuggcccagaguggccucauccuccaggggcgcgccugccaggagcacgacuugaucuuccggggcaaugcccuccagugaggcuacaugagccuacagggaaagauaaggcucguaagcguucccucgggccgcgagagugaagagcacaagaaaauggaacccagggcgcaccaagcagccuuaccuugaucugggcgaccguuuccuggccggucaccucgaagguguguagcuccugggcgcggacaaagagcugcauauuggcgacugaguaaagaaaagacggcuuguaagagaagccaagaaaugcucugggauaaaggagauuugggaguggaaagcgguccagaaacgaucgcgacgggaugguggucgcggcggcucacguggggaaggccaggccucccaaggaguucggauagggacuggagcagggccacggagcaggccccguucuucgguuccccccgcgccuucugaccccgcagccaaccugcuacaagcccuucggauccagccaaggccccauucuuaccugaacggcggucccagcuaccgcgaagauggagucgagaaagaggaagaagcgagggcgcgucaguacagaccgugggcugcgugucacgucacugcugagcgaccgcgcgguucccugcuauuuguaccgcccaaggcaguccuagcuccg

SEQ ID NO: 18690 - RNA, 32067 nt, Homo sapiens
gcgccgcacccggaagagacguggcagcggagggauaaucggggcggccggggcugaagggagaggcgcaggagcccuggggagaguggucccugcccuuccgcgccucgagccaucgcuaccgcccuucggaaccagugcagcggccgaucaguaaacacagagacuggggucuguagagaaggggcgggacuuggaggggguggggcucaggagaggucuugggggcggggccgguaguaucggggagccucugauggaggggccuggccgggggcgggauccagaaggauugaggggucgccggaggcgggauuuaugcaggggguguuucuccgcauaaggagggacagugggcaggaaucugagaucggggcgaauaugagaggugucugggggaguuaagaguggaaacugggcuggugagagcguagugguggccaccagaaccugacuuccuaccaacucaugccccuuucccaggaucgaucauggggcuuuguaagugccccaagagaaaggugaccaaccuguucugcuucgaacaucgggucaacgucugcgagcacugccugguagccaaucacgccaagguggggccuucaggggagcgacugagcagggcacugggugggcaaggcgguauuggcuuccuccaaauccaugaggggccccgcgcuagaauguaagccccacaagggcaaggacuugauuuauuuuguucacugauauaucccccguucccaagagagagucuggugcacaguaugugcucaauaaauauuuauugauuaaacaaacgaaaggaugagucuccucuguggcuagagaaaaagagacagucggaccuuggggugauaggccgagcagccccagcaccaguugugacaucucucucccacuccagugcaucguccaguccuaccugcaauggcuccaagauagcgacuacaaccccaauugccgccugugcaacauaccccuggccagccgagagacgacccgccuugucugcuauggugaggccuuggcaccucggggggaucaggccagccucaggggccagcuuggugacugguuuccaggcccuccucaagcagcaggacagugagucccccgagucucagagcccagauucuaguccuguuaaaguuccuuaccugcuguguaaguucaggcaaguuauucuuccuuucuaggccucacugucuuuccuaaaaauuaaagcuccuaguuccucuuuccuaaaaauuaagcccugccaaucuggagguuucagcgagaaccagucaagcuuacggguaugcugguggccgugacuauuagcuagccagaccggcauguugcuuucagauauucaggauccaccacugauuccaaggcuaaacagagaggaagugaguuucccacauuaaaguuagcuaaaagaagucagcagacauaugugucaugacuuugaccugaaucugggguaagagccuuagcuccaguuuuugaaggagcucaugcaagagucagcuccauauguguuucuccuugugagugcauguguguacuugcaggcacuuaauguacauuguguguuuaaaugaguguuaguguguugaucuguacuuggggugaaugaauggguaaauguauguaugugaacauaugaacacagguguguugugggagugcaagagaaugcaugguugagggugccuguuagcaaaccugugaguguauagauguguaugugugagggcuccuguacccauaguguagauauagggaaugccacuuguguuugauuaugugcuuauaaggacauguacauuugugcccagggauguguacauguauaugugugccuguguguguaucgaggaaccuuuucugaaacuguucauuauuagccauuagcccaaagaauaugaugagugcaggcccagagaggacucauugaaaggacugaaaggggagguggcguuuucuuccuacccaaacuuaccccugugagcuggacagcuugguagcaccugccuggacuuagauggugguagccaagaagacugacauuuuagggaacaggacggggaggagaaggcucuggcacacacacauguguccauauguccugcaauggucuggggacuauugcuaggcuaggagcccuaagugucuucuuccucaugucucuucuccccugucucaugggcccuaagaucucuuucacugggccugccucaaugaacgugcugcccagcuaccccgaaacacggcaccugccggcuaucagugccccagcugcaauggccccaucuuccccccaaccaaccuggcuggccccguggccuccgcacugagagagaagcuggccacagucaacugggcccgggcaggacugggccucccucuggugagagucccucgucugucugaccaucuaucugcccugggccccaccugagucagauggguggguggggacaauacuaggcagccuggugacccagauuccuuccuccagaucgaugagguggugagcccagagcccgagccccucaacacgucugacuucucugacuggucuaguuuuaaugguaagugguggcuuccaccgacuguuugggcuuuagccucccugcucugcugacagcucccuuggucugcagucacaugcucuaccccugagcucuaugcacugcuucugcugacggcucucuuuccacccacagccagcaguaccccuggaccagaggagguagacagcgccucugcugccccagccuucuacagccaggccccccggcccccagcuuccccaggccggcccgagcagcacacagugauccacaugggcaauccugagcccuugacucacggugagccugggaguuauccaggccgcagaaggauaggaagaggguggaaugguuuguauagggggagcuugaggauccagagacccacccggaggaaccuuuccuuaauccaggcacagccauuaccuccucacaauucugagauguucugucagacugaggagagcaggugaucccccuagcccuccccaaagcggccaguuuuccugagucuauugaugcuaguggcuccacccuguagccccuaggaagguguaugauacgcgggaugaugaccggacaccaggccuccauggagacugugacgaugacaaguaccgacgucggccggccuuggguuggcuggcccggcugcuaagguacacagggucaggcagggcggaaugccaggaagggguggagagggaaugggagccagagguccuggaagggaugguuucaugacaaaaggggcuuguucuggggaguaacaguaccuggugcuggggcugugcagagaggccuuggcugugcagcagaagcuguguuuugcuucucucugggacugucucuaugccuccuacacaggagguuugaacucaggcucuuugaggccccuucccgaucugacacccccuaaucuuuguaauucuccccgacgucugacacacugugguuuccagaauacagucgugcgccucagcugguuugagcugcacaauaacgcccuaugguggcaggugcaggagugaucaucccugaggcacagacgaggagauggaggcucaggaauggguggugaccagggcuucucuccagccgcgggggccaccagggacuggggccugaccugauuuuccccucauccccccaggagccgggcugggucucggaagcggccgcugacccugcuccagcgggcggggcugcugcuacucuugggacugcugggcuuccuggcccuccuugcccucaugucucgccuaggccgggccgcagcugacagcgaucccaaccuggacccacucaugaacccucacauccgcgugggccccuccugagcccccuugcuuguggcuaggccagccuaggauguggguucuguggaggagaggcgggguaauggggaggcugagggcaccucuucacugccccucucccucaagccuaagacacuaagaccccagacccaaagccaaguccaccagaguggcugcaggccaggccuggaguccccgugggucaagcauuugucuugacuugcuuuccucccgggucuccagccuccgaccccucgccccaugaaggagcuggcagguggaaauaaacaacaacuuuauuaaaacacccgaggcagccuuuugcuucccccuccuuagcccuguuccgacuccccaggccucaguggugcuccucccgguacucgauggccagaaacuccaaggacaggcgguugaagaacauggcuccguugagcacugggcgggggacagagccccccaugagccccaguacccuucccuggcuacuccuugccacaucucaggguuccaaagcuccccgcucccucuugcacccucccacuccugccacucacucaggauggucagggcggagaagcagacguacuuguuuucugucaucucagcauagagugaccccauggcagcccagcagaugcugaucaccugggagaacuguaggcccauccagugggagaguggcccccucgcacaacagugggguuuccaucagccccucgggucucccacagccagcccuugcgucccugcccugagccuaccaucaggacgaccguguagugaaagcucauguggucauagugguaggugaugcagaaguugugcacgucucugaugaagaugcccagguguaagaagaagagcaucagcgcagccguggugagcaucaugccuuuugggaagaagaacguggcgaugcggucuugcagccacaucuugcccgcaguguagaugcaagucagacuugagagcuggagcaagcaggcccugcccaggaaaagcagcagagucucugguucuaaagugccugguauggaauagcagugggauucuagaaccaggaggacaguggaggggacaagauucuagaacacaggcugauuccagccaacacaggagugccucacgggugguaggggugcuuugaauugugagaucagugggggcccauggcaauggcgaaggggcagcagcccuaguuaucccauacucacucuagacgcuuuuaugcaugucucaaguuucccaaaacggaggcagugugaacacagucuacagaugaagaacuggggcucagaaaaguugaggggcguggucuagauuuacagcaagucuuaggcagaugagagaugaggacccagcugcauagcuggaaggcauucccaggugaggggaggccuguauuugcucuacccucugguggagaggaauuacgagaagggaaggaucaacagauucuucagagcugucccgggaccuuccccgugcccuucccagguguggcccagaaggcaccuggcuuuuccauucucucccaagauguucuuacaggaccugaugcuggucagcuuucugcuccgccaccuucaggugcuuggagcauuuucaccucugucagucuaagagucccaugagacagcuggggcugguggcauaaguccuauuugacacuugagucugaggcagagggaggauggucuuccucaagcuguuauagccagugagggagagagucaauacugaaacgaagauccgauacuaccugaggcugugcugagugagcagggucacaugcaagccaggaggaagaaaucuccuccaugcaugugagagaugagaacuaggcugggugcgguagcucacaccugcaaccccagcacuuucagaggcccaggugggaggacugucuugggccaggaguucaagaccagcuugggagacagcaagaccccaucucucucuuuuuugagauguaguuucacucuuguugcccaggcuggagugcgauggcgcgaucucggcucaccgcaaccuccgccuccuggauucaagcgauucuccuaccucagccucccaaguaggauuacaggcaugugccaccacgcacagcuaauuuuguauuuuuaguagagacaggguuucuccauguuggucaggcuggucuugaacucccaaccucaggugauccgccugccuuggccucccaaagugcugggauuacaggugugagccaccgcuccuggccagcaagaccccaucucuaaaaaaaaaaaaaaaaaaauuugcugagugugguggugugugccuuuagucccagcuacucaggaggcugagaugggaggauugcuggaccccaggagucccaggcugcagugaacuaugaucaugccacuguacuccaagcugggugacagagaaaaaaagaaaagaaaagaaaaaggugagaacuccagggccgucaacaaaauaugccaauaaaacagccagaaaugguguggagugacaugaaagcucccagggauugaagcaggagaagaggagggaggaggagaggacuugauuucgaacucagccaccccacugccuccugcccaacuguuugccccaaaaguuaggucccaggucagcccaagacccacaggcugccucccagcagugggauuagagccugcacccaccaucugugcuugcugcccagucuccagacaagcacaauaguucuucagagccccauccuaaccacaugaaagggguaaugccccaaggcccagcuguggucccacuguugaaacaauuguuuggaccucaguccucauuugaauacaaaugaacuuuuauacauuaaaguuccuagcuccuaauuuuauuuuauuuuugagacagagucucacucuaucgcgcagacuggagugcaguggcaugaucucggcccacugcaaccuccgccucccggguucaagugauucucaugccucagucucccaaguagccaggauuacaggcgccugccaccauacccagcuaauuuuuguauuuucaguagacaugguauuucacuauguuggccaggcugcucuugaacuccugaccucaggugauccacucucuuuggccucccaaaguacugggauuagaggugugagccacugugccuaccccuagcuccuaauuuuuaaaaauuauauacauguaauauaugaauaugggcugggugcgguggcucacaccuguaaucccagcacuuugggaggcugaggcaggcaaaugaccugaggacgggaguuugagaccagucugaacaacauggagaaacccugucucuacuaaaaauauaaaauuaagcugggcgcaguggcucacgcuuguaaucccagcacuuugggaggcugaggcgggcggaucacgagguugggaguucaagaccagccugaccaacauggugaaaccccgucucuacuaaaauacaaaaauuagcuggguaugguggugcaugccuguaaucccagcuacuugggaggcugaggcaggagaaucacuugaacccaggaggcagagguuacacugagccaagaucgagccacugcacuccagccugggcgacagaccaagacugugucucaaaaaaaaacaagaacaaaaacaaaauuagccgggcauggaggcgcaugccuguaaucccagcuacucgggaggcugaggcaggagaaucgcuugaaccuaggagguggagguugcggugagccgagauugugccauugcacugcagccugggcaacaagaucaaaacuccaucucaagaaaaaaaaaaaaaaaaaaauauauauauauauauauacacacacauauauguauguauguauauaugaauauguucuuguaaaauauuugcauaauacacaagcaugcagaggaaaauguaacagucucccugcugcauccccaccacugaaguacccccuuccccaguuuggugacuuggcaucuuuuaggucccuucuuuauguaacgguaacuucauacaucuagauguacauauacaugcauaaguuuaaagcauuuuuaaaaaucauauguuuugucaaaguguacuuuucaaaaaguuaaaaccuacgucuaaauauagaaugaacacguaacaaagauuuauuaggccgggugcgguggcucaugccuguaaucccagcacuuugggaggcugagcucccaaagugagccugagaggaucacuugagcucaggaguuugagaccagccugggcaacauagugaaaccuccucacuacuaaaaauuaaaaaaaaauaaaauuagcugguugugguggcccuugccuguaguacccccuacuugggaggcugaggcgggagggucauuugagcccaggaauucgagcccugcuugcaucuuugcaguccggccugggggcauagugagaccuugucucaaaaaaaaaaaaaaaaaaaaaaagaucuuuaacucaucagugaggggauuuccgcuugguaaggugguaaugcacaugaggaacuggacaggacgagcauuuaaagaggaacguuaggccaggugcaguggcucaugccuguaauccuagcacuuugggaggccgaggugggcggaucaccugaggucaggaguucgagaccagccuggcuaacauagugaaacccugucucuacuaaaaauacaaaaaaacuagcugggcaugguggugugcaccuguaaucucagcuacucgggaggcugaggcaggagaaucacuugaaccuaggaggcagagguugcagugagcugagaucgcgccauuguacuucagccugggugacagagcaagucucaaauaaaauaaaauacaauaaagaagaauguuagcauaugauuacuagguuagaugcaaaaugcaauggauguccuacaugacaaaaauuauacccuuugagguuaguuuuucuacuggauauacaugucuuucaucucuccuggacaauaucuccuuguaauuucagucuauuuaccuuacuagugaauagcaaaaucaaacaacuguguauucuuguggguaaauaauccuugggagggcuucugaaacgaugccccagugugacaaugagaggacacacuacacucuuggacuuccaauuuuuggauuuuuccuuuuuuuuuuuuuuuuuuuuuuugagacggaguuuugcucuuguugcccaggcuggagugcaaugccacaaucucagcucaccgcaaccucggccucccggguucaagcaauucuccugccuuagccucccgaguagcugggauuacaggcaugcgccaccaagcccagcuaaucuuguauuuuuaguagagacggggguuucuccauguuggucaggcuggucucgaacucccgaccucaggugauccacccaccuuggccucccaaagugcugggauuacaggcgugagucacugcgcccagccuaauuuuguauuuuuaguagagacuggguuucuccauguuggucaggcuggucuuggacucccaaccucaggugauaugcccaccuuggccucccaaauugcugagauuauaggcguaagccaccacgcccugccuggaugauuugucuuaacacuauucuccaacuuuuaaaaauguuuauagacuucuuggaguagaccucaaucuauacccuuuuucauuuucuuaagauuauagcuucauaggcugaaaucaaguauuuuaaaugguuucuagacaucccauugauucagaggucagcaaacuuuucccguaaaauaguaaauauuuuagguuuggaggaccaugcagucucugugguagcuacucaacucugcucuguguuuuuuuuguuguuguuuguuugggguuuuuuuuuguuuguuuuugagauggaguuuugcucuugucacccaggcuggagugcaauggcaugaucuugacucacugcaaccucugccuccuggguucaagcgauucuccugccucagccucccaaguagcugggacuacaggcgcccgccaccaggcccggcuaaguuuuuguauuuuuaguagagaugggguuucaccauguuagccaggcuggucucgaacuccugaccucggguaaucugccugcuuuggccucccaaagugcugggauuacaggcaugagccaccgugccuagccucaacuaagcagccauagaucauauguuaaaaaaugggcgugacuguguuccaauaagaguuacggaaaaugggauaugaauugcauaugauuuucaggugucaugaaauguuauuuuuuucccaaccauuuacaaaugagaaaaccauucuagcucacagaccauaugaaaacagguggugagcuguguuuggccugcaggaucccuggcaaagaacaaguaaaccagugaguuuuuccauuccaaccuuccuccaacagcccuucauaaguaauguuucaagggccacuuugaugaagaaagucuuuuucucuuuuuccuccauuccaacucuguguccuaaucugaacuccagaucguucccugucuucaugagcucuucaccuuugugcacagcugcacuuuuguccaagucagaacccugggagagcagcucaggaggcugaggugggaggggaggucaagguuggagugagccaaagauagcaccacugcacuccagccuggaugaagagcaaaacccagucucaaaaaaaaaggaaaagagaacccugagaguuauccuccacauuuccaccuaacccuucacucagcacauuccaucagucacuuaagcucugcugagucuguccuuuuuuuuucaauaauagggggcgggucucacuacguuguccaggccaguauugaccuccugggcucaaucaauucucccaccucugccuuccaaagugcugggauuacaggcgugagccacugugcccggccuuagggguucuuaaaugugaguguguaucagaacuacuugggaacuuucuaaaaagaagcuagaucugagagaaucccagagucuuuuuuuuuuuuucuugcuuuguugcccaggcuggagugcaguggcaccaucgcagcucaagcaguucccccaccucagccucccgaguagcugggaccacaggcgugcgccaucauccuggcuaauuuuuguuuuguuuuuuuugagacagagucucgcucugucauccaggcuggagugcaguggcgagaucuaggcucacugcaaccucugccuaccggguucaagcgauucuucugccucagucuccgaguagcugggacuacaggcgcgcgcuaccacacccggcuaauuuuuguauuuuuaguagagacggguguuucaccauauuggccaggcuggucuccaacuccugaccuugugauccgcgcccccacccccccggccucccuaagugcugggauuacaggcgugugccaccgcgccuggccuguauuuuuuuuuuauagagacggaguuucgccauuuugcccaggcuggucucgaacuccugggcucaagcgauccacccgccucgaccuccccagugcugggauuacgggagugcccggcgcagcucagcgcagagacuuacaaugcgccacagauaguccugaaggcaauucugaugcacgucagaggaccaggcccuaagaagaacugcgcuagaggcgugguacagaauaguguacaugcauuuaauccucguagccccccugugaaguauguaccccaauuuuaggaaugggauaaacugagccacugccaguggcaggaucccaggaacacucuacucuggccucacgucccgcauccguccauugcaucugggcacauauuccgugggccccuugccugcgagagugcagguuggggagccacuacccgucccccuucugggacagcagcaaccccaggcaguuccacaaaaugcuuccacccaggaaacugggggaauucagggcucucccggaaccuuugcacccggggaagacaggugcgggggaacucuagucucgaaggaccuagggcugcagggggacguuucaccugaaggacugccucguuucaacaacaacuuuauggcucccggaagugccuccuccccguccccuuccuuuccagccucacgcccgugggcugcaguuggaacgauggcggcggcagcugccgccgggccuagcccggggucuggaccuggggacuccccagaagggcccgagggggaggcuccggagcgucggcggaaggcgcacgggaugcugaagcuuuacuacggccucucggaaggggaggcggcgggacgccccgcggggcccgacccccuggacccgacugaucugaacggggcgcacuucgacccggaaguuuaccuagacaaggugugugcgcacggggagugggggggugcggggaggggggaagggaaccaggccccugcuauauugcucccccagaucaugccuccgacuuuuugugagguucaggagagcagguguucauaagaggacgaaccucggccagggaguacgagcagcugaggcgucugaggggaugugaguaggacuggacuggccugaggugaugcggcaucugaggucuucugggcugaugugauaggcccggaauugggggcguggcccaagcguugacaggcgcggggcugggcuuaggccgagccccaggauuucaaaugcugacaaacaccaaacacgguugaaccuaguaaccccugagcuaggccacuuagggcccccugccugggauuccugacagccggcggggguuugcgggguggguggggaucagagauuucuugcccugaaagccuaucagcugcaggcaaggcugggggacaugaaugccuccugacccgaacacuaaccacccaacuucuucagcugcguagagagugcccucuggcccaguugauggacagugagacggacauggugcggcagauccgggcucuagacagcgacaugcagacccuggucuaugagaacuacaacaaguucaucucagccacaggugauccccacggggacacacccuccaaagucucacagcccccauucucccaccuguguugggaaaaccagcaagggauuuagaggggggagacucagauuccagucuuguccugacauuauuccauucucaccuccuuuccuuugagccuucguugucagacuacuauagagauaauagcuacucucagaggguugucuuaaguaccaaaggagagaaaagacaaaaggagauuaguuguuuauuuuuuagagacaaugucuuguucugucucccaggcuggagggcaguagcaugaucauggcucacugcagccucgacaucccaggcucaugugauccuucuggauccuaccaaagcacugggauuacgggugugagucccuggcccagcccaaaaugaaauuuuaaaaugaaauguauuuaucugaagcacuuaaaaggccaggcaugguggcucaugccuguaaucccagcacuuugggaggcugaagugggaggaucacuugagccuaagaguuuaagauugaccugggaaauauagugggacuccaucucuacaaaaaaauaaaaaauaaaaauuagcuggacaagauggcguaugccuguagucccagcuacucaggagacugaggagggaggaucacaugagccugggaggucgaggcugcagugagcugugcuuguaccacuucacuucaacuugggcaacagagcaagacccugucucaaaaaaaagaaaguaucuaucugaagaagcaucccagacacuaggcugggcacaguggcucaugccuguaaucccagcacuuugggaggccgaggcagguggaucaccugaggucaggaguucgagaccagccuggccaauauggugaaaccccaucucuacuaaaaauaaaaaaauuagcugggugugguggcaggcaccuguaaucccagcuacucaggaggcugagugggagaaucacuugaaccugggagguggaggcugcggugagccaagaucacgucacugcacuccagccuaggcagcagagcaagacucugucugaaaaaaaaaauaauaagaagaagaaucccugacaucaaggaaaccucaguaagguguaguuucucuuauuauugauagcuuucuuuucugcuccagggaagaauagguggucuugucccucccuuucuuucucccuuccuucccuccuuaacuaagcaaagagagaagauguaugauauuaggggacacaaagaucaugucgaggcuuuuuuuuucuucuguccucuuuauucucuagugccagacaguguuccacuguuuuccacacuagcuucugugcuguuuugaggagauguacuacucagacuuuuguaguaauuguacacccacguguaguaaguccaggagccagauccaaaggguuuaccugcagccuguggaauguucugggagcaucugugggguugcauucugaugucuuacucucgugucacaguggugggugugguaaccuauacacauuguucuuuuaucugauuugaagcagauuccaugaguaggcaccuuucuguuagcuaauaccagcaucaaaauggcaagaaaucauaguuucugugcugggauauuucucacaggaauuuaauaagauuacauuuuccauuuguuggaauguguauaauaauauuuugagacuuagcucuuuuuguacaucccacaaaaggaacaaacguuuggaaaagugugaggauaaccaggagcauugaugucuuagaagcuuaagugaggggccgggcaugggguucucacccgugaucccagcacuuugggaggcugagguggguggaucacuugaggcuaggaguucaagaccagccuggccaacauggugaaacccugucucuacuaaaaauacaaaaauuagcugggcaagguggugcaugccuguaguccaagcuacucaugaggcugaggcaggagaauugcuugaacccaggagguggagguugcgugaggaagguguuucaagacauagauuugauagacuugggcgagacacucaggaaaguaauguagcauggaguguguguugauugggcaagagagagagaaaaaugagaaaggaacuagguccucaggaaggagggggguggaacagagcagggauggaggcaucggccucagcaaagggccgggagcucaucuaugguagcaggaggggaagcagaaugugggcagagccaggcagauaguagaugugcaguuuaacuagaaaccuuccagaauguauuagggauuuggcuuuuauccacagagagcuaaaacaaaugagugaugugcucagauuucugguuugaauagauuccuccagcugcacuggcaggaauggauggggcugagcacaguggcucaugccuguaaucccugcacuuuggaaggcugaggugggaggaucacuugagcccaggaguuugagaccagccugugcaacauagugagacccgauaucuagaaaaaaaaaaauagcuggguaugguggcacacacuuguuagaauaaacccagcuacuuggggaggcuaagguggguggaucacaugagcccaggagcuggagauugcagugagcuauaaucucaccauugcacucuagccugggugacagagcaagaccuagucucaaaaaauaaauaaauaaauaaaaaggccaggugcgguggcuuaugccuauaaucuuagcacucugagaggccgagacggguggaucaucugaggucaggcauuugagaccaggcuggccaauauggugaaaccccaucucuacuaaaaauacaaaaauuagucaggcaugguggcaggcaucuguagucccagcuacucaggaggcugaggcaggagaaucgcuugaacccaggaggcggagguugcagugagucgagaucgcgccacugcacuccagccugggcaacagagcgagacuccgucucaaaaauaauaauaauaauaaauaauaauaaaaggacagcccacagaaugggagaaaauauuugcaaguuaguuaucuaauaaaaaucuaguguucagaacauaaaaagaacguuuuuuagcucagggcuaaaaagacaaauaacccuaauuuaaaaugggcaaaggauuugaauagacacuucuccagagaaaacauacaaguggccgaaaagcacauauaaauaugcucagcaucauuaggucuuagggaaaugcaaauccaaaccacaaaaugcugcacccaguguggaagacaguuugaccauucuucaaaaccacacacaagauuaccauaugaucggcaauuuuacuccuaggaauauaccaaagagaauugaaaacauguucacauaaaaacauguacacaaguguucauagcaguguuuuuuuuuuuuuuuuuuuuuuugagauggagucuagcucugucacccaggcuagagugcaguggugccaucuuggcucacuguaaccuccgccuccccaguucaagcgauucuccugccucagccuccugaguagcugggauuauaggugugcaccaucacacccgccuaauuuuuuuauuuuuauuuuuuguauauuuacuagagacgggauuccaccuuguuggccaggcuggucuugaacuccugaccucaagugauccgcuugccucggcuucccaaaguacugggauuacaggcaagagccaccaugccuggccaauagcagcacuuuuuauaauagccacaagguggaagcaauccaaauggccaucaauugaaugaauauaaacaaauauccacacaguggaauauuauucagccauaaaaauagauauaacauacugacacaggcuacaacauagauuaaccuuggaaacaugcuaauguuucauaugccuaugauuccauuucuguuaaauguauucuguagcgaauagacaaauccauagagacagaaacuagauuaaugguugccaaguucuaggagugggggaauaaggaaugacugccaaggguuacaggguuucuuuaggggaugaugaaauguucuggaauuacguagugagguugguuguacaaccuugugaauauauuaaacauauuaaaaaccacugaauugguaugucaauuauaucccaauuaaaaagaaaaccaggcauugagccagauuuggccugcaggcuguaguuugccaaccucucaccuagacauugaguuucauuauguaauaaugcauuuacuugugucaaaauuagaaagaucucaaacauuauacagggaaaagccucuccuaauucuuuucucuaggcaaagacaaagcagucuuugacaguacauuucacugaaaauuaacagagcccaggugggauuauggcucauaccuauaaucccaacacuuugugaggcagaggcaggcagauugcuugagcucaggaguucgagaccauccuggccaacagguuauaccugucucuacaaaaaauacaaaaauuagcugggugugguguugugucccuguaguccgagcugcucaggaagcugagguggaaggcuuguaccugggaggcagagguugcaguaagccaagauugugucacugcacuccagccugggugacagagccagaccuugucucaaaaaaaaaaaaaaaaaaaaaaaaaaaaagaaaauuaacagacauacagaaaagugcacauaaguggacagcuccauggauuucacaaagggagcacagucacauaaucagcauccaggucgggaaacagcauaaccagcaaagcccccugagccuccuaccaguuaccacccaguccccucccaagguagccaacauccucgcauccagauggcuuucacucucccugguuacaaacugcuuuucuuaacaagcuuuuuuuuuuuuuuuuuuuugagacagagucuugcucugucauccaggcuagagugcaguggcccaaucggcucacugcaaccuccgccuccgggguucaagugauucuccugucuuaggcuuccaaguaccugggauuacaggcaccugccaccacacuuggcuaauuauuguauuuucaguagagacgggauuucaccauguuggucaggcaggugaccucaggugauccaccugccuuggccucccaaagugcugggguuacaggcgugagccacugugcccagccugcuuuucuuaacaagcuugaaaugcaaagauaaacaguguagucuuugugacugaaugguguggaugcuuucacuguuguuuuuggauaugguacaacuuuuaucuccaguguaauggcuccauggcugggaaggcagcgacaaugacagcacacagcacuguuggguuuucuuuuacucuauuuuccuaacaacuuaguguuuggauuuuacccuuuagaaguuggauucaagcuuccuucuugagguagccccuaagugucaugggcucaaacacccacuaccaaaagagucugcucuuuucaugguagcuuuuggcagaccuggaaggagauugugucacauggccuguaaacaaaaccaguaauucacugggugaagaccaaaugccucaucaacugccaagccucugucugucucccuuagaucaguagcccaugaucccuuuacgaaccucagccucggcucugcuuuuauuguuuuucacugcauagcgcugccuuugcuauguccuuuaguucaccaucuaugaauuggcaagaaaaauuuucuugccaggcacaguggcucacuccugugcucccagcacuuugggaggcugaagugggagcauugcuugagcccagaaguuugagaccagccugggcaacauagagagaccccaucucuacacaaaauuuaaacaaaaauuaaaaaauuagccgggugugauggcgcuuguguguagucccagcuacuucagaagcuaagguaggaggaucacuugagccccagaguucaaggcugcaguaagcuguguuugcaccacugcaugccaucuuggcucacuguaaccuccgccuccccaguuaaggugauucuccugccuuagccuccugaguagcugggauuauaagugugcaucaccaugccuguagacagagcaagacccuaucucaagcaaagaaacucaaaauaauuaugauuuccccaacaaaaugcaggcaauggucccuauggucccaaaaguaauauagauguuucacaucaugugauuuuauuccuuaguaaccuuccuuucuaugaaaucaucucuaagagggcuaaaugauccuuucuuguggacuguguuguuaaaaugaaaaguccauuuugcugauacguaaucuaccuuuccauguaauuuuuuaaaaaaucccuuaauagcucuacagaugugagcccuguagauucuuugucucagacaguucuuucucuuauauuuucucuaauauuuuuuuccugcauuuuuuguuucuguuuguuucuugucaaauugacaucaaugcuuuucuccuuacucacccuuccagcugucuccccaagugggguagauucccaguguugcuuggagaacauuccuacagucccagagccacacacagaccaggugugggugugugaaggcucacaagugauugcaguuagauauuuccagauucuucuuuguaaaugcugaucaguuugcauaaccaccagcaaagaagagaauaccucuuucaaucuuugacaaucugagaagugaaaagugguaucucuuauuguuuauaguaacguuuacaggguguuuuuuuuuguuuuuuuuuuuuagggcuuucuauuuauucaauuauuauuauuugagacagaguguugcucuauuacucagguuagagugcaguggcacaaucucagcucacuacaacuugugccuccaggguucaagcgauucuccugccucagccuucccaguagcuaggauuacaggcaccugccaccacgcccaacuacuuuuuguauuuuuacuagagacaggguuuuaccauguuggccaggcuggucucaaacuccugacgucaagugaucugccugccucggccucccaaagugcugggauuacaggcaugagcuaccguggcuggccuauuuauuugauuauaucaucugcaaauagugauacuucucccuccuuuccaauuuguguaucuccauaauacaucucgugacucuagcugaguuggcuaaugccccagaacaauguagauaacauuggcaaucaagguuguccuugccauguuuugacuuuaauuggagugcuucuagcacugccucgguaaacaugauacugaguuuuggaggucagggaaauauuuagcugcucauauguuauugagaguuuuuuaaaaaucaagaauagauguugaaauaucuauuaacauggcaaauuauuaugagauccucuaauuuugagucauccuggcauucaugaaacaaaaacccuuuuguguuuaucaauuauuauuuuaauaugcugcuggauuuuguuugcuuauuugugcaucuccauuuguuuauuuaauucauccuugcaucuccauucauaagagauaugaauguguauaugugagguauuucuguuauguuuucauaacaguguuauguuuguuccaucaaguuugugugagagcuguucucguuucucugcuggggcaguguuuacacagagaauuggaaggcgcuguccuucaagccgccgcaacaccccuggacaucugggccagaugccuuuguguggaggggaaaggggaguaggaccuuucuuucacaacauucucuaguuuuucuguuucuguuuucuuguuuuuugcaauccauuuugguaaauccuauuuuuguagcaaauuauccauuucauccauagaauucaccaagcccuuaccaauuuaguguuuucuugguauuuuacccaugcugcaauuucaguuuugauuuccuuuucugaccucauaauugguuaacaaugagguuuuuucgacugggcacgguggcucccgccuguaaucccagcacuuugggaggccgaggcggguggaucacuugaggucagagaccagucuggccaacauggugaaacccucucuacuaaaaguacaaaaauuagccaggcaugguggcacgugccuguaaucccagcuacucggggcugaggcaggagaaucgcuugaacccaggagguggagguugcagugagcugagaucgcgccacugcacugcagccugggcgacggagggagacccugucucaaaaaaaaaaaaagaaugagguuuuuuucuuugugaucuaccauauggaaagguuuguauauauuuuauggcauuguuugggaaaaaugcaaacugugugcuuccuaugcucucacaucaccacaaucaugaccacagaagaguucugugaccaaauguguuggguuucuuccccacacaccaagcagcagacacccgcuggguguccucugauuuaauuccaacacuauuuacccagagauagcaucagauuccaugaguugagggcugaguccccaagccugccucccuucaggcacuaguucagucccaaaucugccuccccacuuucaggcacuagcugcaggucagggccucaggccuccagaauuucugaccaacuggcuccagguagggguuuccauaacucccucuuugggcucaguuugcuggaguggcucacagagcucaggauaacacauuuaccaguuuauuacaaaggauguuacaaaggguacagaugagcaggugcauagggcgagguguaggagaaggagcauggaguuuccaugcccuccccgggcgugccacccuccaggagccuccagagcugagaucgcgccacugcacuccagccugggugacagagugagacucuuucucaaacaaaacaaaaccaaaauaucuccuguuacagauacacauuucugucuuauccucuucgccuuucuuuaugaacauuguugguauguucaauggaauuagggaaauuaguugggaaauguuggcaguuguuggacaagagaugauaguggcuuacaaagaaaauguugcagguagaccuuccaugacuugguaauggauugauuacuagguauauuaauccagguucauacugcuguaaagaacugcccgagacuagguaacuuauaaaggaaagagguuuaauugacucacaguucacagcauggcuggggaggccucaggaaacuuacaaucauggcagaaggugaaagagaagcaaggcaucuucuucacaaggcagcaggaaggagaaguguuaagcgaagcagggagagccccuuauaaaaccaucagaccucgucgggugcgguggcucaugccuguaaucccagcacuuugggaggccaaggugggcggaucaugaggucaggagaucaagaccauccuggcuaacauggugaaacuccaucucuacuaaaaauacaaaaaauuagcugggugugguggcaggcaccuguagucccagcuacuugggaggcugaggcaggagaauggugugaaccugggaauuggaguuugcagugagcagaggucgugccacugcacuccagucugggcgacagagcgagacucagucucaaaaaaaaaaaaaaagaauagguggaauugaauugaggccgucagugaacagucaggaacauuggaaggcucauccauguggaugugcacaaggaggugacaggaggaggagaagaggcagugauggggaacugagaggagugucagaggacaguagagacagcaaagaggaggguuguggcuugauggcauggucuuccuagaagccgggguuuugaagagaggagaucuaggcaugauuuagaagcaugaagggaccaggcucccaggcaccuggugugugaaaggaaaaacagccucccuaggcaggauucuaucaggaccaaagggaaagggcccuucagagaagacagcccauguuccggaaagcaugugaaaggcuuugggaggucuggaaaggagaugagggucaacaagaauguauugccucauccaggcagugcgcuggacacgcagaugcgcuugggagccagcggucccugccuuggcugcuuguggucugauggagcaguugaggcacagugguggcagcuggcuaagcaccugcggccugcuucggaucuggacuaauucugagggccggcucuccugggcaccaggguuaggggguuacggggaguaugugaguaacgccugcuuugggaacauaaacccccucccccgcccccaugugcgcugugacccacgcccucgcaguccuuucucuggaaucauccaugcgccccuggagcaagcuggggcgucugugaaggggugggugagaaggagcugagguugcgcccgcccugcagucaccugcucuccccuuuuccccgccccugcccuccuagacaccauccggaagaugaagaacgauuuccggaagauggaggaugagauggaccggcuggccaccaacauggcagugaucaccgacuucagcgcucgcaucagcgccacgcugcaggaccgccacgagcgcaucaccaagcuggcaggugggcgcugccgggcagggccugcagugggccuuuccuggggcucuggggcuaacgucacccuccgucccccagggguccacgcgcugcugcggaagcugcaguuccucuuugagcugcccucgcgccucaccaagugcguggaacugggcgccuaugggcaggcggugcgcuaccagggccgcgcgcaggccgugcugcagcaguaccaacaccugcccucguuccgcgccauccaggacgacugccaggucaucacggcccgccuggcccagcagcugcggcagcgcuuuagguguggccccucugcccugaccccagcgcucccgccagccccgagccccaucugugcccggcuccugggcccuccuggagcugucccccugcccugugugugcuuugcuuuccugcuccugccccauccaccggcagccccggcccugcccuucacuaccucucccucgugcagggagggcggcucaggcgccccggagcaggcagagugcguggagcugcugcuggcccugggcgagccugcggaggagcugugcgaggaguuccuggcgcacgcccgcggccggcuggagaaggagcugagaaaccuggaggccgagcuggggcccucaccuccggcucccgacguguuagaguucaccgaccauggaggcaguggcuucgugggcggccucugccagguggcggcggccuaccaggagcuguuugcggcccagggcccagcaggugccgagaagcuggcggccuucgcccggcagcugggcagccgcuauuuugcgcugguggagcggcggcuggcgcaggagcagggugguggugacaacucacugcuggugcgggcgcuggaccgcuuccaccggcgcuugcgggcucccggggcccugcuggccgcugccgggcucgcagacgcugccacggagaucguggaacgaguggcccgcgagcgccugggccaccaccugcagggucuccgggcggccuuccugggcugccugacagacguccgccaggcgcuggcagcaccucgcguggcugggaaggagggcccuggccuggccgaguugcuggccaauguggccagcuccauccugagccacauuaaggccucucuggcagcagugcaccuuuucaccgccaaagagguguccuucuccaacaagcccuacuuccggguacgccuccucuuggguguuccuuguucaaccugcugguugacccuccaaaaccuuuuaugccagugcuugggaaacuggggaaaccaggcacucugggugugguuucagguucuuaugcacggucugggggguggggaaggcucagggcaucugcagcugggcugagaagcagggcauggugggguccccaguguuggcuuucucugcccccacucagggaagcugcuccgggguacuuagaauguaggaugaugcugucccuugcagagggggcuggggcacuuagagccccagcagagggucauuaacagccuuaccuggaagaggggaccugcuguggaccugggcaccuucucuugcagggugaguucugcagucaggguguccgugagggccucaucgugggcuucguccacucuaugugccagacggcucagagcuucugcgacagcccuggggagaaggggggugccacaccaccugcccugcuccugcugcucucccgccucugccuggacuacgagacggccaccaucuccuacauccucacucucacugaugaacaguuucuggugcaggugaagcacuagcuccuagccgggcagggaaugguguugcugggaaugcagauggcuggacagugcccucauggccagaccccagaccagcugccuguguguaccccagccuccaccuugcccaaucugugcccagcuccugguuggcaguggccccugagcugcccccaccauacccacucccucuguccucugccuccuuggcucaggaucaguucccagugacgcccgugagcacgcugugugcagaggccagggaaacggcgcggcggcugcugacccacuacgugaaggugcagggccuggucauaucacagaugcugcgcaagagcguggagacucgcgacuggcucagcacucuggagccccggaaugugcgggccgucaugaagcgggugguggaggauaccaccgccaucgacgugcaggugcugcccaggcuggccgggguagcccugacgcaggcuggggguacugucccuucaagaggggcuggggcagcagaggaucacuggcagucccugccuggaggaggggacauguguaucugggcuucucacggggccaguucuguagccagggcguccgugagggaaccccaggggaacaagucuccaaggaugaagaccaaacgggcuggggagugccuauguccacggucuuguuccuucucagcccaggauuaugacaucuucgccccuauuuuaccuguggagaagcagaggcucaggguuacccaggaagucagggcaggguuggugcuggugcugaagauuagaccucagaccaacucuuguauccugccuuugccccacuccacugguucuauaaauagcgaccauguaccuacuaaauagcgggccccgcggugauuacccugugauccuugugaugcuugaguagcugacuuagggcauccucagcaccgaugggcuggugguuuccccugacucgggccuccuugcaguaccucuuuuuaccaccagguggggcuccuguacgaagaggguguucgcaaggcccagagcagcgacuccagcaagaggacuuucuccguguacagcagcucucggcagcagggccgcuacgcccccagcuauacccccaggucuggcuggucaggggagccccagggggaagggacaaaagagggcgagggugcagggcgggcucugauuccuugucuuccccaauccagugccccgauggacaccaaccucuugagcaauauccagaagcuauucucugaacguauugauguguucagcccuguggaguucaacaagguccgacuuccaacgugacucagacuuccagggaucccggggaggguuggcuggagcagccccacaccugcccaaggagccccaggacucugugaccaacugggggugacccugacccuccagucucugucucuagggcuguuuuuagguaguacagagugcccugccuccaaaucccacagcccuugucccagucuugguguaugcccagccugagucugggugcugaccugggauuacuguuugcccuuguccuuauccccacaguagucuuggguccuccccaggguuuucuguucacccauggucccugccccgccucacuccaagcucagggaugccucugauugcugggcccuaccuguccccugcccuccagaugacggcgcuaauauuguaucccucccuucuuaucuggccccggagacuuucugccucaucccagcuacuuccaucguaugucucccgggccccugcuuggaacuugggugucccccacacacaccugcaguccccaagcugcaucccugugucccugccugcaggugucggugcugaccggcaucaucaagaucagccugaagacgcugcuggagugugugcggcugcgcaccuuugggcgcuucgggcugcagcaggugcaaguggacugccacuuucugcagcucuaccuguggcguuuuguggccgacgaagaacucgugcacuugcugcuggacgaagugguggccucugcugcccugcgcugcccagacccugugcccauggagcccagugugguugaggucaucugcgagcgcggcuaggcgcagccgcugccaugcaccggucugucccugcaccccauggcacccaggaucuggucucggugguccuuccccgcaggcaggugucaggaccggccuaauaaacauguguggccuccuccucucgcuugcugggcgggccuuuccgggggcgggguuuugaagcugaggcuucugaggcgcccgcgucggguccgcccccgagcgccgauuggcuggugugcugggcccagcaugggcagggggcgguuccacuuaaaaacccugggacgagagcgguccuugucugcguuccguguccaggcaggugcaggcgccgcggggccggauccuccgcgcggccgaguccaucuccugggaaauggggcggacaguguuuccuugacugacuauugugagcgcccucucucuccggcggagcggagaccauggcccccacucagggcccccgggccccgcuggaauucggagggccccuggguaauggggcagagagaugggaccuggggcaaaggcuaagcgaaggagagcuggagcgggugaacuaagagcgggggcgagaucugaggauggaaggcuuugggggugucggaggcagagggacccggggguuugcagcgaagggugucuggagagggagagcugaggaggggccgguucugggggcugcagaacggggauuuauggugucgacugggagcaggaggagggucuucgaggggccugggggcgggggacuaagauggacgccugggaagggaacugggaggcagcggggugccugggggccgagggcugaggacggggugcggaggcgcacucugggaaugccgagagggucccgcagagacgucagggcgcccgugcgggccggcggggagcuggggggcuaggggcggacgcccgacgugauggcccuucccgcaggcgccgcggcucugcuacugcugcugcccgccaccauguuccaccugcuccuggcggcccguucgggccccgcgcgccugcuggguccacccgcgucccugccggggcuggaggugcuguggagcccacgggcgcugcugcuguggcucgccuggcucggccugcaggcggcgcucuaccuacugccggcgcgcaaggugcgggccccgcucgcggacgcucgggggagggaagcgaaugggcucggcgagggaaaggacgccccgggccuuaucagagcccccuuggacccgcagguggccgaggggcaggaauugaaggacaagagucgccugcgcuauccuauuaacggugccuaggggacgggcccucgcgcuggaguuaagcggccggggguggagcuccaggccuagcggggagguccacggagauuggcccccaccccaggcuccuuugugugccucuguuacgcccaggacagacgccgggggcucucccuaugccccucguccccacagccuuaccccauuuacugcuacuccgugcaccacagcaguggcuggggugauccucugaaggccaggguggcagccuaaugcuuggggcagggucuguggccccccugaguuuugggcucugcguguguuugcgggguggggauguggaggcgcgcagccccagggcucacugugcgcugugguucaggcuuccaggcccuggugcugacagcccuguugguggggcuggggaugucagcggggcugccucugggggcgcucccggaaaugcuccugcccuuggcguuugucgccacccucaccgcuuucaucuucagccucuuucucuacaugaaggcgcagguagccccaguuucggcccuggcaccuggggggaacucaggugagagggguccugggguggagacggaggcagauuggggcgucugccuguacauucacucuccaauauucuccaggcaauccgauuuacgacuuuuuucugggacgagagcucaacccucguaucuguuucuucgacuucaaauauuucugugaacugcgacccggccucaucggcuggguauguugggcuugacugagcuggccucaggccagggggaggguuagggugggugagcagcgcuugggcagggcagggccaaaacugugcagaugcgagucauuaaccauucauauuccacaaacauuuguucaauccaccugugccuagguacugggagacaaaaauaaaguuagaggcaaaaaagcaucuuugcugcagagagccuacauucuggugggaaagacagaaaaaaauaaguaaaauauauacagcaugucagggaugacguuaggagagcacgugcaauucucaacagcagucaagcacagaaucuauuuccagggagugaccgcaugcugcuugauggucaaggcagugcagaaccugaaauugaucgcugggguuagcaaccuacccgucacuaguggccuugacaacauuccaacugugaucucugguucuguggccaagauuacccaaagaaacucuugggcaaggccucuccuguugcccuggaaauuaucuuacccgaggcaggagugccaggugcccacccugggucuggguccuggccugaugacaggcacaucugaggacacuuccucaucuuugagaugugauaaaauuaaagcuuucuccuaagauuacugggaagauuagaagagguaaucuuuaugauagaacagagcucagugucaaaugcaggcgcccagcacaggcuugcuccggcuagccacacugagcacguaccacuugccagggacgcuauggagggcuucaaacacgaugaugccauugagucaugacaggcccaugauuauccccauuuuucacacaggggugggggaaaguaggcuguggagagggcaagcaaccugcccaagugaugaugcugagaucugaaaacaggucuguuugagcacugaagccuuagcccgaaagggcuuaggacagacaaggcaagaagaaacaggcugcgggcaccucccuguccacagucucuguccuugggucuagggccuggauccacuuaagagcuggaguguaacugacaguugagaagggcagaggcuggccacugcucugcccaaggcugccacuucuguggagacuauugccuuguucccucuccccagguccucaucaaccuggcccuguugaugaaggaggcagagcuucgaggcagucccucacuggccauguggcuggucaauggcuuccaguugcucuacgugggugaugcccucuggcacgaggugaggcuggacuggacgagggugggugucugagggccgcauagggacuaagccagugugucugggucuugucccugcaggaggccguccucaccaccauggauaucacacaugacggguuuggcuucaugcuggcguuuggggacauggccugggugcccuucaccuacagccugcaggcccaguuccugcugcaccacccgcagccccugggguugcccauggccucugucaucugccucaucaauggucagucaggaaggggcagcaggcugggcccaucuucccccuaucccuuugauucaugcucuguuuacacgcaccaccacauaggugcuaacccccaggguucucuaaagccagggcaggguccuggggguccaggcagagucugggcugcagacaaguugggcagauguucggggucaggcaggaggcugcaacccuugaccuugaccaccgguucacacucucucaccagcuacugguuacuacaucuuccguggggcgaauucccagaaaaacacuuuccgaaagaauccuucugaccccagaguggcuggugagcugguucucuagggccaugggugagguggggcagcugggcuuccugggaacucuccacccugcugucuuuccccagggcuugagaccaucucuacagccacagggcggaaacugcuggugucuggguggugggguaugguccgccaucccaacuaucuuggagaccucaucauggcucuggcuugguccuugcccugcggugaguggcccauguggauauggguagggacaugugaggggaagagguggcucagcgaccacaggaugccuacuuuggguaugcaccagugagaguagucagagagcuggggguggacccaguguguggcuggggcacaccucugugccaaccuaguaccgugugcuuugcugcagacccuggcgcuuuugcugcugagccccgaugcccacaugagccaugagguguggaaacguuugugaacugcgggguggaggggccggcaggguggucacagagccuccuucucuacaggggugucacaccugcugcccuacuucuaccuccucuacuucaccgcgcugcuggugcaccgugaggcccgggaugagcggcagugccugcagaaguacggccuggccuggcaggaguacugccggcgugugccuuaccgcaucaugcccuacaucuacugaagcggcuccaccaccccaggugggggcaugugcccacucauccaccagcacacccaggaccaggagccucgacacacuugggacucaagggcuugcaccccacccagcccugaggaugaacaaccucagagaagaggugguuuagagcaaggaaaaaaaugaaaccagugaccaaaaucggagaugcucuuccuccuuuggauaaacacugggaacccuug

SEQ ID NO: 18691 - RNA, 14323 nt, Homo sapiens
cccagcuggccaagaguccgcaggaugcaguggacgaagguguuggggcuggggcugggggcugcugcccucuuggggcuggggaucauccucggccacuuugccauccccaaaaaagccaacucacuggccccccaggaccuggaccuggagauccuggagaccgucauggggcagcuggaugcccacaggauccgggagaaccucaggugagaaguggggccaucugcuccuccguuugccagaggcccccucccugaugcuggcccugccccucccucugcccacccugcagagaacucuccagggagccacaccuggccuccagcccucgggaugaggaccuggugcagcugcugcugcagcgcuggaaggacccagagucaggccuggacucggccgaggccuccacguacgaagugcugcuguccuucccuagccaggagcagcccaacgucguggacaucggugagguccugcccagucuugggaaugcccggggguggggagcugcugggcccagccaugauacugccaccccuccaacagugggccccacugggggcaucauccacuccugccaccggacugaggagaacgugaccggggagcaaggggggccagaugugguacaacccuaugcugccuaugcuccuucuggaaccccacaggugggcccagaacccccccuacugcucuggcccagcucccuugguuccacccaggguucuccccacccugacccagggaacgugccucaacuggggcacagcgcgcccuccggaauuuacucaccgggacacuccaucgcugcuccuuuccuccaucagucauucaacaaacacuaguggcucugcucaaggccaggucuguuacagggcacccagacauggaggaaaugaggggugacuguucuuggggagcuuacaagcucugggugaggugggggaacagaaucuaaauucucccuccugccaugcaaacuuccaccccccuuccccacccacacuucgcugggcccagcucuaaggaucacccccucuugggacuagggccuccucgucuaugccaaccggggcgcggaagaagacuuuaaggagcuacagacucagggcaucaaacuugaaggcaccauugcccugacucgauauggggguguagggcguggggccaaggugaguggcagucccccagugcaggaggccucggugaggaaggggcugggcaguggacuggaggaagugaggggaaggggaaggagaagaggcaguguugaguggggaaccaagccccaggguggggcaggaaaggcaagguguuuucggguugucccaccaaugggcuguguggccucggaugccucccugacccucucugagcuguaggaaauaaagggguugaguacaauuuucagguuugguauuccagaagucuaaguccuccugugaaauaguuuugaauauucaacuuaagucccuccuguuggcccucucccugccauuucuuuuccaucaaaaauucugacuaggggccgggcgcuguggcucacgccuauaaucccagcacuuugggaggccgaagugggcagaucaccugaggucaggagaucaaggccagccuggccaacauggugaaacuccaucucuacucaaaauacaaaauuagccacacaugguggugcaugccuguaaucccagcuacuggggaggcucaggcagaugaacugcuugaaccugggaggcagagaugguagugagcugagauugcaccacugcacucuccagccugggagacaucgagacucugauuuaaaaaaaaaaaaaaaaaaaaaaaggcugggcaugggcgugguggcucacgcuuguaauccuagcacuuugcggggccaaggcaggcggauugccugaguucaggaguucaagaccagccugggcaacacggugaaaccccaucucuacuaaaauacaaaaaaacaaaaauuagcuggguguggcagcgugcaccuguaguccuagcuacucaggaggcugaggcaggagaauugcuugaacccaggagguggagguugcagugagccaagauugugccacugcacuccagccugggugacagagcgagacuccaucucuaaaaacaaaaaacaaacaaacaaacaaaauuaauauaaaaagaguagaaugagagaggggaagggauaguugguauuuaauggggaccgaguuucggauuugucagaugaagaguucuagagaugaaugguggugauguugcacaauauggauguacugaaugccacugaacugcauacuccacaugcuaaguuuauguuauguguauuuuaccacaauuuuuuuaaaagugggcuggacgcgguggcucaugccuguaaucccagcacuuucggaggccaaggcagguggauuaccugaggucaggaguucgagaccagccuggccaacauggugaaacccugucucuacuaaaaauacaaaaaauagccgcucaugguggcaggcaccuguaaucccagcuacucagagguugaggcagcagaaucacuugaacccaggaggcagagguugcagugagccgagaucaugccauugcacuccagccugggggacaagagcaagaccucaucucaaaaaaaaaaaaaaaaagguguccauaauaagagcugggaaaagagaaagaaagaaggaagguggagagaaaggaaggaagaaaagaaagggaaaaaaggaaaagaaaaagaaaggggaacaagcaguguagaaauacacagauuauuaauuaaccaucaccacuacccauuuccagaaccuuuucaucauuucaaacagaaacuuuauuuaacaauaacuccccaggucccugccccagccccuauucuauuuucuguaaccucaauucuacuuucugucucuaugaauuugccuauucuagguaccucgcauaagugaaaguauaagauauuugucuuuuuaugucuggcuuauuucacuuaacauaacaucuucaaggcucauugauguaucagaacuuucuuucuuuuuaggcugaauaauauuccauuguuuuuuguuuguuuguuuguugggguuuuuuugagacagagucuugcucugucaccuaggcuggagugcaguggcaugaucucagcucacugcaaccuccaccucccagguucaggcgauucucgugccucagccucccaaauagcugggacuacagguguguaccaccacaccuggcuaauuucuguauuuuuaguagagacaagguuucaccauguuggccaggcuggucuugaccucaggugaucuaccugcuggucuugaccucaggugaucccaccucaggugaucugccugccucagccucccaaaguguugggauuacaggcgugagccaccccacccggccuccauuguauguuacagcccacauuugguuuagccauucaucuguugauggacacuugggcuauuuccuccuuuuggccguugaggauaaugcugcuguggacaugaguacacaacuguguuauuuuaugcagcuucaugguauuccacuguaggaugucccuguuauucaaccagacuccacugauaggcacgggcuuggcugugccgaacuggccuuuacuguugcaagaggcacugccauaaaugacuugugcaaacgucaucuugcccauggaagauuggucuauccuggcuuccacagucgaggaaggaggaagaggaauaggacauaucuggucccggucccucccuuacacacagccuccucugcccacugcaggcugugaacgcugccaagcacgggguagcuggggugcugguguacacagacccugccgacaucaacgaugggcugagcucacccgacgaaaccuuucccaacuccugguaccugccccccucaggaguggagcgaggcuccuacuacgaguauuuuggggacccucugacucccuaccuuccagccguccccucuuccuuccgcguggaccuugccaaugucuccggauuucccccaauuccuacacagcccauuggcuuccaggaugcaagagaccugcucuggugaguuugugcccugggguguccugcccagccccaguggccuccagacuucaagccccacacucacauuuacccugaagggccucuuccuccuccccaguaaccucaacggaacuuuggccccagccaccuggcagggagcacugggcugccacuacagguugggucccggcuuccggccugacggagacuucccagcagacaggugagaugcagccagaccaggucucccucaguugcccucucccccaacucgccucuccccuucccuugugaugauguucccucuuuccacuucaaagccugaccuuuuucccuuuccucucucucccagacccucuccugaccccaaaauaugucuuguuuuuggggaagcccgugaaacagcugcugcuguuuccuguggggauuccccugccccucccaccucaucuugacgucuguaacucacgacucccucucuugaagaugccaagcuccuucccaaaucagggccccugccacucccaaccugcaccaaccucccucccuacagcacccacuggccuccaggugcccucuccucccaggccccuucacccagcuguuccuguccuccuggucugucucacucaggagagggaggccccacgagaaccagguccacaucugucaccgucauugcccagagacuagucagggacuaaguacccaauaaguaccuacccagcgaguaggcaggagagccuggcuccagccuugcugccucucuugguacuucggggccaaugaauggccuugccacgucacuuuccagcuccgggccucagugucuccugcacugggucgggggcagugggcaaggccaagagucuucucacacccuucacccuccccagccaggugaaugugagcgucuacaaccgccuggagcugaggaacucuuccaacguccugggcaucauccguggggcuguggagccuggugagcccuccucuugcugccugcaccccaggccccugcucugcucuggaugccgcuguccucauccagcccugcccuugccaccacccagcccagcucccccugcccaccucucccucuccucugguucucugccccuuuuccucuggccagaucgcuacgugcuguaugggaaccaccgagacagcugggugcacggggcuguggaccccagcaguggcaccgccguccuccuggagcucucccguguccuggggacccugcugaagaagggugaggcggcccccuccccuggaccagggaccuucgcccccggagguccccuuccuguuccaccuccucucccucacacugcagugcuccuugugccaugccugagggcccugggggcagacaugcaugacaccagccuuggccugcagcagcccagugugguacagggaauagacuguggguugauucaugugccgcuuccaagugccucccgugugccuggauggagcaaggcccgaugcugcugugaagcaggcagcgcccaggcucugcccuccgggaacuuuagcucagcugggucagggacggcagccgauuguuaacucugaugucucuaaugucuugugugccuuugacauggcaggccagguugggacaagucucucaguggaggcagcacuucagcguuucagugcuucagggaaggagaggagggcaaggagguggcagccagaaaggagguggacagggcugggcgagguggcagagcaggcagggccaggccaggcugaggaguuuggaguucaguccaaggguugugggaagccggugaaggauuucacgcaggagagggacaugauagaguccucauguuaaacggcuccuggccaggcacaguggcucacgccuguaaucccagcacucugggaggccgaggcaggcagaucacgaggucaggaguucgagaccagccuggccaacauggugaaaccccgucucuacuaaaaauacaaaaauuagcagggcaugguggugugcaccuguagucccugcuacuugggaggcugaggcaggagaaucauuugaaccugggaggcagagguugcagugagcugagaucgcgccacugcacuccagccgggagaauggagcaagaccccgucuaaaaaaaaaaagcggggagcaggggaagggcacuccacauaggggggccaggcagacgcuugucauuccagggcuggagaugcuguggggcuuggaccaggauggagggcaguggggcagggacaggcugcugggcccgggucugcuggcuccaggggcaagagggaggacaagucgagggcuguggucuaagcgacucgacauuagugccauuuaagaaaaauaacuggguggaucuaggacagaucuagaaggaagaugugaaucugggucuucccauauuaauuucuuguuuuaguuuuaguuauuuauuuuuauagagauggggucucgcuguguugccuaagcuggucuugaacuccaggacucaagugauccacaggcauugaguuuccacgccaggcccucuuucguuaguuuuaaaaauucaugguaaaauauacauaacaaaauugaccaguuuuacguuuguaaguauuugauucaguggcauuaaguacauuucuaaaguugugcaaccaucacugccauuggcuccagaacuucuucaucuucccuuacauauaauaucccagagugcuaagcauggcauuugaaccgauacccacucaacuguaauugcacacaaacacgccacugcugucaaacuccauccccccccuuguaugauaugaugucgcaguucagaaaugagaccugaagucuggccacagugguucaugccuguuaucccugcacuuucgaaggcugaggugggcggauugcuugagcccaggaguucgagaccaaccuugugagaccuugucuuuacaaaaaauaaacauaaaaaaauagccaggcguggugacaugugccugugguuccagcuacuucggaggcugugugggaggaacacuugagccugggagguugaggcugcaguaagccgugaucacacuacugcacuccagccugggcaacagaaaaggacccugucucaaaaaaaaaaaaaaaaaaaaaaaaaaaaaaaaaaaaaaagaaagaaagaaaggagagagagacuugagagaugacuuggggaguugguagcaaaacagucugugaaaccacagguguugcugagaucagcucagaagccagggguggagggaguggacaagcuuguggagagaggcugggcuuucgacuuuacccuuauggguagcgcagaaauucccauauuuuuuuguuugucaaaguguuguauguugaaauaauuucagacuuacagagauguaaaaauaguacaaagaagccucuuauacagacacuccuaauauuaauguuucaucacguuugcuuucuaucucuguauaauauaugggccaggcacggugacucaugccaauaaucccagcacguugggaggcagaggcaggaggaucgcuugagcccaagaguuuaagaccagccuggggaacauaccgagaccccugucucuacaaaaaauaggggaaaaaagccuuggcuauuuauaauauaacuauauauguuuuugucugaaguauuauuauuauuauuauuuugagacacagucuugcucugugacccaggcuggagugcaguggcgcaaucuggcucacugcaaccucugcccuccagguucaagccauucuccugccucagccuccugaguagcugggauuacaggcaugcgccaccacgccuggcuaauuuuuguauuuucaguagagaugggguuuuaccguguuggccaggcuggugucgaacuccugaccucaggugauccacccgcucuggccuuccaaagugcugggauuacaggugugagccaaugugcccagccaauuuuccacaacuuuuuuuuuuaauuauuuagacagagucucgcucugucgcccagguuggagugcaguggcgccaucucggcucacugcaagcucugccuccuaggucugcaccauucuucugccucacccucccgaguagcugggacuacaggcacccgccaccacgccuggcuaauuuuuuguauuuuuaguagagaugggguuucaccuuguuagccaggauggucucaaucuccugaccucgugauccgcccaccucagccucccaaagugcugggauuacaggcgugagucaccgcgccagcccccacaacuuuuaaaugcuuccagcugggugucguggcucaugccuguaaucccagcacuuuggaaggccgggguggguggaucaccugaggucaggaguucaacaccagccuggccaacgugguaaaaccccaucucuacugaaaauacaaaaauuagcugggcgugguggugggugccuguaaucccagcuacucgggaggcugaggcaggagaaucgcuugaaccuggggggcagagguugcagugagcugauugcgccacugcacuccagccugguugaugagagugagacuccaucucaaaaaaaagaaaaaaauauuuuuugagacagggucucacucuguugcccagccuggagugcaguggugcagucagcucacugcuugcucgaccuccugggcucaagcgauccuccugccucagcuuccugauuagcugggacuacaggugugugcgccaccaagcccugauacuuuuuuacuuuuuguagagacaaggucuugcuguguuacugaggcuggucucgaacucuugggcuuaagugauccuccuugccucagccucccaaaguguugggauuacaggcgugagccacugugcccagugaugaccuugauagcaaaauaauuuuuuggcccaagcuccaauccaggaucacacuagugaucugguuacuaguuuccuuuagucuauaauaauuguuuagcuguucuuugucuuucaugauccugcuauuauuauccuauuauuuugucaaauaacccucaauuuggguuuggcucauuugauuuagauuauacauuuuuggcagaaaaaauuguaaaaauguauaauugcaagcguguaaucacaucacacugaaaaauucuucauuugcugguugcgguggcucacaccuguaaucccagcacuuugggaggcugaaguggguggaucacuugagcucaggaguucaagacuggccugggcaacauggacaaaccccaucucuaccaaaaauacaguaaucagccaggcgcgguggugugugccuguggucccagcuacuugggagguugaggugagaggaucgccggaccccaggaaguugaggguguggggagccgagaucgcaccacugcacuccaaccugggccacagagugagacucagucccucaggcuggaugcaguggcacgaucucagcucacugcaaccucuaccucccaggcucaagcgauucuccugccugaacccgggaggcagagcauccugcaaccuggcuuccaccuccagucccuauacccacaguguggagccaaauaucuggauuugaaacuggcucugcugccuaccagccgugugacccugggaaagucauuuagcuucucucagcuucuucaacugugaaauggaaauaauaauaguaucucccucaaggcauuguuguagggauugguuccacguggauaaugcccuaacaggaaauguuccuguguuaucaccaagugaagauggcuauggaguuuggccuggaggcggggguugaggguggagggucggaagucuucccagagcaugcccacagagagagaggggcaguaggcauucugguagaagggaccacccgacccuucagggggcuuggaguuggggucaguguuuggugcgggagccuccuggaaggccuggcugcagggugccaggacauccugucaccagcugccccgccuuuucccgcucuccccuccucacgucagcagccuuucuccuaaggcacccuaggaucaggaggacccuguccuccaacccucuaucccccauucccaggcaccuggcguccucgcagaucaaucguguuugcgagcuggggggcugaggaguuugggcucauuggcuccacggaauucacagaagugaguggcccuacaggguaggggaucgaaagggguucccaggacagaacggcgcggggcugacgucgccccucgcacccgcaggaguucuucaacaagcugcaggagcgcacgguggccuacaucaacguggacaucucgguguuugguaugugggugguggggcaggaaaggggaggagacggcgggacgacuggguggguaaaagaaggggcuggggcccaaauagucuuucuccccuccucccacagccaacgcuacccuuagggugcaggggacgcccccuguccagagcgucgucuucucugcaaccaaagagguggaagggggcaggccgggcggggcugaacuagcuggggcgggccgcgugcggcggacggggccgcuacgggugggcggggcuggggagugguacucucuagaucugcuggggcuggacugaggcuggggcaagccucguaaggacuggaccacgggugggcaggagaccgguggagaacccgcccuguuguuggggcuggggagggccgcgcaccgagacuaaauucuccuuccggccagauccgcucaccaggcccuggcgaccugagcaucuacgacaacuggauccgguacuucaaccgcagcagcccgguguacggccugguccccagguaagcccagggacagaagggggcccggagcgaggcgguccggcccagcgcucuuuaucccggcccccuuccuucccgcagcuuggguucucugggugcuggcagcgacuaugcacccuucguucacuuccugggcaucuccuccauggacauugccuauaccuaugaccgggugagcaggcgccccuccgucccugccucgguaccuugcugcaugcgcccccuccucucuuuguggcuguucucauacagacugaacccugcaccuuuacucauugcuaccucugccaaguuucuuaaaaaaaaacacacacacacacagaaauacacacacacguuuuauauagacgaaguccugcuuuguugccaggcuggucuugaacuccugggcucaaaccauccucccgccucagccuccuaaagugcugagauuacaggugugagccuuggugcccggccucugccaaguuuaaccuuuucaagcaccucuuuaugcucaucuauguuauuuuaucaaauguaagauacuacugauuauaagaugugccguuauguuaugcaauauucaggaaaggaaaaaaaaccaccgcuuccaaccaguuguaagauggcauugccugugagaagcauucuguuuccaaagaucuuaaaauguaggggcgggggugggaggggggaaguuaaucucagcaucgauuaacucagaccauuggcgugagcguuggcaugaagguaaaaacaagacaaggggugcagagugcccagcuggcaccucccuguuugaugcuccaaaaaguauguucuccaccucacagccacagcgauucuugguaguagagcugggauuugaaucuaucugaccccaaagccccagguucuucuccuuucugugaaacuggaaacuggcaccagacccagcucuuccacuaauuagcuaugugauaucagcagguuaaccucucugagcuucaguuuccuuuucugugggaauucuagaagccaccucacagacauggccaagauucaguggagauaaugcccacauuuugcagcucacuggagguacaccuucucccacuucccaucccaagccugucaccucugggcuuuguucccccagagcaagacuucagccaggaucuaccccaccuaccacacagccuuugacaccuuugacuauguggacaaguuuuuggacccgggugaggagggagacaaggggcauccugagaccaggacaggagaggcugaagacugagcccuggccuugucaccuugccgcaggcuucagcagccaucaggcuguggcccggacagcggggagugugauucuccggcucagugacagcuucuuccugccccucaaagucagugacuacagugagacacuccgcagcuuccugcaggcagcccagcaagaucuuggggcccugcuggagcagcacagcaucagccuggguaugcacagcccugacccugagguauggggagcccugcacccccaugacugagccacugcuuguuccucacagggccucuggugacugcaguggagaaguuugaggcagaagcugcagccuugggccaacgcauaucaacacugcagaagggcagcccugagugagcaagggcagcgggcaggggcugggagggcagcacccagggcaggauaccaggcugguagcugggcugcuggcuccagggugacuggcaguuccugccuccccaccagcccccugcagguccggaugcucaaugaccaguugaugcucuuggaacggaccuuucugaacccuagagccuucccagaggaacgcuacuacaggugagucugucccagaguccugggaggugccuccagguggggccggacaauggcuccccaccugagacgagguggucagcuucucugcccuuuagagugcaacccagccccugaagaagaugggaauguaaggcucagggaggggaggaaaguugcuugagggucccucugggagcuaggacuggaacccacauuuccucccccgaccgccacugcuguaagagcucccuggccuucagagacaaguggacgggggugcuuuucugccucgcugcguacaggagcugagccaguucuaggcccaggcuucucuuuccuggccccugacugacugacccugauccugucccauuucucuugucagccaugugcucugggcaccucgcacgggcuccguagucacauucccgggccuauccaaugccugcuccagggccagggacacagcuucuggaucugaagcuugggcugagguccagagacagcucagcauuguggugacagcccuggagggugcggcagccacccugaggccuguggcugaccucugaccccagcccucuuucuucagcccucccuuuacuccaacccucuccugccugcuuuccugagauguccuggucuuccuuggugccagaagagggcacuaccacaggacccucucaagcuucucaggcaacagcuugaggucccugaggggaguggcaagcccuaaugcaacucacccucauccuggugcuuagguggcagagggugggcagcaggggacagggaugggauggcaaaaccaccaacugcccuugguggcagguggguggagaugggaugcgugccaaccucagaugccaacucaggucaucaaggccaaggaccaguggcgaaagugagucuugggguaccuuaggccuuggcuagucugcguuccucucccugcaugcuguguauccuaacucccuacaacagccccucaaauaaaucacaucuagugacugguaccaacaaaacaaguuccuuuuauuaccuggaaaccauggaaaaagaaaccuaagugcucuggcccaguccuggggcucugggaggcucacgcucccuccucaggcuggggacccaggucuguccgugcccucaucuuccuccucugccaugaccaccuccuccaggguacguccucgaaguuugcucuccacuaacaccuugcacguacuggcaggcgguagcccuuccuccacguagcgaccccucaggaacacaacucucuccucuccguccaagggcagcccgugggccuggcacaggucccgugcuucccugaguccauccagggccaagagguugaccaugaagcccagaggcaaggucuggcccuugggggugcuaaaggcacgagcgaagcgggccagggcuucccggcgggcauggcccacauggcacugcacagcgcaacuuggcagguagggcagggucuggagcagacggaacaggcgggcagcauugcccucucggaaggcagcaucuaccgccaaggccuugcggaggggcgggcaggcgcgcagggcagcaggcagcuguagaaccucaugcagggcuuccaccgagccu

SEQ ID NO: 18692 - RNA, 2115 nt, Homo sapiens
aagcaccucuuuaugcucaucuauguuauuuuaucaaauguaagauacuacugauuauaagaugugccguuauguuaugcaauauucaggaaaggaaaaaaaaccaccgcuuccaaccaguuguaagauggcauugccugugagaagcauucuguuuccaaagaucuuaaaauguaggggcgggggugggaggggggaaguuaaucucagcaucgauuaacucagaccauuggcgugagcguuggcaugaagguaaaaacaagacaaggggugcagagugcccagcuggcaccucccuguuugaugcuccaaaaaguauguucuccaccucacagccacagcgauucuugguaguagagcugggauuugaaucuaucugaccccaaagccccagguucuucuccuuucugugaaacuggaaacuggcaccagacccagcucuuccacuaauuagcuaugugauaucagcagguuaaccucucugagcuucaguuuccuuuucugugggaauucuagaagccaccucacagacauggccaagauucaguggagauaaugcccacauuuugcagcucacuggagguacaccuucucccacuucccaucccaagccugucaccucugggcuuuguucccccagagcaagacuucagccaggaucuaccccaccuaccacacagccuuugacaccuuugacuauguggacaaguuuuuggacccgggugaggagggagacaaggggcauccugagaccaggacaggagaggcugaagacugagcccuggccuugucaccuugccgcaggcuucagcagccaucaggcuguggcccggacagcggggagugugauucuccggcucagugacagcuucuuccugccccucaaagucagugacuacagugagacacuccgcagcuuccugcaggcagcccagcaagaucuuggggcccugcuggagcagcacagcaucagccuggguaugcacagcccugacccugagguauggggagcccugcacccccaugacugagccacugcuuguuccucacagggccucuggugacugcaguggagaaguuugaggcagaagcugcagccuugggccaacgcauaucaacacugcagaagggcagcccugagugagcaagggcagcgggcaggggcugggagggcagcacccagggcaggauaccaggcugguagcugggcugcuggcuccagggugacuggcaguuccugccuccccaccagcccccugcagguccggaugcucaaugaccaguugaugcucuuggaacggaccuuucugaacccuagagccuucccagaggaacgcuacuacaggugagucugucccagaguccugggaggugccuccagguggggccggacaauggcuccccaccugagacgagguggucagcuucucugcccuuuagagugcaacccagccccugaagaagaugggaauguaaggcucagggaggggaggaaaguugcuugagggucccucugggagcuaggacuggaacccacauuuccucccccgaccgccacugcuguaagagcucccuggccuucagagacaaguggacgggggugcuuuucugccucgcugcguacaggagcugagccaguucuaggcccaggcuucucuuuccuggccccugacugacugacccugauccugucccauuucucuugucagccaugugcucugggcaccucgcacgggcuccguagucacauucccgggccuauccaaugccugcuccagggccagggacacagcuucuggaucugaagcuugggcugagguccagagacagcucagcauuguggugacagcccuggagggugcggcagccacccugaggccuguggcugaccucugaccccagcccucuuucuucagcccucccuuuacuccaacccucuccugccugcuuuccugagauguccuggucuuccuuggugccagaagagggcacuaccacaggacccucucaagcuucucaggcaacagcuugaggucccugaggggaguggcaagcccuaaugcaacucacccucauccuggugcuuagguggcagagggugggcagcaggggaca

SEQ ID NO: 18693 - RNA, 9004 nt, Homo sapiens
aguuggagcccuggucugcagcugugucuguuuuucuaauucauaccuaugagaguuggauuuccccuggugaacugucuuccccuuccucuaccuagaaaacuacucgcgcuuuacucccagcuuuaaugugaccuccuuuaggaagccugcagauggaaucaguugcaccgugucccaugcuucuauaacuuuuucugcaucccuuugacauagccacaguucaccaucgacuccaaugauccauuccuuucuguccccugcuagauugagggucccagguggucucuaacgcuguugaaucaacaaaugacucagccaggaaucggggcaaggagcgguuuauuucacaacugagugaaggaugaggcccacagccucgguagcagcaguagcagcuccuccccgcccagcccucucuucuugguaugguagccaaaggccaggucaggagccagagagacagccagggcacagcccucccgccaugggagccggguggccacagagcagcagcgggcagcaguagcagcagcaggcugggguggaggagggggaguguuaguuuggccggcugacucccaaccccccauggguaguguuuggugaagguugagggaccuggacugcuagguggggggcaucuggagugguucagucagcugugaaaaugcggcuggaaaugucauccaggagccagucgaugcccggcagcagguucuccccggugacggcgcugcagcccuggaugcaccagugguggcugcggauggaguccagcuccaggaccugggaggacaaaggugcugauggugguggccagugacugcagacccugccugccgucagccccuucccuccccagcccagaggaacuccacgccuuccucaaggcccugcuccaugucaucccauccaggaagccccgccggucccagggagaguuugucagaccccaggggcaccugggcucucuguccaguuccaugccagugcugccccuuagugauguaaaugcagcaugggcuccugagcauccaccaggauccgggcaucgugcuaggagccccacacacccucucucacucauucuccucaagcccucaugagccagggauugugucgaccauuucaccaaggaggaaaccaaaguucagagagguuaagcaaccugccuaggggaacauagcucauaaguggcagagccaagauuuuaacccugcucuuucucacuguggugcuugagcacuagaaucaugguuaaaaugugggcucuggggucagacacaggcuuccugucuauuuaguggcugugugaccugggacaaguuaccuaaccucugugagccugcuucaccaucuguaaaauaauaguucucaccucaugaggugguugugagaaugaaaugaguuaauccaugcaaggagcagagcauacugaaagcacugacuugugcuggcuaccguuagccugugaacaacacaugcgcagcucugccuuccccaggcugugggccaccccaugccuuauuaaucacuggauccccagugcccugcauagguccugccaccuagcagggcuaggcuaauaaaugcuuuucuuauuauuauuuuacuucuuucuuuuuuuuuuuuuuuuugagacgaagucucacucuuuucccacaggcuagaguacaauggcgcaaucuuggcucacugcaaccuccacguccuggguucaagcgauucuccugucucagccuccugaguagcugggcuuacaggcgcacgccacugcacccagcuaauuuuuguauuuuuaguacagacgggguuucaucauguuggucaggcuggucucgaacuccugaccucaggugauccacucgccuuggccucccaaagugcugguauuacaggcgugagccacugcacccagccuuuuugguuauuuuuaauaaaugcuuuuaaaauaaauaaauguaugccccuuucccucagcgagccugucccggggccuggacucaccucgcggauggcguuagaggacagugcuccaggcagguccugcuuauuagcaaagaugaggaggguugcuccggccaggcgcugggggagaaaagauagaggggugggguggggacucagaggacagccugaccccuccucuaauggcccagagcaucuggggugaaggaucgaccuggaagaucaaggugaggccccgugguggugggagaggcccaggagugaguuuguggacguagccaucaaggcuggcccacaugaauggagcagcccugggccaggguucugguuccagccaaccaccacccaggggacaccgcuguccccaugcuccagcuuccucuuccaugaacagggagggguguugcauaagaugaucccugagcucuccgugguucuagacugcuccaaucugaugaccagacaugcacagaggaugugaacucucccucuucuggguucacacagcccuuuaaccguuccacucccgacaggccucacuguccaccucugauucuaguuguuuccacauaugugucugugauugggagagauguggguggacgggucuaacccuugggccuugaccugccuugaccagcauuugacggcccugaucucaucugaccugcuccacccacauaggagaugugugcggugugcccaggacaguccccacucugccugcagaauccccccuuucacucucacaaguguccucauuuucaacuaaaugcaauuuuguagccugaaucaaacauuggaacacaaaaaguauauuaguggaaaaacgugaaauucaaauaaaaucuguaauuaagauaauaguaauucaccaguguugauuuauuaguuuggacaggccacgguuagguaagauggggaagcaagguaaaggguauaugggggaccucugaccucuguacuaucuuugcaaguguccuucuuuuuuuuuuuugagacggagucucacucuguugcccaggcuggagugcaguggcacaaucucggcucacugcaagcuccgccucccagguucacgccauuuuccugccucagccuccugaguagcugggacuacaggcgcccgccaccaugccuggcuaauuuuuuguauuuuuaguagacacgggguuucaccauguuagccaggacggucucgaucuccugaccucgugauccgcccgcuucagccucccaaagugcugggauuacaggcgugagccaccgcaccuggccccuuccuuuuuuuuuuuuuuugagacagggucuugcucugucgcccaggaggcuggagugcaguggcacgaucacagcucacugcagccucaaccuccugggcucaacugauccuccugucugagccuccagaguagcuaggacuauaggugcgugccaccacccccagcugaggucacacagcaaagagucagacucuugagccaggcuccauggccucucgaagcuucauacuggccuuggguuauccucccuaaagcccagugaugugggugucaucaucaccauuucaaggcauagaaacugaugcucaggguagugacguaguaacaccacagggacguuaacucaaucucaguccacagcauguguccugccucuggcaccaugggccucccauggugggggcccagagaaggaagggauccugccucugguuucccucuggggccacgggccccucugggcaucugcugagaaggcagccacacguccauacauguacacaaaggguaggagcugcccaccuccuccaccagcaggcucuggagcucccgcuggcaguccugcaugcgcuggcggucugcgcuguccacuacccagaugaggccaucggugcucucaaaguaguuccgccaguaggaccgcagggacuucuggccacccacaucccagauguucagcuugaaucugggcaaggagcgggugacaggagggucagcugggccccucucccaccuucccugcccugcucugggcuggcccucccauggggccccugcucacccucggugcuccagggucuugauguugaagcccagcguuggggagauggugucgauguccuccccauugaacuucuucaggaugguugucuuuccagcauuguccaggccacuggggcgcagcagguuaaggagaagucccuguucucugccagguggugacauuguugcagagccccuuaggggacucauuauuucccaccauguaucaaacugaguugagcacaugccugaccauaaucggcccacaauaaauaugaaaguaucaaauuauaaauaucaucucuacugaccaaaggcuccuuaauuuguugaacaccuacuaugugccagacccucuucugggugcuagaggacaaagcccugcccuuaggaagcuuacacucuagcgggaagacagucaauaaaguacaaacaaaugagaaaagaaggcccugccagaucccggcuagcgccaucaacacaacagagaggcuuuccaagagggccaucggaggaggcucuuucagcucaggugccggggaaggccucucugaggugucuggagcugagacccaaaauacaaggagcaagcuuuuugaagaacuaagguaagaacaaauaucuggaggcagccacccucauuuguuucuggaauauuccagaccugcuacugcacagugcaaauuaaugggugugcuuaccuguggaaggaaccacccuccucuaucuucccaacacugcagcucaguugggcaugguggggugggcggguccuggacucgaccaccuuucccugcucaucggagcuggggcaaaugaccuaggcccaggagaggggugaggagggcauuuccccugaggcccagccuuagccccuggaaccuagccgcugaugacccccugcccccaagccaucauccauguuuccuuccccucuugaucauucccacuggcugaugagcuugccguucuuucucccaccuuaaaaagagcaaauaggccgggcgcgguggcucacaccuguaaucccagcacuuugggaggccaagguggguggaucaucugaggucaggaguucgaaaccagccugaccaacaaggugaaaccccaucucuacuaaaacuacaaaaaucagccaggcgugguggcgggccccuauagucccagcuacucgggaggcugagacaggagaauugcuugaacccggcaggcagagguugcaaugagccgagaucacaccacuguacuccagccugggcgacucagcgagaccccgucugauuaaaaaaaaaaaaagagcaaacaaagcccuugaucucucugccccaucuaguuauucauuuauaucuuuccuuuuacaggaaaucucaaaauaguuguuugugcucacccccauuucugccuucuugcucuuucaagaacacacucccaucaggcuuuugcugcugcuguggccaaaacuguccuuaccaaggucaguccccaaagaccucccuguggcccucuagugcugggacagcgcucagucaucuucuguuccccacucagcaccugauggaguggcucacccuccuccccagcacaugcgcugcccuuggcacugggacacacccucaccugguucugcuccucaccugacuucauccugguacaaccggguucucuucucuggccacgcucaucccugggugaccucauccaggaucacagcuucaaauaccaucucuauccugauaacacccaaaugugcaccucccacacacuggaccucagugccuacauccagcugccugccugacacuucugggcugucucggaggcaucucacauggcacacacaggcacacacaggguucucaucuccacccugaaccugcuccucccccaguccucuccaucucagcaaaugguuccucacccuucuaauugcucaggccagaaacuuccaugaccucacuacuuccauccugguccaagccaccauccuaucucgccugcgucacugcaguggccuaacuggucugcgauuccuucucuccacugcacuucucacugaaagggaaaaccaaaaaccaaaaggcccuaggugaggggguucccagucaacgcuccuccuccccacuccagccauacugcccuccucaccaguccucugaacacgccaguuaguccucccagggccucugacuugcuguucccuuugcuuuaaaguuucccccccccccgaauugcuauaugguucaacccucgccucccucauguacucaauugucauuuuuuuuuuuuuuaacagaguuucgcucuugucacccaggcuggacugcaauggcgugaucucagcucacugcagucuccgccucccggguucuggcaauucucuugccucagccucccagguagcugggauuaaagguguccaccaccacauccagcuaauuuuuguauuuucaguagagacgggauuucaccauguuggccagacuggucucaaaacuccugacaucaggcgauccauccgccccggccuuucaaagugcugggauuacaggcaugagccacugcgcccugccaucauacaguggccuucuuugaccacccuaaauugcauuauucuccauaccuauauacguagugggaguucauccuggagcaguauaaggcccuguuccccagaagcaugguccaaagcauggcccauauauauauaguauguauggagaauauauauauguauaaauagagacagagucucacuauguugcccaggcuggucucaaacaccugggcucaagcgaaccucccaccucagccucccaaagugcuaggguuacaggugugugccaccgcacccagccucuauuacauauuuuacuuacuuccuguguuaucaucuuucuacccgcgggcaacccccccgccacacacacacacacgcauuacagaauuuccaugaagguaagauuuuuuaguuuuauuacccugggcacuaggacagugucuagcacauauuaggcacucaauauuuaucaaaugagugaacuguaugcuuuucuuagagcucuuuaaagcagacaugcggcccggcgcaguggcucacgcccauaaucccaacaguuugggaggccaaggcggguggaucacuugaggucaggaauucgagaacagccugaccaacaaggugaaaccccgucucuacuaacaauauuuaaaaaaauagccgggcgugguggcgggcaccuguaaucccagcuacuugggaggcugaggcaggagaauugcuugaacucggggggcggagguugcagcgagcugagauugugccacugcacuccagccugggcaacaagagcgaaacuccgucucaaacaaaacaaaauaaaacagacaugggccggacuccguggcucaugccuauauucccagaguuuugggaggcugaggcaggaggaucacuuaagccuagaagcuggaggcugcggugagccuugauugugccacugcacuccagccagggcaacagagcaagacccugucucaaaaaacaaaacagucaugaugugauuauuaaguuauaugugcacguaagcgucuuaucuccccagccauucccccgcggagccuggcacagagcugggggaacaggugcgggcgccuaacuggacucagaaggcgcacagggcgcacgggacacucgggcccacacacacacauccucagccgcagggacaaccacgggccgcguaacaccaaagagacggacuguuggauccacgcucgaaaggauccgcggagcccacacgcgccacccgccaccccgcacgcccccgggauucggagcucgagggcggggccggggccuggaacccucgggcccgggggaggagaucagagccgggagggcagcggccccacgcuugggccaggccgccgggugguggcguccgaguuaucuccgggacccaccaccccugacacucgggccgccuagccccgccgcugcgccugcaggaccgcuucugcggcccucggagcuggccccugccccaguccuggggugcggcuccucccggcccgacggggcgauugauggggcccgcguggugacgccaggggcaguugggacgcgccggccgccgcguuccgcucccgacagggggcgcccggcaccgccugcccggcuggaccccgccacccucgcgguuccggcguccgguaggauacagcaugagcagucgcagcucccgcucuuucugcuucaucuucuucagaauggucaggagccccaugguccccggagcccccucccggccgccguuucuucccagucccgggaccccgcucccgguuccuguuggcuaucacgcucgccgacggcauagucgauuggccggacgcucguuuggucccgcccuugccgcacgugaccgcgaggucgcccgcgcagcugcugcgagggucccucuagcggcgcgggggguuucugugcugccgcccgcccugacgcugcgccucccgagggcugaggcugggggagcaagggcgacucccccacccuuuccccugccggacuggggcucuuggccggagcggaaaccuugaaguuccugaguugcaucuuggcugcgucugaccugagagucagaacccagggcccccagguacggacgaacucauccuggggccaguguaggcccccguucccagcaacacaguccaaauccugcucaucugggcccucggcaucauccucugacagagcggaaaguugggccucccccuacccggcuccgguggcucucaguucagggcggcggugcccccuggaggccguucggaaacaugcggggcgucccuggguuccaaugacggaauugcagucccgccccaaaggcugcccccacccagaggcccagcguuucccuguucagaagcacaguuccuacuuuugcagauggaaaaacugaggcccagauggugcuuagcacagu

SEQ ID NO: 18694 - RNA, 1424 nt, Homo sapiens
uucaagaacugcuugcuuuauuuagggguaagggcaaagagggaaguaaaaugaugaaagauugguuuagaagggccaggcagaggcagggaagaagcagaaacuccccucuucucaggugacagucacaaaaucuuacaaaggaucaaagcuggaacaacccuccccuuauuuaaaaaaauuccauagcaaguaaccaucagggcuggagcuccuuccaguuuuugaaucuugaacacagguuucccccaccagaacgucaagcccugugacccaggggaggaaggaggggagaggaugggcuaguagcgagagaggcgacacaugucacacuggcaggcccuggccgugaagaucucgagcuccucccuccggcuccccacacacugcagcuguacuuugaccugcgggagaggggaguccgugcugcaguccccuuucucagggcugucuaggaucuccaucucucuggucuucccgcgaccccagcguccauccaccgggcccgggcccuccucaccuucuucaggccacugauggugcagcacugagagacggaggugauguugugucgguaaccacuggccaccagcacagaguaccgagaagggaaggcgcuggacucacaguggcccacacaggccugugccacgugggagcccuggcaggugccuuggcggucacuucgcacugucacauugaaggcuagaaggagauaggcaagcaguagacggcgccucugccaagguuugccucgccccagcucccguugccugugccucaguguggggcccuuuagggugcugccugccccaccguccacucagcucuuugcucccacccagaaccuccacugcuccuagcccuccggucccagagguacucacggugcaaguggcagccugggaugacugccuccuggccccaggcuucagugacugccaggaccagcagauagaggaccaggguuugaggggacgccauaggcaucugaaacacaguggggagaugucucuacgugggugugcaggugggauggcgaguucuuuaaauacugcauuccaggugagugagccagggcuggcuggucugacaggugaggugugccugaauggugcugccuuuucccuguaucugccuuuguguguguguguguguguguaugggugugagugugagcagcugucucuggaaaggaccugugugucagcccucugugcagugauucucccuucccuggaauuuucuucgccaucuggagcgcaaacaucuuccucccuccaucugccccaucuuggccugcagggcccucguccacauucccagacccuccccagagcuccuccugccucagcgagcucaccacuuccgaggcccaggaacagagcggcuugcaguuuuccugugccuccugcuggucucca

SEQ ID NO: 18695 - RNA, 10174 nt, Homo sapiens
ggaggugcgggccggguggggggaggugacuugaugucauccugagcagcugggcggcgggugccggugcgcacggagccgagccggggcucccguugcgcugcaccgcguugggucggagucccaggacuucagcggagauccgcgcgcugcgacggccggugcagagcccgccgagcgcccagucccggcccggggcugaguugggggcaugcucuagccgcccccccggagcccgggagagaacccaggagcgccgccgcccagccccagcgccccgagcggaaccgcugcgaaggggcccugaacggccgucgcccucccuacgggcagcccccggggguuggcgaccgaagucuagguuuucgagaagugagugucccccaccccaugagguuuggggggccaggaaggaggagcugaggugggggagggugccagguucuaggagcgggguggcaucgggacagcaccuccagucuugggguugucccaaguggccgggauuaguggagcagcgaugcguuccauucugaaaggggcagggaugacgaucggggcuccauucugagucggggcuggcuugggggauaggcccuauucugggagggguuguuuuggaggcuuucugucugagagaagggagggacauguccaggaugggagggggcugcaccccuauuuuagggucugggcaaggauaggagggaaaagaccugggcacuccacgcagccucccggcucuccugaggaacugaugggcuuucucugucucuuucuugcugaucuuucugccugacuucguuuucaaaagagccagggugggaacccuaacuggacucuucgggacccccaggaaggaucugaggccugagccauccuccuuucuacccugucugccccccaggacugggcaguugcaggaggcccugggggggggcccaggacugugguugugccccccccccaaaggccggacaggaugggaccaaguuagucuguccagucucacccagcaccucccaggcccagagagaacccccggggcucugaaagcuugcccugccgccugaccgccauggagacgaagcugcccccugcaagcacccccacuagccccuccucccccgggcugucgccugugcccccacccgacaagguggacggcuucucccgccguucccuccgcagagcccggccccgccgcucccacagcuccucucaguuccgcuaucagagcaaccagcaagagcucacaccgcugccccugcucaaaggugagcuggcugcuggccacugggggaaccgaacccccgaggggaccagcagggccauggggaggggugggaggcagcgggcagcugccaagagagagaguuuggauaccccuccaggcuagguucuccgccaucagaacugaccccagcccuccagcccucucugcugacacauggccugacuggccugucauccuuagaggugggacauccgaagguggugccacccuaggggcagaccaaggccaaggguggggcccauagccuggguuccagggggccacuaucagcccagccagcugccagaucccuggagcaggcgcuuggcaggguucccugggaucaccacauaggucccuuccccagccuugggccauagggccagacuggccaagccugaggacaccguagagauccuuggcccugaaccccuccccauuucuggcccuuagaacagggugccaccugagagggaggcagcagcuguuuggggcaccuguggaaagcugcugcauccaggauuugugaucuugcuuuaaaacucaggccaucauacucucugagccuggauuaggaggaagaaaagcaacccucaacccccaggaauggaggaagggacaguaguuguuugcugucugcaaggagcaggagauggcacaagagcauggggccugggggcagcagaggcagccguggagauuaggagggucugccccacccacagcuggggcagcugggggagcuggggcccaggcccaggaugcccucuccuccccagaugugccggcuuccgagcugcacgagcugcugagccggaagcuggcccaguguggggugauguuugacuucuuggacuguguggccgaccucaaggggaaggaggugaagcgggcagcccucaacgagcugguggaguguguggggagcacccgggguguccucaucgagcccgucuacccagacaucauccgcauggugagcaccugccacccaggcuccgagggccggccgagagggcgugugagccccguuuccuguccgcaggaccccugcguggagaauaacccuguacucaucggcuuggccucaguccacgucuuccuuccccccgaccugcugcugcccaacacccacugaaugccuccgggccugccccacguccacaccuuugcuuaugcuugccugagaccuggagugcccugccccacaccccauaccauccauggccuggcucaggugccgccucugccaagaagccgcugucaauaaccaagcuggaaaucucccuuuuccugcccguagaccucacagcuucuagccuuguucuccccacuggauugcaccugccuagaaggcagggaugugucccauucaccccuggguucccagccccuggcccagggcuugcacgaacuaggcguucaggugaugauugcccaaggaaugaacugcuugcuggggcagaugcugaaaucaacccauuagaacuuugaaugagggccgggagcagcagcucucaucuguaaucccagcacuuugggccaaggcgagaggaucacuugaggcaagggguucaagaccagccugacagugagaccgcaucacuacaaaaauuuaaaaauuugccgggcauaguggugugcuacuguaguccagcuacucagaaggcugaggugggaggaucgcuugagccugccugggagguugagguugcagugagucgagauuguaccacugcgcuccagcuugggcaacagagcgagacccugucuugggaaagaaaaaaaaaaaaaaagcuuugaaugagagacucccuggcuucugucuucaagggcuuuuccuuaaugaaccccaacucugccacucagaucucagugaauaucuuccggacucugccgcccagugagaacccugaauuugacccugaagaggaugagcccaaucuugagccuucguggccacaccugcaggucugaaggguuggggaagacagagauccaaguuucagaagagauccaaggcauggggagagggccuccuuagccccuagacaguuggaugagggccauaggguggaaugagugggugaggcuguuacugaacucaccuuuuugucugucccccucccccagcugguauaugaguuuuuccugcguuucuuggagagcccagacuuccagcccuccguggccaagagauauguggaucaaaaguuuguccugauggugaaguggggagcccaggcugggugguaccacaaggcaggggcaggcucucugaggggccagggauaggauggaagcaaccugggguggaccuuuccccugacccugacccugacccugacucugguucccacagcuccuggagcuauuugauagugaggauccccgggagcgugaguaccucaagaccauccugcaccgggucuauggcaaguuccugggucuccgggccuacauccgcaaacagugcaaccacaucuuccuccggugaguggcugcugccugcccagcagagaccuggggagggugagagggcuguuagaagacugcggcaaaggccaugugcgguggcucacaccuguaaucccagcacuuugggaggccgagguggguggaucaccuaaggugaggaguuugagaccaaccuggccaacauggugaaaccccgucucuaauaaaaauacaaacauuagccaggcaugguggugggcaccuguaauuccagcuacuugggacgcugagacaagaauuacuugaacccaggugaaaccccgucucuacuaaaaauacaaaaaauuagccgggcgcgguggcgggcgccuguagucccagcuacucgggaggcugaggcaggagaauggcgugaacccgggaagcggagcuugcagugagccgagacugcgccacugcaguccgcaguccggccugggcgacagagcgagacggaugaacccaggagguggaguuuacagugagccgagaucaugccacugcacuccagccugggcaacggggagacugugucucaaaaaaaaaaagaaaagaaaacaaaaaaaaagaagacugcagcaaaggcuccugggcugcaggggcccuuguagaacuucuguuuuccaagcccuuucucaguaacguauuacauauugauuauacaaagccugugaaguugacagagaauggguauuuauuuccauuuuacagaugagaaaguagaggccaagagagaugaaaugguuugcagggacugggucaguccaggggccuaggagcuaaaucauuugacccuuaucaugccaggccauaaggacccagagagagauucuuucugcaaacaugcacugagcaccagcacccacugggcaucaaggcucacguggccuuguaguugagaccauggcucugaagcuguauggccuacauuugaguuugguuccaacguuugggugaacuuuggcaaauuacuuaagcucucuccuaguuugcucgucuuuaaaaugggaaugcuggcugggugcaguggcucaugccuguaaucccagcacuuugggaguuggaggugggcagaucacuugagaucaggaguucaagaucagccuggccaacguggugaaacuccgucucuacuaaaaauacaaaaauuagcugaguguggugguaaacaccugcaaucccagcuacucaggaggcugaggcaggagaaucgcuugagccugggagguggagguugcagugagccaagauugcgccacugcacuccugccugggcgacagagcgagauuccaucucaaagauaagauaaaaauggggaugcugcuuguacuaacucagggaccauuaucgaggugacauggggccuugccugcaaagcacucagcauagcuccuggacugaggccgggacucugaaacauuaguuguuauuagcuacaaaaugggugagccaugaucccuguccuccugcaccuuggaguucauuagauucccugccuauuaacauugggguuguuuuauuuaaccgcugagucuugauuucuucauccaugugauggauuucuuaagccccaucucccuggauaauucugagacuuacaugguacggaguagaugugcuaaguguuugucauucucuugguugacuggcaagagagccuugagcuugggacucaguggcagagguggcugggcugagaagggcauuucagugugggggggcggggaucucaauggggccugguuugggauguugggaagggagcgcagccucuggguugggggagaguuggaugagcgugccgugcaggugagggugggcaggcaggaugccuaagggggcacugggccuacccugcuugcuuugagcccaccugcguucuucucuugcagguucaucuaugaauucgagcacuucaaugguguggcugagcugcuggagauccuaggaaggugauucucccugggccucagcuggagcucaggauucuggaaggagggacuggggccaggucaccugagcccucuuccucucuucugccuccuccucagcaucaucaauggcuuugcgcugccccugaagacggagcacaagcaguuccugguucgcguccugaucccccugcacucugucaagucgcugucugucuuccaugcccaggugaggcccaggccugucccugcugcagcaggagcuccagacagucagggcagccaguggguccuggaggucagauccuccagggauccuaucucaccuucuuugucuuuauaauucuguuccaucuaccuuagaaaauucccacuggcgcuuuaaggcuaaccucagauaucagcucugugaagccaggcuuuucuucucuacccucccuuggcagaauuacauucuucuccaucuauauucccaaauauuuggauacacaaaucuauuaugggagauuuugauacacaauuuuuuuuuuugagacaaaaccguacucuguugccucagcuggagagcagugguaugaacauggcucacugaagccucuaccugcugggcucaagcaguccucccuucucagccucccgaguagcugggaccacagauguaugugccacaugccuggcuaauuaaaaaaaauuuuuuuuuuguagagacagugucuugcuauguuaccuaggcuggucucaaacucccaggcucaagugauucugcugccucggccucccaaagugcuuggauuacaggcgugagccaccacacuagccauauuauggaaccuuuugcaaaauuuauaaagaugaguuuguugacuguccccacuccccgcgagaucagaguuguauucccagcacacugaaugugaugccugguacauccuaggcaggugauaaaugcuuggugaauaagaaaguaacaggccgugggugagcaguauuuggcauucuguccuggacagcaaguccuuggcgccuggugccuuccugaccugucuuccuucccuccaccugucacccccugcagcuggcauacuguguggugcaguuccuggagaaggaugccacucugacagagcacgugaguaccucugggggcuaaggcagccucucaccucugcaggcgugacuccugucucaucucccacaggugauccgggggcugcucaaauacuggccaaaaaccugcacccagaaggagguaugaagaagggcuuugaugcccgccagagggaggcugggagggcucggccucuagaaggcagucagguguguguauguguagggggagaugugagcugcugccccucugucccuacuccccuccccaacccacccaggugauguuucugggggagauggaagagauucuugaugucaucgagcccucccaguuugugaagauccaggagccccuuuuuaagcagguggcucgcuguguuuccagcccccauuuccagguaugaggcaggacaggcggggaugggagcagggcuggccuggaaagguuggguagcugaccuaauaaagcucccuuugcccucaguuucuccuccaaucccgggucugguaauggggagaugcuggacuuagggucaggagaccuagggugaagccucggaccugccuuccacuggcugaggggccuugagcaaaucacugcaccacucugauucugauuaagcuuccgcagcuguaaaaugggccaacaaccucuucacaggguggggauaaggauggaagagauugugaguguaaacauguuugguaaacugaagugugauccagaaugugauggaggacuguuaucacuuuuccccuuuugcuaguggccuuagauuucauuagacucgcuuugggaugcagccaggcuuccccgcaccaacccagcuaacuaacucauguucugcugcaagcaugugcagacuuccucccguucuuaugggccauaacccaguggaagucaagucuuccucacagugauucuggcacuucgguucauuaaacaccuaaaagucuaguaucucauuugauucuuauaacauccuguugagauagguauuauuagcccauuuuacagaugagaaaacugaggcugggagguuaaaugccucucccaaggucacauggcauaguagagucuguagugguuaggauucaccccgcagcauuggauuccguaucuagaacucuuuucccuucaacacuguugcuuccuccagggcucagauaagcccugaagguggggugugugaaggucagggggccugggcguugagguagugauggacaccagaccuugcacacagagagaagccacugccaguuaaucacucugccaucuugucugccccagguugcagagcgggcucuguauuucuggaacaaugaguauauccuaagccucauugaggacaacugccacacugugcugccugcuguguuugggacccucuaccaagucuccaaggagcacuggaaccagugagugccaggccaugaccuaacucacagaaacugggaccagggccagccaguccagacccgaccccaggguuacuccuagcuggagaauaucagagaaagcaucaaaagauggcccagggguggugaaaaggacaggaaagugggcagugcuuguguucagguggaaugcuguaugugaagggcagggaaagggagaggugggcaaaccaaagcuguuucaucuccucaucccuccuugacacugccaagaaccaucguaucacugaucuacaaugugcucaagaccuucauggagaugaaugggaagcuguuugaugagcucacagccuccuacaagcuggaaaagcagcagugaguguugggggcugggcgugggggaagggagaagagcagggaggagucagacccccauggcuggagggaacccgaggacuaccccaaacucugucugaucagaugcugcaagacuguccaugcuccugccauccuaugccugacugucugccccuguauccucccgucauucuucgaguagcucagacuuguucugacucccuguagcuuccuacagaagccagaaccacucaggccccacccgucaucuucucugugacugcaggcugggaucugucuguccucugcucucuucccucaguagaggguuuuuauggagucacagaacaaaaaugguuccaugccuucccuuugccgguggggugguagugagggagucuggacugugagggagucuggacuguggggggccccaggaaagggagcugccucacccucucuccccagggagcagcagaaggcccaggagcgucaggaguuauggcaaggucuggaggagcugcggcuacgccggcuacaggggacccagggggccaaggaggccccccuccagcggcuuacaccccagguggccgccagugggggucagagcuagacagcaccucagaaggggaaaagcuaaacccagagcugucagucccucuaucccuucuccuguccaggggcccagagagaaacacaccuaccccuggccuugccagaguggcuucugaggacucccugcccagcccagcuuucacuggggggagacgaggagaggcaaugguggucuuggcaacagaaugcucagccccucguggcaggacuugacaagggcaagcuugaccaggaagcugccaucagggaucuuccccugccccgcaaagcuaggcuccagcugcaggcgggcucccacccucugcuccuggccuugggcaagggcacucagcgccucgccugccccugccuuggccaaugcgagguccuuccuuauccccaccaugggguccauggucuauuuauucucgcccagcucacccucuacacagacacuguccugggugcacacuccucccuucccucgcuguguacuuccuuguccccuuuuuauuuauugggcagggggagggggagggcacaggcaagaagagauucacaguguccugggguaaggggggguucacaguaaucauggucuacuccucuuuccguggcuggggguagacuuaauaaagagagaaauucaagaacugcuugcuuuauuuagggguaagggcaaagagggaaguaaaaugaugaaagauugguuuagaagggccaggcagaggcagggaagaagcagaaacuccccucuucucaggugacagucacaaaaucuuacaaaggaucaaagcuggaacaacccuccccuuauuuaaaaaaauuccauagcaaguaaccaucagggcuggagcuccuuccaguuuuugaaucuugaacacagguuucccccaccagaacgucaagcccugugacccaggggaggaaggaggggagaggaugggcuaguagcgagagaggcgacacaugucacacuggcaggcccuggccgugaagaucucg

SEQ ID NO: 18696 - RNA, 22755 nt, Homo sapiens
cguccggaggcgcggccuggcgccuagagaagcggcggggcgagccgggggcucuagugaacagcggagccggacggggaucgccggcgggcggcaagcggaggcggcccaggcccggcggucuccgagaugucacgauggcuguggccauggucaaacugugugaaagagcgggucugccgcuacuugcugcaccacuacuuaggucacuucuuccaagagcaccucagccuggaccagcucagccucgaucuguacaagggcagcguugcccugcgagacauccaccuggaaaucugggugaggagccaggcccgaguccaggaaggugcggagggugggagcgcagcgaccugaggcucccugcggcaggaucgggcugggggaucaggcaccgggcguagagaggccaggggaaucuugcccucuccaggcgucagaggcaccccggcuggccucuucaguuccuuaccagagccagaaacugagcgggaagggguuucugucuccacgggaggagaaacugaggcuggagagggcaagaucaccugucuggagaaugcaagacaaacucgucgaguuugggggcugaguuaaggagguuggcucucgggcugaggaggggcuggggagggagcguaggaacugagcugggccagggcagugacagacuugggccugcgcagcuggugggggaagcugguagggguccggagcccuggcgaggacaccuguggaucaugugcccugaccucuugaccccacgguccugagcccguaggugggaucaacaaaccaccggauguguaugucaacaaccgcgucaguacgucaguaccaguguugaucaacaccucgugugccugggucgcugccuacuuccugcuuuugggagagugggaugggccaagugggugucuagggagggacuggauggcccccaccuacaucucccaccgacccccccggcucagugucccugccuggagggaggcccuggaggaaagguggggagaucuggcuucaagccgggaggaggccaagggagaugcuagggaggccaagagguguaaggucagaggcuugaggcugggaacggugaggagcccugacucacagcucagcugaccuggggagcuuugaaggagccaccaauuagaggcgcguccuggucgauccaccagguccagagcagcaggggugggcauggaggcagggacuucucaguuuuguggcuggacucagggggcugcuaaucugggcagaagagcuaggcuuuggggguaggccaggcccuggugagcaaaugugggguaggauaaucgugggcccugaacugggggcaccccccaguggccugcugucugugaauucugguguaggaagcccucucugaccucuaaccuuagccucagccucuaaggccgucucuaggcugccccuuuuuuauuuuuauagagacaggauuucgcuauguugcccaggcuagccuugaaccccugaagggauccucccaccucagccucccaaagugcugagauuauaggcaugaaccaccauacccagcccuaggcuuccccuuuuuacuuucagcuccagaaaacgccccuacuccuguucccugcccucuuguuggggauugaauuggcuucucuagggcccugguggaaugcaggcgcuuucuugauaaccagccccuccucccucccagcucagccugcaggccccgccuugaaggcccccaaagaaacugaguaucuggggccucugaaguggcaugaaaagaaagaggcccgcaucccagucucagucccuguuguauacugggugacuagauuaguccugucucuaggccucaguuucccgagcugugggucucugggugaggaauuuggacucccaucugcucugccaugugcuuuuuuauucuuggauccaaccaguuuacugaggcccuuucuggguggcaccuggggugacgggggaggcaggugggguacagcccuccaggagcuuccagguuggcagggguacaacuccagcauggacauuuuagccaggggcucagccuugugccucacagagaggcacagcuacacuagguguuugggguuggugguggggggggggggucccaucuggcauuaggucagccccucucuuggacacugucccuuugaacucugcucauccagggugaacauggguauucuggacucugccauacaugugcccauguuguccugugccugcaacacaccaccuucuaccagcgccuauccccccucccuuuauucuucagcuugccccuccucugacggcccaggcuggguuaggcgucuuccccacggcccccccaccagcccccucaccacccccaagcaccugcucaccucuugaguuucauccuaguugcucugagucccuggcuggagccuagcuuggcuggggaaugaagacauuuuauuuacccaucuagucucagugucagcauguagaaagugcucgguaaauauuaucuugaauuaaguggugagggaaacaucugcucuggcuugaaggauuaggcaccuuugggugacgggguaggggggcuggccuguaguaggggacagcaugagcauaggugggaccuuguagauaacacguggagggacagggcaagccaagggugcucuccaaggcacuauggccagauaaggcugugccagccugugggauuugggguuucccugagcugguuuugucucuugcuugcucccagucugugaacgaggugcuggagucaauggagucaccgcuggagcugguggaaggcuucgugggcuccaucgagguggccgugcccugggcugcucugcucaccgaccacugcacagugcgcguguccggccuccagcucaccuugcagccccgccgggguccaggugagggcagggcgaggcugggggcaggcaaguggggagagugggcuggggcguccaggaccugacugggccugccugccuugagacccuguuucucccuacagcgccaggggcugccgacucacagagcugggccucaugcaugaccacaagccugcagcuggcccaggagugucugcgggaugggcuaccggagcccucugagccaccacagccccuggaggggcuggagauguuugcccagaccauugagacuggugagcaggccccuccuggccgcccugucuccugcccuucaguggcacacagaacaggggcuccagacaacggcacggccacccuggugcccagaugggaaauucugccuccccuuugcugcucuaccugaccugagaccccuccccaacuccucagugcuucggaggaucaaagugaccuuccuggacacugucgugaggguggagcacucuccgggugauggggaacgugguguggccgucgagguccgugugcagagguaagggcaggccgaucugggguggacuggugugaagauggggagugggggcugcuggaugguccccacccgcagccuagguuccugggaagaggcaggguggaucuggaugggccucgguggugguaggguuggggaggugggcugcaucgugagcccggacugguguccagaggccaggugauacaggcccagaguggccgaggccccaagaaccaaguuagaugcugagggucugaggagcaagggcuggccugagccuccgggcuggacauggugguucaggacggccuaggugugauggggcagcucugcaggcuaggcucccugaccccgugccccuagagcagagcacuguguggagagaggggcuccaggccugggguggccagggcacgggcugacccuacacucuccagacuggaguacugugaugaggcagugcgggacccaagccaggcgccgccgguggacgugcaucagccgccugccuuccugcacaagcugcugcagcuggcagggguccgccugcacuacgaggagcucccggcacaggugagcgggcucugauucccacagccccugucuccucucccuugagcccauugagccccucccauccuuucugaccaucucugacuccauuuucucaaccuuucccucuuguauccucccgucucccaggaagagccuccagagccccccuugcagaucggcagcugcucaggguacauggagcugauggugaaguugaagcaaaaugaggccuucccuggccccaagguggguccccaggccccuggggagggggugaguaccccaucucaagacuccuccuccucagcaaggcugauuaucuacagcccacaguggggaugucaagugcgggauuuacuuccuucuuggcagcuaaagaaacugaggcuguaggccaggcacaggguucacaccuguaaucccagcacuuugggaggccaagguggguggaucaucugaggucaggaguucgagaccagccuggccaacauggugaaaccccgucucuacuaaaaauacaaaauuagccaggcgugguggcacaugccuguaaucccagcuucuugggaggcugaggcgggagaaucgcuugaacccaggaggcagagguugcagugagccaagauugcaccacugcacugcagccugggcaacaagagugaaacuccaucucaaaaagaagaaaaaaagaaacugaggcugagaggucaaguuguggccugguucauagagcuaguugguaacagaguuuaguuugguagccagcauccugcuuucccagggcgagggcaggcgggugguagcucuuagaggagcuggguggugggccuaggcuccauggcugccuccuuggcccccaguuggagguggcgggacagcugggcucccugcaccugcuccugaccccgaggcagcuccagcaacuucaggaacugcucagcgccgugagccuuacaggugaggccccuggguggcaugggggugggguggcugggagggccagccagcccagacugaagucuccuccccugcagaccacgagggccuggcugacaagcugaacaagagccgcccgcuaggugccgaagaccuguggcugauugagcaggaccugaaccagcagcugcaggcaggggcaguggcugagccccucagcccagacccccuuaccaacccccuucucaaccuggauaacacugguggguguggggucagaccgugguuggaggggcagcuagugugggugcagcagccuaggggcuggggucggcugucccugacacuccucacuucacccacagaccucuucuucuccauggcuggccucacaagcaguguggccucagcccucucugagcucucccucuccgauguagaccuggccuccucugugcgcagcgacauggccucccgccggcucucugcccaggcccacccagcuggugaguuggagcacccuggggguacuccagggacaggaaggacuggaagaggccuuagugccgugggcugucagaggcacacaggaaauccccagcgaugccuggauaucuaccaucugugacuugguucccuggggaccaaacaaggugggagcuggugauagaguggacagagccuagguuuuucagucauugaucuuagucaagcacuugaacucucugagacucagcuuccucuuccauaggaagagaagggugagaucagccuuugccaggcuguauaucuggguucauguuuauugagagcuuauugugugugggugcuaggcugggugcuuuaucacauccuguccuuccagcacccugaggaggguucaguugagccugggcagaaggccuggucuacuggaggcaccagugucaccccugccugaccaagccuucugccagagccacaugguggggcagaccuggccucccaacccccagccugguggcaaacuauugcuccaccugggguacccggaaucuguugggagccccugcugaagccucuguccccucaggcaagauggcccccaacccccuccuggacaccaugcgcccugacucgcugcugaagaugaccuuggggggugugacccugaccuugcuucagacgucugccccaucuuccggaccaccugaccucgccacgcacuuuuucaccgaguuugaugccaccaaggaugggcccuucgguucccgagacuuccaucaccuucgaccacgcuuccagagggccugucccuguagccauguucgguauaagcccgaggccagggccugaggagagaccaucagagcccccuaagugcaccuucugacgccuguccucuuccccgcaggcuaacgggcacagccgugcagcuguccugggagcugcggacgggcagucggggccggcggacaaccagcauggaagugcacuucgggcagcuggaggugcuggagugucuguggccccggggcaccucugagccugaguacacggaggugagggcagaggcagaauguguacgaggcggggucuggagguuuggguggcuguggggccaggccugacccugugugccucccgggucccaucccagauccugaccuuuccugguacgcugggcucccaggccucagcucggcccugcgcccaucugcgccacacacagauccugcgccgugugccuaagguaacccacccgcuccaggccaccaggcuguccccauggcguguugaccccacccuggccucugccagggccuccucugcugcccagcccugucccucuuccccugugcuccacaucucuccaugcuggggcccucaaauaccugccuggcccuuccuaugccagucucugagccuggucaugcccuugcccuaucucaauauggcccccuggcuggccucuguugcuaagaguggcgcaugucggguggcuuuuauaaguaaacaagcacauugugcgcgucgggcaaagguggggcaggccuucuuagugcucucguggccccugccccagcucuucucccacuaccagagagggccuuccugucccacccgcugaguaccacucagcccucacugaccugaacgcccucgcccucagagccgaccccggcgcucaguugccugccauugccacucagaacuggcccuggaccuggccaacuuccaggcggacguggagcugggggcccuggaccggcuggccgcccuacugcgccuggccaccguaccugcugagccuccagccggccugcuggugagaggccccugccagggccaggccgggggugggugcagggccuggguccuucggcucuuggucacagugggaggggcuccgacggcugcucugacccccaauccuccugcagacagagccccugccggcgauggagcagcagacgguauuucggcucucugcaccccgggccacgcugcggcugcgcuuccccauugccgaccugcggccugagccggaccccugggcgggccaggccgugcgggcugagcagcuucggcuggagcugagugagccccaguuccggucagagcuuagcagugggccuggucccccaguccccacccaccuggaacucaccugcuccgaccuacauggugagagcccccgagugacagaacuuggggcaagaggccuggcuucugggagagaugggcuuggggcuauggaaggggcccagucacaacccgagcagucccuggcccaggccuuuaccagcucuuggggucccagcacugccuguccccggccuccucaccgacaaguaggguggacccuuugucucuggcuuucucugcccaccaagguguguguggagucgggggcacagcucugagccgaccugggcauuggggaagaaauaggaaaaggcagcagugaugaccccccuaauuccccaucccccuccagguaucuaugaagauggagggaagccaccugucccuugccugcgugucuccaaagcccuggaccccaagagcacugggcgcaaguacuuccugccccaguaaguaggggcucuggacugggcccaggagaggaggguucugcuggggguggcagggggccaguuuggaacugggugccgggggcccugcaggccaguaacaggccugugccccggcaggguaguggugacugugaacccccaguccagcagcacacagugggagguggccccggagaagggagaggaacuggagcugucaguggagagucccugugagcugcgggaaccugagcccucgcccuucuccucuaagaggaccauguaugagacagaggaggugagacuuggccccaccucuucccaggacccccucccgcccaccgcccggguuccugccguaggagccaccuguguggcugugggccagggcagcacgaccaccuggggugggcaugagcugacccaacaccagugaggauuucggcucuuccauucuuuccagccagucagagagucuuucugaaacggcacuggugagggcaggccccuggggagcauggguccucgauuggaaagaucagguccugccccaccugacccguggaucagcacuguacacuuagaaaggcaguuaagggccaggcucugccacuuggugacugugucaucacccuggggaguuaucugaccuugaagaguuaccuauagaugaguuucuuccccuggaaaaugggcaccaugaccugucuuucucucuuuuuuuuucuuuuuuuuuugagauagaguuuugcugugucgccgaggcuggagugcaguggcaugaucucggcucaccgcaaccuccgccucccaggcucaagcgauucuccugccucagccuccugaguagccgggauuacaggcgcgugccaccacgcccggcuaauuuuuauauuuuuaguagagacgggguuucaucauguuggccagacuggccucuaacuccugaccucaaaugaucacccaccucagccucccaaagugcugggauuauaggcaugagccaccgcaccuggccuaauuuuguauuuuuaguagagacaggguuucaccguguuggccaggcuggucucgaacuccugaccucaagugaucugcccuccucacucucccaaagugcuaggauuacaggcgugagccaccgcgcccagccuaaccauaaccugugucacaggccuguugugaggaugaaagaaguuaacauaccugaagcccuuagaacagcacaggugugccaucagcacuguaucuguacggcuaucaugcauccccaguagagaagggcuccuaugaaugaaugaaugaugaacgacaggagggcaggacugagaccagagacaggccccagccagcgucucuaagaugacucuccugcucuuuccaccucacccuguccagauggugaucccuggagacccugaggagaugaggacguuccagagccggacccuggcacugucccgcugcagccuggaagugauccugcccaguguccacaucuuucugcccagcaaggaggucuacgagagcaucuacaacagguggagacccggggccagcagggcgggacuggacacugggugggccuggccucccuuaccugcuguccacccgccuaucucaggaucaacaacgaccugcucaugugggagccugcagaucugcuucccacccccgaccccgccgcccagcccucgggcuuccccggccccucaggcuucuggcacgacagcuuuaagaugugcaagucagccuucaagcuggguaugagaggugcuaacgcugggcuagagggaggacccccaggucugggaagggccaggcuagcccuucgcggucuccuucccagccaacugcuuugaucucaccccagacucggacucggaugacgaggaugcccacuucuucucagugggggcaucagguggcccacaggccgcugccccugaggccccaagucuucacuugcagagcaccuucucuacacuggugacagugcugaaggggcggaucacagcccucugugagaccaaggugagugcagccccgggcaggcgggccccaaacuucagagcucccauuggcggcagagcaagaccagcgcgagcagcuccaggucaagaauguggagagcaggaggccugagugggcagcgccagcccacccacgccagccugcccacccugucacagcccaucagcuccuucugacccccugcuguauguaaagcaccaugcuaggggucgggaugggcauggagcacccacuguucccacuccgagcgggcagacccggcagagauuauuuuucuccuggcaaaagaggcaagugccauccagggccuccagcagcguccaugguggaaacuggagcugacccccuuaggccagggcuccaggagccgccaacccccagagggcuugaggguugcugagugcagcuggggaagccaggcugugugcuccuucugcaggaugagggugggaagcggcuggaggcugugcacggggagcuggugcuggacauggagcacgguacccucuucagcgucucccaguacuguggccagccaggacuuggcuacuucugucuggaagcugaaaaggcaacacucuaccaccgaggugugaggccugggggcaggucaccacugggguccaggguuggggguggagggcuuucaggacggaugugggcccuggguggaguggguagccaguuggcuuggcagggggcucaugagaccccuccccagcggccguggaugacuacccgcugcccagucaccuggaccuucccaguuucgcucccccggcucagcuggccccaaccaucuacccaucggaggaaggggugaccgagcggggagccucgggccgcaagggccagggccggggaccccacauguuguccacugcugugcgcauccaccuggacccccacaagaaugugaagguaugggcuugccuaccauccaccccuccugcuagccugggcugcagccccggugugcggugggaccccagugcgcggugaggccccagugcacgguggggcuggccuccccacugcccugacugcgcccccacccucaggaguuccuggugacacugcgguugcacaaagccaccuugcgccacuacauggcccugcccgagcagagcuggcauucccaggugagcguggguggugggaagccacauggcccagugacucuggacuucuguuuugggcaagcaggucucuaggugggaggaggccggugggaggaacauggacugggccacagcugaccuuguccggagcuccugggcaagggguguggcagacagcuagugggcagaaggugaggugccaggcaggggccaggacagggagggguuagaggagggaggacaccaccugauccucacugcuuccuccugcccuggccucugaaguuguuggaguuccuagacgugcuggaugacccugugcugggcuaccugcccccgacggucaucaccauccugcacacacaccuguucuccugcucuguggacuauagguaccaggcugggugggccaggggcuggggacggggaugggcucucagguguaaggagccggccccagcccgaguaucacccccaggccacucuaccucccagugcguguccucaucaccgcggagaccuucacucucuccagcaacaucaucauggacaccuccaccuuccugcucagguaugcaggccgccccacacugggccaucccacccucgccgggccgaagcugccugccagcuguguguccucuggugcucucggucuuaauguacacccgggugauagucucauucucaggaauguggauuguuuccgccuuucuagagggcaguuggagccuccugaugagacccuuauaagcauuugugcucucugaccuguaaucucaugucugaggguuguccuaggauaugcgaauaagagaggugggauuuaaugcuuauggaguauaaguuaaaacagccaaaacguaucaguuaaaucacaagccucacaaccugagcaaauaagcauggcccaccuaguagguagaaaaccaugcagggauuaaggugaagcugaagaaucccuucaaaauauaagaagauggagggugcgguggcucacaccuguaaucccagcacuuugggaggcugaggcaggcagaucacaaggucaggaguucgagaccagccuggccaauauggugaaaccccgucucuacuaaaaauacaaaaaugagccgggggugguggcaggcgccuguagucccagcuacuugggaggcugaggcaggagaaucacuugaaucugggaggcggagguuacggugagcgaagauugcgccacugcacuccagccugggugacagagcgagacuccgucucaaauaaauacauagauagauagauagauagauagauagauagauagauagauagauaaaaaauauagaaagaugccacaguacaguguuuacucaaauaacauuggauacaggacugcguacguuuuaaaaucaguuuaugaagggguguuuauaugucucggcgugcagcugcagagaaaguuuggaaggagauguguauggugguuuucucagaauuagggauuaggaaugaugaaugauuuuuauuuucuuuauucuaaaauaucuuaaaggaguuuucauuauguuacccuuaaaauaaagacuuuuuuauuuauuuuuuuuuuuugagacagagucucgcucugucagcaggcuggagugcaguggcgcaaucucagccgacugcaaccucugccuccuggguucaagcgauucuccugccucagccucccaaguagcugggacaacaggcacccaccaccacacccagcuaaguuuuguauuuuuaguagagacaggguuucaccuuguuggucaggcuggucucgaacuccugaccucgugauccgccugccuuggccuccaaaagugcugggauuauaggcaugagccaccaugcccagcccuuauuauuauuucuuuuugagauggagucucacucugucgcccaggcuagagugcaguggugugaucuaggcucgcugcaaccccugccucccuaguucaagagauucuccugccucagccuuccaaguagcugggauuacaggcacccgccaccaugcucggcuaauauuuguauuuuuaguagacaugggguuucaccacguuggccaggcuggucucaaacuccugauaucaggugauccgccugccucagccucuccaagugcugggauuacaggcgugagccaccgcgccagccaaaaauaaggacuuauuuuagaagaaccacaaaugcagcagggagaaaaauggacaccccuucccaggacugucaugaggccccauugaggugucggaacugcaggcacuuugagagcugcaagugcugcccgcuucccacugccugcugucugggccuucuccccauugugcaggcaggaacgcugaggcuggaggggccuguccauaccaccuccugugggcuugggaccccucugcucggcucccguggagcugcccccugcagcggugcccgggcccuucucagcccuguucccccccagguucauccucgaugacuccgccuuguaccuguccgacaagugugagguggagacccuggaccugcggcgaggugggcagggccgggacugggcucccuccccucugagggaccaccgccccggccacacccagagcagccaggugucuccccgcagcugcuggccggguccuuagcucccacacguagcccgcacagcagggacuacaccuggaucaaccggauccuucccccaggugcuggggccggggccggguggaagggggccacaggaccuuucucucgccucugcugcagauuaugucuguguuuuggauguugaccucuuggaacuugugauuaaaaccuggaaagggagcaccgagggcaaacuggugagugaggcugucacucuggcuccuggagccacagcaggugcaggggccaagggagucuucaggggcugcugcucccucacgugccugggcuccggacacaguucaugccugcccuuccugggcugcaguuagcgccccuccugcaaagggccauaguacagcccuggugggggugucccuugaugcuggcugaaugaaugaauggguuucagcccugccaccagaggacgcggcagccagggcaccagcgaggcccugggaaucagccaccuuuguagguccccggauucaucuccuguaagauggagauaaccugcccugccucgcuaggcaugcagagcccuucacggggagugggguagggugggugggcacacuccugcuuccuuggauggcccugggccaagccccuuucacccucugggugaacaguuuguucaucuguucaguggaguuacugggcaggucauccacuccaggagagaccaucccuguucugccuguggcaggaucagaacugcggugcccucccagcgagcggguggggccagcaggcaguggccccuguguucacauagcugcuccccccaccccgccccugcagagccagccacuauucgagcugcgcugcuccaacaaugugguacacgugcacagcugugccgacuccugugcccugcuggucaaccugcuccaguacguaaugagcacaggcgaucugcaccccccaccccggccccccagccccacggagaucgccggccagaagguacaggugaggccuggccacacaggcuaccagagcucggccaggccccuccccugccauggcccucgggccugggguugggggagcucuguccugucucacucauugcuccuccccugccuggcccagcucucggagaguccugccucucugcccucgugccccccaguggagacggcccucaucaaccagcgugaccuggccgacgcccuccuggacaccgagcgcagccuacgggagcuggcccagccuucaggugaagugggggugcuguggggacagcagacacagucaggcacccacugugggcgccucuccaaacuggccucucuccuauagguggccaccucccucaggcgucgcccaucuccgucuaccuauucccaggugaacggaguggggccccacccccuucaccaccugucgggggcccugcuggcagcuuagggucaugcucagaggagaaggaagaugaaagggaagaggagggcgauggagacacccuggacagugaugaguucugcauccuugaugcucccggccugggcaucccggugcguggugggagggauggaccaguuugccguccaggcagguguguuuggagcggggacggaacacucaggggugguugccuggccaucuggagcucccguggugagagaagcaggcaggaggugguugccaucaccucggggguggugcuaggucugugccacccuagggaggcagcccugaugcugggcuuugauggaguagggggauuuccagaggaagaggaggccugguguuuugggcagagggacugggaaauucaagggauggaggaagaggagagggcaguuagcaagagggauggagaaccauguggcugcaagggccagugggaaugucugaacucacccaggucuuaggaggcagggcuggcaggagccuggcauucucaggcuccucuuggacagaccacucaggcauagacucgggugauagcaacccaggagugucaucuuucaucaaaaacagggaggaggccaagcaugguagguuacgccuguaaucccagcaauuugggaggucaaggugggagaauugcuugaguccagcaaugagagauuagccugagcaacauagugagaccccgucucuacaaaaaauaaaaauaaaauuagccagauaugguggcacaugucugcagucccugcuacucaggaggcugagaauggaggaucgcuugagccuaggaggcagagguugcagugaacugugauugugccacugcacuccagccugggugaccgaacaugacccgacccugucuauaaaaaaaaaaaaaugaaaaagaagugaggccagguugcuggggcugggggcagcugggcuggaucgaacaucugugucacacgucuaccuggccucccugcagccccgagauggggagccuguggugacacagcugcaucccggccccaucguugugagggacgguuacuucucacggccgaucggcagcacggacuugcugcgggcaccugcccauuucccagugcccagcacucggguggugcuacgugaggucucccucgucuggcaccucuaugggggccgagacuuuggcccccaccccggccacaggugaggaggagcgggugcagguggcagcuggugaagguuggggcucaggcugguccaggucugacuuucagcagcuggagaccuugagccccauccaccccaggugggccucaguuuccucauccuuccuuaucccgccugccuuccaggacuggggcuagcgggggucucuugucccaggcuaaaaggcccgcugaggacggggagggaaugggguuccucugagucagcuuggccccugucccucuucccagggcaagaacuggccucucaggucccaggagcuccccuucccgcugcucuggccccaaccggccccagaacucauggcgcacgcaggggggcagcgggcggcagcaccauguccucauggagauccagcugagcaaggugagugggguggcgagugccuacuacacgugugugucauagaacaacgggccuuguucucgaugucacguguagcaaugacuaaugcagaggaaaaccccugccuuuguaguggaggaagccaggcagggaccaagauguaucgaguguguccgauggugaagagcgcucaggggagagucugcagggguggaggagacaggugugcuggggagggucuggaaaguccucuucugaaggcaccauuugaacaaagaccugaacaaguggggaugugagccaggaagaguuuucaggcagagaggacagcgugaaagccgcaaauuggggccaggcaugguggcuuaugccuguaaucccagcacuuuggaaggccgaagagagcagaucaccugagcucaggaguuugagaccagccugggcaacauggcgaaaccccauuucuaccaaaaaaaaaaaaaaaaaaaauuaaccauuugcaguggugugugccuauagucccagcuacucaggaggcugaggcaggagaguuguuugagcccaagaggcagagguugcagugaguugagaucgcccuauugcauuccagccugggcaacagaguaagacucuguuucaaaaaaaaaaaaaaaugcuggaagcuggaagcauccugacauuuccaggagcagcagagccugugcauaaccagcgacccagaauguuucuuuugagucuuacaagagacgaaccccucagggcuuuugaggagaggccucugugggguggggcucugcagcaaucagggagggcuagugagcagguucaggagagccuagaugggggcuggccacagguucagcugcggauggggugugugagauacagagagugguacagaggguucaagguuugggccugggaaauugccuggggcaggggggucccacuugcucagagugagccaggccagugcugggcuucccaaggagccgcuagaggcaaagggcagaggggccucaggcugcucggguuggugggcugugcugcaagaaccugcgggagaugagugucagagcagggggccaggggccucucugagaccugauggccagccagcgggugugcaggaagagggggaaggaaggcucuccacggagaggggcuacgagagcaaaguccugaaggcaaaacaggccuggacuccuugaggggcagagaccagugcagcuggcaugggaagcaagagcagggucaggucuggagggagaggcaggucccugcugggcauagaauagagaagggguaggggccgggcaugguggcucaugccuguagucccagcacuuugggaggacgaggcaggcagaucacuugaggccaggaguucgagaccagccuggccaacguugugaaacccugucucuacuaaaauuagcugggugugguggcacaugccugcaaucccagcuacuggggaagcugaggcaggagaaucgcuugaacccgagaggcagagguugcagugagccgagaucacgccacugcacuccaaccugggcgacagagugagacucugucucaaaaaaagaauagagaaggggucuggggccagcccuucccucccucuuggggcccugcuuaccuggccaggccucuguccaccccacagguaagcuuccagcacgagguguacccagcggagccagccacaggcccugcggcccccagccaggagcuggaggagcgaccgcugucccgucagguguucaucgugcaggagcuggagguccgagaccggcucgccuccucccagaucaacaaguuccuguaccuacacacgagugagcggaugccgcgacgugcccacucuaacaugguaugagcgaccugcaccauccacccuggggcagggcaccagaccguuggggauacaucuucacgcaugcauggauucacacacauacacgcauucccacacaaacacccagguuguuugugagccugggagaagggcagagcuaggggcuguguuagcgaagggaacagcguguucagaggcaggguggcugggugagcugucagggaacagcugggugagcugcugccccagaggcccagcagguguccagaacucacccucugcucccagcucaccaucaaagcgcugcauguggcccccacuaccaaccugggugggccugagugcugucuccgcgucucgcugaugccccugcggcucaauguggaccaggugaguggucuacgugagggcagagccuagggugaccccacugucuccaggccucugagucugauccacaucuggaccucucccuugcaggaugcccucuucuuccucaaggacuucuucacuagucugguggccggcaucaaccccguggucccaggggagaccuccgcugagggugagaggcugggccagggaggggagcgucugggccuucugccucccaggacagcacagguucccagucauuccuggccccauccccagucugugaccuccccuccccuagcucgccccgagacucgagcccagcccagcagcccccuggaagggcaggccgaaggcguagagaccacugguucgcaggaggccccaggagguggacacagccccuccccuccugaccagcagcccaucuacuucagguaggcugcuggacugcggguggggggcccugggccagauugcugggggccaggccagugagcaaagaacccccucuuccugcuccccuacccagagaguuccgcuucacgucugagguccccaucuggcuggauuaccauggcaagcacgucacgauggaccaggugguaaguggggcggucggaugggguggccauguggggucagcuguggcugagucccucugggggccaggucuugcauccaggcacuguuagcagccagggcgcucuccaguggcucccaugggcuagcuagcucccugagucccauuggguaaaccuggacccccucccucucccagggcacuuuugcuggccuccucaucggccuggcccaacucaacugcuccgagcugaagcuaaagcggcucuguugcaggcacgggugaguccccagcaccccagccucucuccagggucccugaucuuccuucuguucugguccugacugguuguguggccuuggccaagucaucacccuucucagggccucaguuucuccucuguaaaaaggacgcaguuggcugggcaugauggcucacacauucaggcauucgagaccagccugaccaacauggugaaacccccccgucucuacuaaaaauacaaaaauuagccaggcgugguggcauacacauguaaucccagcuacucaggaggcugaggcaggagaacugcuugaaccugggaggcgguugcagugagccaagaucgcaccacuucacuccagccugggcaacggagcaagacuccaucuaaaaaaaaaaaaaaaggacacagucccucugcacaugacugggugggaccacagggaggguagagugcccacaguacuugccacagggguacugaguccuccugaccccacaaucccuccauguguggcucugccucaccuucugccuccucaccucccugcccugccaggcuccuggguguggacaaggugcugggcuaugcccucaacgaguggcugcaggacauccgcaagaaccagcugcccggccugcugggaggcgugggccccaugcacucgguuguccagcucugugagugucuagguuuggaagcccucgaaacugcuuuuacccuugggcaaccuagaagcugccauugggaauaagaggaggaggugggggcagggcagccucgggugucucugagcgcuccuucccccuaguccaaggguuccgggaccugcuguggcugcccauugagcaguacaggaaggauggccgccucaugcgggggcugcagcgaggggcugccuccuuuggcucauccacagccucugccgcccuggaacucagcaaccgguugguacaggcuauccaggugagugggugcccuguaucugggcugugcaggacagagcagcuggagcccucugcaccacagcucccugguucuguccucaaagcuccucagagugggcagucuggguaugacagcccuacuuuauagagaaacagccacggagaggcuaagugacuugccugggaccuccaagccaggucucccgaggcccacaggggcucccaugcaggagcgggagugccccccaggccuucagagcccacugugucuccugcucauggcaugucuuguaaagggggguggaggacggcuguguuugcagacuaagaaucugaggcgcagaggcugcccugguucauucaggccauacgcuucgcuaggccagaaggaccccagggaagcuggggagccagucucgugggcaguugucagaugaauucuguaggggaucgaugguccuaggcggcuaaggggugagugcaggugcauggugcauucuggaaccugcaagcucagaccccaacaggacagagggcagggcuccaggggaggugggagggaugcaugggcaccagggagcccccgggaguguucagucaggugggaaagagugaugccaggugagaugcugggcagaggaucuggcagacagaaggaaggaugggccucugaccaucuggcaggggcgucuggggggccaggcaaggagcggucagucucaggcgugcagcugcggcagccauguggaaccugcugaaugugguggucagcaggaagagagguuuggguugagaagacuuuaggaaaguccccugaggagucccacguuccuagguucccucagcagaguggcaggugccuaggaaggggaggaagagugggaggaaguggggagugaggcugagcaggacccccuaggccagcacagugacaggcagggaggcugagggcugguggggucucagacuguccugggggccuggggcugacgugugccccagccagcuguccucauccagugcucccaugucccccaggccacagcugagaccguguaugacauccuguccccggcagcccccgucucccgcucccugcaggauaagcgcucugcgcggaggcugcgcaggggccagcagccugccgaccugcgggaggguguggccaaggccuacgacacagugcgagaggugaccaggcccccgcccugccccagucccccaugcccaucuccucacacagaccccgcccugaccucuggcuuccacagggcaucuuggauacagcucagaccaucugugacguggcaucgcggggccaugagcagaaggggcugacgggcgccguggggggcgugauccgccagcugcccccgacuguggugaagccgcucauccuggccacggaggccacguccagccugcucgggggcaugcgcaaccagauuguccccgacgcccacaaggaccacgcccucaaguggcgcucggacagugcccaagacugagccuggggugcccggcacccagagggugcugcccaccaugcuccugagccucccaagagcugcagcccacgggcccggcccggccuggcccuucaggggauggccacugugaaggacgccuucccagccugcccguugccaaucugcugugagaggggggccucccugccuuggggccuuagcccuggcucugcacuuuuccuccggggagaaaggacacugccccucccccgaccugggcccacacugcugccuucucccaggacggaggcuuuuggacccucggaccccaucccacucagccaagugucuuucugugucuggggggaggaggggaugauauccgugugguucgauguauuauuuuuaagcuccgugagugcgugggucagugucugcaugaaguggaauaaacugcccaccgccagccccccucucagauccucugucccugugaacccug

SEQ ID NO: 18697 - RNA, 25997 nt, Homo sapiens
uccucccuaccgcccccaauuccgcccugcccccgccgcggcggcgcuagccgccacugagggaccgacccuauaaaggccgcuccgcgaggggugcgcagcauucggcagagggcgcuucgacgggcugggcugugcgccugcgcagugugggucgcucccgauucccugccccggccggccccgccucggcuccgcacccucgccccgcucucagccgccgcucugccccgcagcagccagccccguguccggcaguauguucagcugggucagcaaggaugcccgccgcaagaaggagccggagcucuuccagacgguggcugaggggcugcggcagcuguacgcgcagaagcugcuaccccuggaggagcacuaccgcuuccacgaguuccacucgcccgcgcuggaggacgcugacuucgacaacaagccuauggugcuccucguggggcaguacagcacgggcaagaccaccuucauccgacaccugaucgagcaggacuucccggggaugcgcaucgggcccgagcccaccaccgacuccuucaucgccgucaugcacggccccacugagggcguggugccgggcaacgcgcucgugguggacccgcggcgccccuuccgcaagcucaacgcguuuggcaacgcuuuccucaacagguacccacccaucacuccagggggcggggggcgcguccggggcacaccccucacucggagccugacccucccguggcugucgccccgccguccuuugucuccgaggccccagugagacccucagugaccacucccugguccaagggcccugccccuucccagaguaaacccacugggggucuaagagugggcguugucggcucccccagcuucuguccuccccagaaucuuccaggguaaccaccaagcccuccugcagaucccagccccacuccccucagcagcagggccgcaguaggaagcugagccauuccugcgcuccuuuucuuggucuccaccuccgucccgcaggcuggaugcaccuaauucacggaaaucaacccuccccucccugucuucuuaagugucaauagcaaaacacaaugaaacuuuuagccauucccuucucuggugcggugugggucugcucugccuccccugggacggugguuuuguguaggagggaggaggaggaucggcuguggcuugcugacuuuggggcagccccuuggaggcaggggacaguugagguucgaacacuucucccaauggcagcucucaagaggucagugcugcccugagggguuucaggaagcaggaugaggugguggcagugggagcccugcaaugagauucuggcccuaagcccuucugugcacugagggacagaaucugagguuccuucacccacuuggaccucacuuuuccaguuaaguggccucugcacgcgaggagagugagcuccaggacucugccugucucagugcugugaaugaaacacagugcucccgccccucaaggagugcaaugcccaagcucacuuuucuccagagaaacucgagacaugcccgucccaacccccaggcgacauaccaaaguacuucacagacccuguccucccugccaccccacguucacggacuccacaugccuuucauaauucugcaccagcgaagagccucugaaggaaucuuugaauccugccuuccagguccccgcccugcacggucacauuccuuuccagacgccauccagcugugcagggcagcuugcccuagagccaagcugguggccaggccuacuccaggcacagagcugaccuucagcagggucuguucacuuccaggcauuucagcccgcccuccuguuuuacggcuguugauguuugucugucaaggccagguugagugcagcccuuugggcuaaggguccugaagaggcggaguccucuucacuuuccuugugagggcacaccuuuuuugaaaggagagacauggcacaggaccaguuuucugaauuuggaagccuagaguuucagagcuggaaggaucuuagacaucaucuuggcagcccccaccugacugguucaggaaaccgagguucagagggucuggcugauguguggaagucacccauuaggucagccagcacugacugccuggcuuuugcacagccaguuacugcuuucugcugcuucuacccgaaaaagagcaauucgagauugcuuuguccgagaccggugcuuugaugacauuggugccacaggaucugagagguggcacacguuuauuuccuucuugcugccaccucaucuccagaggaucccugaucacugauggcccugccgaaagggcccuaucagcccacgcugaggcccagagcugugccaggauguguaguguggggagugagcccggcgaggagggugcaacaaaggaggcuuuucucuggcugauacagccucucccagcugagucuugaagagacucauugagucgugaacuugacuugccggccuucucccccuauguggcugcucuaagaauaaaaucagcuggagcagaccaaggcaaggugcagucagggugucuuaagagugucuugcaaaaacuuauugcauaacugggacugccacuugugcgagaugaaaccugugcguucuuggugagauggaaucggaggcaucuuugcugcuuccccuuucuuguuuucugccauauacccugggcucugcagagcaacugguuucuggguccuauagauauuaacucacuuucugggcucauuuaugaggcauuuuuauguaugugauuucccagagccaauucugcuucccauccuucuauucuguaaucaucucuccagcgccuccuguccccagcaggaaggccaggacuggccuucaugcauugcuacuggcacuggcgagagugaggcccacguuuugcucgcccugcaggucagcuggucuugcuccacugccuugcagagcaccccuugcccuggccagcugcccucugcccgugggccccuggucacugggggauggggccaaagggagaagcugaucggcucagaguccucccgucuguuggaaaggcagcuucaagucuguguccuacagauaaugggucagucuuuucuuugcucucacuaccuuuuucagagaaguuuuuuguuuguuuuuuugagacagagucucgcucuguugcacaggcuggagugcaguggcgcacaauuucggcucacugcaagcuccaccuccuggguucgagcaauucuccugccucagccugccgaguagcugggacuacaggcgcgugccaccaugcccagcuaauuuuucuauuuuggguagagauggaguuucaccauguuggccaggcuggucgugaacuccugaccucaagugaucugccugccuuggccucccaaaguacuaggauuacaggcgugagccaccacgccuggccuuucagagaacuuuucaaaggagcuuuuucugcguccagugaaggaucccugcucucaacugagacugccccuugccuuucugggcuguucuaagcuuagugugaaacucagauaugcguggcugagcccuggcccgcaagucgccagccucuccacggcuuuguucuuccucagccugcucggacuuucagagaauggcgcgucugugcuucuccgucccaccgucuaccagccugugugguccccagcuuuugccagccguccauuucaauucccucacccaagcggcugguugaaagggcagggcuggcccuagcagcaguaggaagcggccagcucucuucaguguggagauuuagccaagugcuggaggauucugagaugggauuucagcgccccagcgugaccuucugcuuccccuccgaacugaauggugaccuaggcuugcacaguuuucacuaacaagucagcagcuugaaaguugaccucucaaacucuaggggaaaagugugugaggaagugcugauuugggucaguuugagccugcugguugcauucccaguugagaaaguccauacgauuugccggccaccccgggaaacuaagacgauagaaaaccaccugucaguuccccgcugcuggagaggaagccagagauggagcgaaggaguacagagagcccuuuguuguguccggagcagugaugacugugucuugacgccucucuucuggcucuugcucucauguagguucaugugugcccagcugcccaaccccguccuggacagcaucagcaucaucgacacccccgggauccugucuggagagaagcagcggaucagcagagguaaacagcugugaccacagcucgggcugcugguguugucacacauccuucucucuaagaucugcaacuugguucagaugcugcccuugagauuucuccuuuuuuuuuuuuuuuuuuuugacggagucuuacucugucacccaggcuggagugcaguggcgcgaucucagcucacugcaaccucugccuccuggguucaagcgauucuccugccucagccuccugaguagcugggacuacgggcaugugccaccacgcccggcuaauuuuuguauuuuucguagagaugggguuucacuauauuggccaggcuggucucgaacuccugaccucaugaucugcccgccuuggccucccaaagugcugggauuacaggcgugagccgccacaccuggcugcccucgagauuucuuccagucucagccuuucuaaaaaaaaaaauguggccgggcacgguggcucacacuuguaaucccagcacuuugggaggccgaggugggcggaucacgaggucaggagauugagaccauccuggcuaacacagugaaaccccaucucuacuaaaaaauagaaaaaauuagcugggcguguuggugggcgccuguagucccagcuacucgggaggcugaggcaggagaauagcgugaacccaggagguagagcuugcagugagccgagaucgcgccacugcacugcaggcugggcgacagcgagacuccgucucagaaaaaaaaaaaaaaguguccgaguaagaacccauuuuacaucagccucccaucuccacagugcucugugcacugagagggcgggagcugcuuucuuucuuggcucccugggccuaggcaaugggagcagccauggugagaccacagccaaucuuauguggcugucaugcuuuugaaccccuggggcaugcuggaaacaacaggaucagaaucgggccaugcugugagggugcaggaagcauugcugacucugaacaagccccugguccccagagcuuauuagcuuuagucuguguuuaacagccuuugccccccaaagccauauacauuccucacacguccagcaggacugagagagagccaagcaaaaggagaagcugguagaaauucaugaaacgggcugguggaaauuugcuuacauuugcuuagagguugacagcagccucccuggcugaggccuucuugcuaugcaguagugcaccgugcccauuccaauuguguaaacuccugccuagauucugccaagcucuuuugaagaucugguucaggaugagccugaacuggguccuccaucugucacugccccuuuuucacagacggguggggcgcuuuggggccugaugcuuucugggaggagcuugaggguaggcugguaccuggcaggugaggaguggagucuacagcuccaaaugugaaaaugaaauaagaucaaacucaaagagggguugaggacaagugagcaaguuuguugaugauuaacuugcagauccuucccgugucccuuacccucuggacuggccuuugcugggugagccuugcagucaaagccggcagcuaggauuuggggugcacaugucucucugcuagggcugugagggcauggggacucuguucuuggagcugagaaaccuugcuucucuuuccuuccagccuugcgggccuugcccgugugggacugcaucagagcguacugaaaucacuggcccucaucugguuucagagcugccaguuaagcuguuagauucucccaccccuggugacagugaugcaccuaggaguuaagggaguagauuuggagaccccuuuaaaaaaaaaaaaaagcgagggcuaguauuuuuauuucuuacugcuauuguuguuccaaccuaguuuuaguaaaugccggauaagcaaaagcccugucauuugccaaagcaaggucagaaaaucugauuaaguuacucuuuuauuuuuuugagacagagugucgcucuaucgcccaggcuggagugcaguggcaugaucucgguucacuacaaccuccuccucccugguucaagcgauccucccaccuuagccuccugaguagcugggauuacaggugcaugccaccacgccuggcuaauuuuuauauuuuuaguagauaugggguuucgccauguuggccaggcuggucuugaacuccugaccucaggugaucugcccgcuucggccucucaaagcaucaucacagccuugaacuccugggcucaagugauccuuccaccuuagucucccgaguagcugggcccacaggcgcgggccaucaugcucggcugggguuguaugucuuguguugcuugccuuggccccugcccucugagaugcucccuccccaccucccacucccucugcuuccuuucccugguaggaaagaggcaggcagaggugucuacacuggcugucucugggacaagcaccaaaguguaugcuccauaucaguggaucugcagacacagcauggcguuuugauugggagcaagggguggacguagguguugccuuguggucccugcccuggaguugccugugcagacaacagguuggaggaacaagccagcaggacaugaggcugcugucagugugcugcccugcucugccuguguggccucccucuccccuccaggugcaaaguguggccccucugcaucccugagaggccaggcuccccuauauccacagaaggucaucucuacccauuaugggcaggaaggagccgguggcugaaagagaagcacaucacgcugauuggaggagggguuuccugcugugaaguagcagaagaucaaaccgauuuuacuagaccauuucuuuuccuccauagcccuagaggccuugguuuagauguguuuuacuaaaaguuaccugguuaggguuugaaugaugguguuuuauugucaggagaaagaccaucgcucaguaccucuuggaggugcuggguguaaacuccaggaugagccccgcuagguguacacaggaggaguggauuucuguuuccuggaggccccgcccgucagucauggaaaggcccguguggccuguccagcggaggaggucggaguggagcagugcguucccggcagggcuggccaccugcuacugccuuugcugguggcguggaaagcagguguuucccucucggaaagauggggccggcagagcacgcaccagggccccagcacaacacgccuccccuggccugccagcccguucccuggaaacauguccuuguggaggccguggauggacauugggguugcuaauugcauuuacuuccauuucccaccccgucuggccccgccuggccccuccugacuuuuuuuccccuuuccccaugguccuaaugugugcaggaaacacggucugaaaagauaaggugggcuggugcaggcccaaagcagucaggaugcagccaggcucugucagggaccccugaggacugccucagggacgagaagggggccggguuggggucucuugggcugccuuugccugugugcuaaucugagugacuuuaaagauaccguucuccugugucagcagagaaagguggccucugggggcugcguucauucuugagugcugccugugugacugauaagggcauuccaaagggcagcuggguccggcagggguggugcccuuggcuccaggggcugccgaccaguugcguggucccggcagugccucaugccgagucaucccccggcggggccucugugggcagcccggccaguucguucguuccccaccauggucacuaggcaacugugaacuaagcgggaguuuuugugucucaaucuccccaugaaagcuguaucagcaucagcaggguaguguuucuacuugcaguagcagaucagagaccuggccagcuuugugucugacuuucugcuggccacugccacaucagugaguuccauugaguuaucacagcagcugcaucuaggaggaagcuccugccuuucagaggaggaagcagaggcuuaggaaaguuaaguaauuggccuaagaugacaggcaggccagcaagugucggcgcuaggauuugaacccagguaggggcugugcuccuacugcggcggagcugagaagggugccuuggcaugaaggcugugggcgaaggagugccgggagcuugggucagacagaccuuugccccuguugggucauuacuguggacacacaguaaugugugucccuccugagacacacagaggccacccucuguuucucucccacccaagguuagacuccaguccugaaauggaccugaggucuggggcuuugaacagcagugcugguauuguguucccuguucccagccauaaaugaucccuuggggucuccagggagccugguggccugggcucucguuugcccucugguggucugcaggcucccucuaagccugggagcuguccugauccuuagugguuggauggggccucccugcccacacucccaccuguguguccugagcccuccggcccagaggcaggccugcgccgugggccgcccccacuuccugccgacaccuccugagauggagaugccgcugccagcagcacccccaggcugagguuucaccagggugcuccgaagaccaucaaaugcucccaggggcugcccaaaggccaugagccaggccaggugcugugucccucuuggauucagcauccauagcacaaguagaucagaagguucaagucccacguuaguacuuggggagcuggguggcucuagggaguugcuguagucccugggagcugcaucaguccaucaggaaacaccauagccucuccaguuauuguagauuaccagaauuuacauguuaagcucuugcccuagugccuggugcacaguuaaguguucaagugucagcugguucauagucaagagauugaaaagcccagggcuuuccagacggugaucugaguaacauccuggggaguauccucggggaagugcugacucagccgggguuucccguuggguuccaggcccuccuuugcucccagcuccaggccucccaaaacccucugcucgccccaccuggcuguggucucccucuguggcccagcaggccaggaugccaagacagcuuuuggccucagccucugcugggggcgugcaggcucugccacagaggaggcguaccaggcgcugcccgcgcucagcaccuguuccccaggcugcgcacuggcggugggcuggggagcagcuggccgagcgccugcaaacauuccguuuauauuugggggaugaggcauucuucaugcauuugaaguccuugccuacacacccaucagaaucugagcuucuuaagcccaaaauacaaauccugcgaguaaauaagagcaaacauuuacuccugcucgcagugugccaggcucacuccauccucccgcggcccuccaagcuggaaaccuacuaucuucguguuacagacugagaagcugggaaccgaggcucugagaggucagagaccugcugggucacacagcucguuguugaguagaagguucaggauggaaaugugggccugauuccagaguuccucugcccccucccgccccucuuuuguugcuucugucugauuugcuggggucuacguuguguguagugaaguccacccuccucaggugcccugcuguacaaagcauuccugggcugccgccaccaugacagagaguauucccaucgccugaaaguucccgugccccucauagucacuccuggucccaggcagcccacugaccuuugucucuaacuuuugccuuuuccggaaugucaccuaaauggaaucauacaggaugaagccuuuugcuuccaccuucacuuagcaggaugcuucugagcugcaucuguguguuugagagccccuguggcccgcuccucuuuguuggggguccuugucccaucauagggaugcaccauccguugucauccauucaccuguuggggcgcuuggguuguuccacccggggcaguuuugagucaaguacgugguucgugugggcgugugcugcugcugcucucagguaaaugcugaggaacggaggcgccucugugcuccacuggaaaacccuuccggaggagcuucagccugagcaagcccaggaacgaggcccagcacgcguuggaaaccugugugauggagagcuagggcgagaaauacugaagcccacgcagcuugaaugacaggaaacaaaagucgauuggagacaaacccucuauguuucauguucuagaaaucuuuggaauguauaaagcagcuuuucccccugcggcuggaacuaccuguguuuuggaggcugcugggguagggcggggaggccugagaaccucccucuuccccuucugugcuggcgggaaacaugguccagcuguucucaggaaggcagacccuguaaggccagcgccuggagaggggcgccccagagccgcaguggccuggaggaggcugggugggacgcgggucgccaugagaggcaccugcgugcacgcuacccugaggugccaugccuggcucagccugguugcccggagccacucuguucuuucaucccacagccccaggacuuuucguuuucacuuuuuaaaaauugugauaaaauacaccuaacauauaauauuuaccauuuuaaucuuuuuuuuggagguggggguacggagauggaguuuuacucucauugcccaggcuggaguacaguggcacgaucaaucucggcccacugcaaccuccgccucuggguucaagcaauucuccugccucagccucccaaguagcugggauuacaggcgccugccaccacgcccagcuaauuuuuguauuuuuaguagagacaggguuucaccauguugaccaggcuggucucgaacucuugaccucaggugauucgcccaccucggccucccaaagugcugggauugcuggcauaagccgccgcgcuuagccuuuuuuuuuuuuucuuuugagacagagucuugcucuguugcccaggccgaaaugcaguggugcgaucucagcucacugcagccucugccucccaaauuccagcaguucuccugccucggccucuuggguagcugggauuacaggcguguggcaccaucccuggcuaauuuuuguauuuuuaguggagaugggguuucaccauguuggucaggcuggucucgaacuccugaccucaggugaucagcccgccuuggccucccaaagcacugggauuacaggugugagccacugcgcccggccucauuuuaaccacguuuuuuggucauggaccccagaaaaguagauuuuaacuauuuguaggugugcauuucacuggcauuuagcacauucuucauuguucagccgucaccaccauccagcuccagagcucuucacuucccaaauggacacucuuccuguucaacaccagcuccccucguggcucccugcaccccgcagccccugcacuccccauucuauauuccuuuucugugcacuugauuacuccugguaucuccugucaguggaauccuacagugccguaucuguccuuuuguggcaggauguuuuaaaaaaacuuuuagguucaggaguacauguacagguuuguuauacagguaaauggaguguggugggguuugguguauagauuauuucaucacccagguaauaagcguaguaucugauagguaguuuuucuuuucuuuuuuuuuuuuuggagacagggucucacucugucacccaggcugggagugcaguggcacaaucacagcucacuguagccuccaccucccgggcccaaacaauccucuuaccucagugucccaaguagcugggaauacagaugcaugccaccacacccaaauuuuuuuaaauuuuuguagaggggggucucgcuauguuacccaggcuggacucaagcaguccuccugccucagccucccagagugcugcgauuacaagcgugagccaccaugcccagccugcuaggcaguuuuucuguccucacccauuccacccucaaguaggcccuggugucuguuguucucuucuuuguugccauguguacucaauguuucacacccauggaugagugagaacaugcgguauuugguguggaacaugcgguauuugguuuucuauucuaguguuaguuugcugaggauaauggucuccagcuccauccauguugcugcaaaggucaugaucuuguuccuuuuuauggguggauaguauucucugugguauauguaccauguuuucuuuauccagucuacuguugauggguauuuagguggauuccaucuuugcuaucgugaauagugcugcaauggacguaugugugcauguguccuuauggcagaaugauuucucuuccuuaggguuuaugcccaguaaugugauugcugagucgaaugguaguucuguuuuaaauucuuugagaaauugccaagcugcuuuucacaguggcugaacugguuuacauucccaccagcagcguauaaauguucccuuuucucugcaaccucaccagcaucuguuauuuuuagacuuuuuaauaauagccauucugacuguuaugagauguugucucauugugguuugauuugcauuucucuaaugauuagugaugcugagaguuuuuucauaugcucguuggccgcgugugugucaucuuuggaaaaggucacagacuuauuucaucacuuagcaucaugucuucuaggucccaggauuuucugagcuagagcuuccugguggcuuaugaucccuuaucagagggggcucuggcuuuuacucacuaaaaccacucccucugcaggugggccuuucucuccagcccacccgcuugggccauguuuucuguguccuuuugcucggcaucaguucugucacucccacuggggccugagcuagucaagcuaacagcaaggccccuaccuuggugggugccaaagccugaagucuuguugccuugggcagugccgggggugcuggcaagcccuguucuguacuugauaccggccguccagcucugaucuagagaguggcucaguguuaccgcugugcaguguagccuuuggcaccucuugaaacccggcgucuuuuaggcugagugaggugccuuugagggcagcgagggccuggugggcuaaggagcgccggugggccugguggggcgugcaguuacguggucacugccugcauggcacaggccugagugcuguggcccuuuuugucaccuguggguguggcuggccagucacuguguuucccucacagcaaaagcacauuuucuguaauaaacaggaaauuuuagucaccugcaaagaaaugggcuuaccucuguugacuccagcuugagaugacggccaguaacuggguuucagagcagguggggcagggcuucuggaccuggggcagggaguuuuggagugcucacucuucuuucuuccuuccccuccuuuuucucucuuuccccagggccccccagccauccagggggaggggggaguggggccuugcuggguggaguuugggagggugaccucagcuccccaggcgccguccugacucccaggccaaagcuaacaugggcugagcacagcccaucagggcgcccucauucccaagaacucgguuuuggcaucacagccuccccagcugugugaauucuaguuucagcuuguggcgggcugaagacaaaugauuugacaaggggagaagcugggcccccuuuuugcugagcgaggaaccucaguccuugagucaucgccuuuucaguacugaccugcguucccagagcuggccauaaaaggcugugggcugcgggccccaggcaggcgcugcaggcuuagcuaguguggccucaucccccgggggcagaggcggccucucccugccccuguuucccucauguugcccuuggccucucuuucugguuuucugccgagacuucacucuuugggcauccucuccuguggagcucagagccagcugcagggaguccgggugcccggggccuuguacuuuggaagcaggagccugugguggcaugaggugcccuggcacgaugcccuuccacaccuucugggcacagggaaccuggcagcucugcugucuccgaccauccaccugagccucuggaaggcugaucgggccuccccguccaggcuggaggccaggaccccggcuccccugcacugcuacccuguuaagaagcuuggcccucggggcugcuucuggucagagugcccuauuuccuguugagcuggggcagggaacggccgcacaucaccuguggagaggcugccgaggcuguguggcugaagcuguggauuugggauuuuccuuacauuuuggugacuuugcucaaggaugaaaguccuugaccggugauggguccaggccgcuggccccuuguucccacagagcccuggcuuccccugccccagccugccaaggaggcugucccugucggguccugggcuggaggcccagugcucccacacgcccuccucccugcagcccggcugaggaauugguauuuaaauuucacagauggagaaaguaacugagaaguuaggaaaagaacuucaggucacagagucaguggcagggggcgggaguggagugcagagccaucuuaguuaguggcccgaguuccuucugggagcgccagguguggggaggggcuccgcgccccuguggcuuugggcucacagauggcgccaagcacgcuugggccuggggccggggcaggcggcaggaguguuuaucccaugagcgagcuugacuccgcacacccuguggugccauuuaucuuggcgugcuugugcguagaggcagccucucaggagccugggcuguggaccugccuuuguccuggagggcuuugcagggugggagcagcggaugccaccaagggggaacccguguaguggaggagucagcagcagcucccacugggggacggcagggcugcccucccaucaccgugggcgacccuguccagcugcugcuuuuccuuaacgcuuuguccuuggaccucccaccucgcugcuguuuuucugcccccucagucuagagagcgcccaucuccauccccagcuuggcaagagggugguguuuuucauggagaugccaggagcagguggugggcugaggacucguuugggcccaagcugugcgacucucagacuguugugugcaggaguggcuucuccugcucuuuuccggagccugacugcucucugggaaguacuuggugcuucugaagagggccggccuacauuuggguggccugggaccugugggaagacugagccagggacguggaggcuugcccagaaucaggcagagaggauguggccccucggggguggggcccaagcuccccaaggauucuaggccuuuguuuccacauggcccgccugucacuccuuacucuuccuagaccgggagggacagaaguuuuacucuaggggcagaggaagaggugaggauuucuuuuguuuuguuuuugagacagggugucgcucugucgcccaggcuggaaugcaguggcaugaucacggcucacugcagccucaaccuccugggcucagguuauccuccugccuuagucucccaaguagcugggacuacaggccugcaccaccuuuguagagucgggauuuugcuauguugcccaggcugaaguggaaauauuuagaagaggccuaguugucauauaggauucaaaacugcuguugaagaggccuaguugucauauaggauucaaaaccgcuguuacagagacccaaaaaucauuggcuuaagucagauagccaauaguuuaugugaaaaacaacagucuaaggccauucugaacaugcagcuuucaucucugaacccgaggugcuuccuccagcuccucccaucacaucagcauccccguccucaggagggagaaaacaacagagggcucaugcaccuuuucuuguucauucugcugaaggaggcugggaaaugcaaucugaagcugggaggccaugaauccagcugaaacuggauaguuauaucugguuccuuccuuuaggaggaauuucaauuagcagucucugccacaggcgacagaauucacuuuaauuggugggccuuaauugggucauaauggguuggugggaagcaauauagaauagaguuuagaauccaggcgcgguggcucaggccugucaccccagcacuuugggaggccaaggcgggagaaucucugagcccagcaguucagcauagacaacauagugagacccccaucucuacaaaauaaaaauuuaaaaauuagccagacaugguggcacacgccuguagucccagcuacucaggagucuaaggugggggggauggcuugagcccaggaguucaagguugcagugagcgaagauugugccacugcacuccagccugggugacagagcaaaacccugucucuaaaaaaaugaauauaaaauuuuuuuaaaaagaauauggagcuuaaagcuggagucuguccaguccaaccacuuuguuuuggagaaguguuuaagacccaggaaggggaagugguucguagcacuuccugggcuucuuguagagcagaggucagcaaacuuuuucuguaagggugggauaguuaauacuuccagcuuugcagaccuuauaguuucugucacaacgacugaacucugcuguguuagacaaaagaagccauggauaauacaaaugagcauggcuguguuucaauaaaacuuuauuuauacaaacagguggugggccagguuugaucccugagcuguaguuugccaacccuuguugcagaaaauaagugagauuccugcaaaauggggagccuggcacaucagcacugaaaaaguagcagcugcaguuacuuuugcaggcgccucuugucacuaccgucccagggcauacagcaggcagguggcaacacuggagucuauguucuacccucugugcugugcugagcacagugcugggucuccuccucacucucgcccuccucugacccaccuuagagcuugcacugugggacgaccuuugcauuagcaccuguuuaugccaagugcuacauggguuggggaguguuauggugggggcaggaauaggggagauaauccugcccucagggugcugugcugucuagaugaacaccuaggaauuuuuuuuuuuuuuuugagacggagucucgcugugucacgcaggcuggacugcaguggcacaaucucggcucacugcaaccucugccuccugguuucaagcaguucuccugcaucagccuccugaguagcuaggacuacaggcaugugccaccacacccggcuauuuuuuuuuuuuuuuuuugagauggagucucacacuguugcccaggcuggagugcaguggcgcaaucucagcucacugcaaccucugccgcccagguucaagcaauucuccugccucagccucucgaguaacugggauuacaggugcccaccaccaugccgggcuaauuuuuguauuuucaguagagacagggcuucacuauguuggccaggcuggucuugaacuccugaccuugugauccacccaccucagccucccaaagugucgggauuacaggugugagccacugugccuggccuuuucuuuuuuuuuuuuuuuucgcgacaguuuugcucuucuuacccaggcuagagugcgguggcaugggcuuggcucaccacaaccuccaccugcuggguucaagcgauucuccugcuucagccuccugagugcucgcgccacccugcccggcuaauuuguguauuuuuaguggagacaggguuucacuauguuggccaggcuggccucaaacucaugaccucgugauccucccaccuuggccucccaaaguguugggauuacaggcgugagccaccacgcccggccuauaggaauuuuaaaaacuaucucaggcugagaaauaccaggccagguuggagaugagagccaucagagcagcaggucccuuggcgccccugagcucucccuucucuuccccccaggcuaugacuuugcagccguccuggagugguucgcggagcguguggaccgcaucauccugcucuucgacgcccacaagcuggacaucuccgaugaguucucggaagugaucaaggcucugaagaaccaugaggacaagauccgcguggugcugaacaaggcagaccagaucgagacgcagcagcugaugcggguguacggggcccucauguggucccugggcaagaucaucaacacccccgagguggucagggucuacaucggcuccuucuggucccacccgcuccucauccccgacaaccgcaagcucuuugaggccgaggagcaggaccucuucaaggacauccagucacugccccgaaacgccgcccucaggaagcucaaugaccugaucaagcgggcacggcuggccaagguagacccuggggugaggggagcagccuauugccaggcagggccauggggcucugagacuggcacucagggccccaggauugcccgagacccuucccagcucacuucacaggcagaccugcacugcgcuguuucccucuauagaaaccagucuuuggucagcacccgcgugcagccugcucuuaacuaagauucucuacccggccucccucuaaaccuguucuguuugugguuuauaccccaucuacuuucaggaaggguuugacugugcuuacaacacagaaacagcacacaggaaguuaccgcugaagcaaaggaggcagccucagaaauggaguguugggggauagagcucuaaggcuuguuggcuucccucuaggguuuuuuguuuuuguuuuuguuuuugaagcggagacucgcucuguugcccaagcuggagugcaguggcaugaucucggcucauagcaaccuccaccucccagguucaaaugauucuccuaccucagccucccgaguagcugggaucacaggcacgcaccacuaugcccagcugauuuuuguauuuuuauuagagacaggguuucaccauguuggccaggcuggucucaaacuccugaucucaggugaucugcccaccucagccucccagagugcugggauuaccccucugggguuuacugagccugaagugcacucagcacagugcuggaugccggguacuggcggggagugacacacagccccuguccacuccucagccuucauggggaaagcagagcacgcaaacaaaaaauaaacaucaguuauuugugucgucucggagcgagcacaggcugcugcgggagcuggcgcuaggggcugucccaguggaguagaagggcugggggggccuggcaggagcugaagcuuaagcugugacaggaagcagcucgugaggagacagggugccagccugcagcccggggagcacugugcauggaagccaaggucacgcugaggcagugucaguucagcaggccuugcagaccauccuuaggucuccuggcagcccaggccugguggcaccuaucagcagccucugaauggccaaaggguuuggaaucucaguggcugaccaaguacuugagugagagccgguguggguggggccaggaaacaaagguuaaugccaccagcgggcccuuccaacacagaaugacagaacacaugcccuuggcgugucugacuuuggauagcacccuaucgugagccagccuagacgagucaccaugagugacagucccggcugugguugggguugaccccguggacaggaguguuugacacagauugucugaacagcugagaagugaccaagcccacauuuguaucagcagggcaccuagcuauucuuucaggcucuuagcacagggcucgguuguuucagaaauaggcuccagccaggcaugguggcucauccuguaauuccagcacuuugggaggccaaggugggugggcgcaucaccugaggucaggaguucgagaccagccuggccaacauggcaaaaccccaucucuacuaaaaaaaauacaaaaauuagccgggcgugguggugcgugccuguaaucccagcuacuugggaggcugagacaggagaaucacuugaacccaggagggagagguugcagugagcugagaucacaccacugcacuccaucccagguggcagagcaagacucugucucaaaaaaaaagaaaagaaauaggcucuggccaggcaugguggcucacgccuguaaucccagcacuuugggaggccaaagcaggaggaucccuuaaggccaggaguuagagaccagccugagcaaccuagugagacccugucucuauuuaauuuaaaaaaaaaaaaaaaaaaaaaggcccuugccguagcuccuaucuccaggccagccaggccggagcguggcuggggaacuguccugccugccaagccaggcccuuuggugauacguccccaguucuucaacagagcagggugcuugcccccaccucauggcaugcaggggguaccaggguagacaucaugugggcaugaaggcuucagugacagaugugccuguggccagggucacaguccccugaucuccagaauauaacugaggacugaggaugggcacuuccuggggagcccaugucccugccugcucagaggcauggagacugcaggcguugagcacaguggcccucguacccacucugucuggaggccagucagagggcaugugggugcuaccuggucugagcagugagaacugacccuucauccuuugccaccacuguccucccauugugccccaaguacccugggccccaccucacccuguagaugaggaauucucauucuggccugaaccuccgugagcugugugcacgggcgugggucagaugccggcucuggaggacagagggcugcguguuuuucuuauuuuuaauuuuauuauuuuauuuuuugauuuuuuuggagauggaguuucacucuguuaccuaggcuggagugcaguggcgcaaucucggcucacugcaaccuccgcuucccaggcucaagccauucuccugccucagccuccugaguagcugggauugcaggcgcccgucaccacacccagcuaauuuuuauauuuuaguagagacgggguuucaccauguugaucaggcuggucucgaacuccugacuuuaggugauccgccugccucggccucccaaaaugcugggauuacaggcgugagccaccgcgcccggcuggcuggauguuuuucuagaucucucccuucuggagccucccugugaguggagccagcuuugagagaggaacccauacaaaaacccaggugacugacccuggccucaaaggacaaaggacguccugagcugagggguguggguguggcccuagcugaguuucucuccuugcagggcagagagagcucccuugcucagccaccuuugaggacagacaggacaaggggcaggcaugagccccugccuggucgucugugagaccaugugugacugccaggccccaggcacacugagucaccgcgccuggaaaacccuguggccuccaguguugccucacaccugccacuuccuuuuccuggagugaguggugcucucugugaugacucccaccggccugggaucugccugccacagugucccuggggagacucuagauccagacccacauggcacggggcugccucccucaggcaguucucagccaggcccccacccagggcacaggcucaggcugagcggggugguggaugggcuggagccggggagaagggcagcaaggcuggcuggccgcagcccucuguggcuggacacgacuuggcaaggccgagggaucugagggcugggcuacucucgagggcugccagguucccagcuugcugcagggaaaugaagggggugccgcccugaacaggcacaugccuaagcaagguauugaugcuuggauaaagcuggcaaccaccaggagaagccuuuuugggauuuuucaaauccuucgucauccgagcugugaugauggaguggagcguggcacgggcccauuggaguucugugggcuccaucggcacucagcagggauuuggacgugcaggcuggugggcccugcaggaagccugcucccugcucugcugcgugggagggggcagcucgggggaagggggcuugcagagaaacagaagaacaugggcuguggggcaccuucagcagcccgggguuccaaucccagcuccuccaugugggagccaagcaccccaggcagccuuucccagccuugcuuagggccggguugggagaaucccaccccgcagggcuguggugaggguugaacggaggguguguggugaggguugagcggagggugugugaugcguggugaggguugagcggagggugugugaugcguggugaggguugagcggagggugugugaugcguggugaggguugagcggagggugugugaugcguggugaggguugagcggagggugugugaugcguggugaggguugaacagagggugugugaugugcccagugguacacgacaaauugccuucuuuggguugacagacuggguuuuacucuuccugaaucaucacaaugauccgugcaaggccaaggcuguugucuucuguuucaagugcguuuuccuguccuguccucuguccuguggcaguggacagcuguggcucuugccagauugugucugcuccuaggacugugggagccgguggugguagcggccuugagcuugacccaucccuccugcuucccuguuccugagcgagcaccuuggaguauccuuggaguguccuuggaggcucugcucucgggggcagccugggccaagagagcgccugaugcucaccccguccucacagguucacgccuacaucaucagcucccucaagaaagagaugcccaaugucuuugguaaagagagcaaaaagaaagagcuggugaacaaccucggagagaucuaccagaagauugagcgcgagcaccagaucuccccuggggacuucccgagccuccgcaagaugcagguacggcugucccgaggccccaugcaggcugguggccaucagggcagaaggaaggcccagggcacuggauuuggagggaaucccaucuccauggggaagggccucccugaacggaagcagcuggguuaaucaccagcaccccacccaacucagaguugacccaggcggugacacugcagaggggaauguggugacucacccugcgugguggggggagggcagggccaugccaggcgcucuggugcccuguccaugaauccuugccgcagcccugcaaggaaagagcuggaggugccuccuguguacagguuagagagccaagggccagaugguuuugccgagucgccccugcuagugugggggagcagcacuuuaugcuugugaagcccugacuggaaccacuuggccuggagucugggaggggccucccuucccagcccuuguccuuccucccccgcccacaggaacuccugcagacccaggacuucagcaaguuccaggcgcugaagcccaagcugcuggacacgguggaugacaugcuggccaacgacaucgcgcggcugauggugauggugcggcaggaggagucccugaugccuucccagguggucaagggcggcgccuuugacggcaccaugaacgggccguucgggcacggcuacggcgagggggccggcgagggcaucgacgacguggaguggguggugggcaaggacaagcccaccuacgacgagaucuucuacacgcuguccccugucaacggcaagaucacgggcgccaacgccaagaaggagauggugaaguccaagcuccccaacaccgugcuagggaagaucuggaagcuggccgacguggacaaggacgggcugcuggacgacgaggaguucgcgcuggccaaccaccucaucaaggucaagcuggagggccacgagcugccugccgaccugcccccgcaccuggugccgcccuccaagcgcagacaugagugauggcgcccggccccgcaccugccauuugcacgcccggccgggaggcagagacggggggaggggaagccucaccauuucucaagguccauaaagacugagcggauguuuccucgccucucgaaaaggaaaaccaccaucuuucuuuuaaggcuguuccugggccuggcgggggaggcaggggugagaggauggaauugugugcacaagaacuguggcuauuuuaauauauaacguuagaggcugcguucuuugucgccgccuccccugugugccagcccugugugcacggccucugccccccggccuuugcuguggcuggagcuggacagugcagcgacugcgaccgugggggagccaggucgcccuuuuggcagcugcuaggcugaggcugcauggacaggaacaccaggcacccuccgugugcuucugagcugagguugcuucacgggaccguggcuuccuuccucaccuggcucugccucccccgugcucucgggcgaaguggguucuugugccuuccccucccgggcccaggcuccccgugcgcgggcccugcccuuuccucccgcgccccaccggcuccgacgcgcaaccccgcucagcagucacagaagcagggcccagccaccuuggucuuuuuuugggaguucaggggaguaggagaaugucuuccagaaaaauacauaagcuaguuucuguucuguaaagugauaucuuucauacuugaccaaaguucccaauaacuucccaaccacuguucaaaagcugugauuuuugucuccccuucccacccuccagccaaggagcagcccugcccagggggcauuagguguggguacccggggagcaccccguuccuggaccccaguguugcauuuccuggcugaggaaggguggucaucccagcuccugcccuacccucucacuuaacuggagcuuugggacgcacccuccacagugggagguggugguggguggcgguggcggggccucacgacagcuuggugcugguaagaggaagcccgugguucuggcuaggcucucauguccagacagcggggaccaggggaaaacccagccccuucuguaaucccccuucauuuccuaccuuccuuccuccucuguuuagcaaaggagggcagcucacuuggauguccuuacaacgccccuggcccccagguugagcaauaagaaaccagaaccuugcggcccaguggcccgggccaguucaggccgccucccccuccucugccuggggccauugagcccagccuccagggcccgggcgcguuugcaggccaguggccacuguccgggcugugauggcaccaaggcagguggagcaccagguaccacacagcugggcuucccaccaggcuuucccgcgggggucucagggagcuucuccccagcgcugcucggagucugcaggaacuggccuuguucuccuuagcccgucacuccauacaguauuaggugaggauggaugcgggcgcuguccuugccgggaagucacuguugaaguugcaguggcuuguucacaccugugggaagagaagugaagacuuucuccuugcauuaaaaagucugaacugugcgaaagcuu

SEQ ID NO: 18698 - RNA, 21778 nt, Homo sapiens
cgcccccaccuucaccucuagccgcggcucccauuggccggcgcgcaccugcccguccgucggggggcggggcgcggcgcccaggugagggcgcgcuggcggcggcggaggaaggugacagcggggagggcgggagaggggcgggggaggacgcgcggacagagccucagacgguugggcggacggacggcccgacaggcgggcaugcgggcggccagacuguagccgagcagcgaggcuccggccgcagccauggagcggcggcugcgcgcgcuggagcagcuggcgcggggcgaggccggcggcugcccggggcucgacggccuccuagaucugcugcuggcgcugcaccacgagcucagcagcggcccccuacggcgggagcgcagcguggcgcaguuccugagcuggggugaguggcggggcggcacggagcgggggcgggccuagggauaucgcgccgagacccccgcacccgcagacuuucccgcagggacccgcacccccacgggcuucccucgcagacucccugcaguggcccugacgcguaccaccggacccccgcggcccgcacacucgccugcacaccucacccucacuccaauucucacacacgcucucucccucucacagaccccgacacaugcacacacauaccaacuugugcucagguaucgaccgcagacgcauguacccagugcaccgccuagagucccuuacagauuuccuugcuuacaggccacaccugacgcaggacacacacagacccucaugcaugucacccacugauacacgggcucuguuucuccuuccucucggaugcauugagacacacaacucauggagagacccagggagcgcugcagaccaccccgaccgcauuggcacugcaaaacacacagaucuguagguaucgcacacuugcagaccuuccccccaccaacacacacacccccagcucccuggguacaagaccacugcagccuggacucaggaaccgaucuccaacccuuggccugugcaggcugcuggccaagcuccuugggggcuguggcgccggggccggggaggggggccuagcuggagaugggucuguaccuuuccugguagacucaucugagucauugggaguggcuggcccggggugacccugaacccacugugggcacuggcgccagcuggaggguucccuggucacacccugccgggccauggggaaaaggcacgggggccuggccagggcggggugaggcagguguuugcccagugggcaacuagcguuccuggcacuccugagcucugggaaggcacaaggccugggguagagggggaggcugccaccuagaugugccagggaguuguccccuagccccaacccuuccauccagggcgaggcagucagaggccccugccucugugccugucucccugguaugccuccgugcuaugccugucugccuguguuguugucaccccccccaugacacccacacacguguguguguuugcacacacaugugugcuccucccugacugccuccagcaccucugccugggaccccggcaugggggcccucuguugacaaucucccaagguaacucaaagggcugugacucauuccucuccugcuugucucuacuugucccugcuccugcccggagcccccaugcccugugggaggccagaggauuaggcagccuguccaggggccuggauccuccugccugugggccugggcuucggcccucuucuggcgggugggucccuauggugcuggcuucaacucccacggggaggcccggggcugcuccuccccagcuccacacacagaccugggaaagagacaaugaauuucuguaaugagguuuccaccccgcccccgcugcgggcuucugccugauaaaccuguggaacagcucucugucccacccacagacccgcccagcuggcagggaguuuaccuccuggcagggggaaacugaggcagggcgccagaccacagcugccccccauccugacugaucacuccugccucccuaagacccaauuccuucccaaaaccuggggcuaauccaggccuggaaagugccugggaguggcuggaguugcccuuccuggagguaucugggaugugaggaaagaggacguucuugaccagacaaaagcuucguccagacagggaggcagggcugggagugagagagccggucaggccuggaggcauccugagcacucacgccuucaggggcuagugcuagcaccagggaaaggcaucuuuguccuguuugugagucucagcaccuuggcagacuggcauccaugccuccagccugaggggccccacgugggaagcauagagccuguccucccugcccuaggggcugcaggccucacccccaaccaggcaccucuaugccuacagggucccgggacccaggcccacagcuccugaaugggagagaagccucucuggggauaaggaaugucacccguccaguuuccuaagacaggcccuggccugaaccugugagggggccaagaacugugagguggggguaggaaugguguccccaugguccccagggugaccuggccaagcagagucaggccgcagacugggcaggacuacaagucccaucagccccugggauggaggcugccuagagucuggggccagggguccagggagguccagggaccaggcggucagcugagcccggccucugaccuuccgcacuuccugaucauggccaaaggagcaccaguuccugccacaaccccuuggcccgaggcugucccuggggaggucaucccugccugggcucacaggagcggcagcuccuggcuugcccaaggugagagggggaauggagcccucccucccugcacucugagucccgcccuguguccccucagccagccccuucguaucaaaggugaaagaacugcgucugcagagagaugacuuugagaucuugaaggugaucggccgaggagccuuuggggaggugagcaaagggccugggguagguggggggagguguucacaccgggcugggcucaccccgguccucccuguggccuuaggucaccguggugaggcagagggacacugggcagauuuuugccaugaaaaugcugcacaagugggagaugcugaagagggcugaggucaguguggagucuggggggcccuugggcacccuacaaaugggugugggggagguguaugcugccagggccuauggcgcggggggggcgggcaaggcugcagaccaggcaaagggugccacccucagcagccacugauuuguuaucuuucucacaauaaacccuuuauuuaauuuuuuaaauuuuuuuuuuuuuuuugagacggaaucuugcucugucaacuaggcuggaguucaacggugcuaucuuggcucacugcaaccuccgccucccaguucaaguaauucuccugccucagccucccgaguagcugggauuacaggcaccugccaccacacccagcuaauuuuuguauuuuuaguagagaugagguuuugcuauguuggacaggcuggucucgaacuccugaccucagaugauccuucugccuuggccucccgaagugcugggauuacaggcgugaaccaccgugcccagccuacaauaaacuuuuuuuuuuaagauagagucucacucugucacccaggcuggagugcgguggcgugaucucggcucacugcaaccuccaccuccugggugcaagggauucucaugccucagccucccaaguagcugggauuacaggcgugugccacgacacccagcuaaguuucuuguauuuuuaguagagauggaguuucaccacauuggccaggcuggucuccaacucuugaucucaagugaucugccugccuuggccucccaaagugcugggauuacaggccuaauaaacccuuuugaaagcaagcagagucguucccauuuuccauauggucacacugaggcccagagcuguagagcgugggcuugggcucagucgcagccagacaggggacaguagagcuaugaccuccaucugagcucccagacucacagaaucuuucuccauccccugagcuggcaaggggggcauccugggcucugaucccaccccaccccuuacuuccccaaaccugcugcagacagccuguuuccgggaggagcgggaugugcucgugaaaggggacagccguugggugaccacucugcacuaugccuuccaagacgaggaguaccuggugaggauacguggcggggcuggaggggaacauccuagggacacaggagagggcccuuggggccaggggcacugggcccaaagagagaccccucuugggaccaagagacucccacuucccaccaguuccugggcuuggcgccuccugccugagcccuggcugggaacuggccagcccagagcugcugggagaugcaggccugccuucccagagcccugcgggaccgcggugaaguggccaggugcacccuucccccgggucugauucuuguccgccaccuccaguaccuugugauggacuacuaugcugguggggaccuccugacgcugcugagccgcuucgaggaccgucucccgcccgagcuggcccaguucuaccuggcugagauggugcuggccauccacucgcugcaccagcuggguuauguccacagguggggccccaaccccgcugcccugcccaaccccgcugcccugcccaaccccugccagcugugcuggggacagcugaugucagcugagcacucaucaugugccaggcacuucucugggugccucauccgugugcuuccuuggaaucauaccaaagagcccucuguggcaggggcugcugcuguguccggccugcagcugagggggucagagcuuagcacagggaaacaccugucucaaggugacucggcucucggguggcaagcuguggucugcacuggggaagucugacuccugcgucccccauagcacacucugccaccuccaaggguuguccccacacauccuuucuacaaucuagccaucuuccuccuucuggccugugggaucaucuacacacacacacguugcucaucacaugagcaccuacacacaggaaugugugugagcuggugcuggcacacaccgugcaugugcaccugggcgugugccuaaauggccacuuacacacaggucaaacgccucacucucccugccugccaucccccagggaugucaagccagacaacguccugcuggaugugaacgggcacauucgccuggcugacuucggcuccugccugcgucucaacaccaacggcaugguaaggaccccgccccagagugggagcaggggauacaaggcgggccaagcucucaggaaaaugggaggccccaggccuagugcagaggcaucaggccccccggggaaggugggugagacccaggccccaggugggcagcagcaggccagccuggcagaguaggggugacagggccaucgcgaggagccagcagucccagccaagcccaaagcuguccucauggcuucaccaccaccacccacagguggauucaucaguggcaguagggacgccggacuauaucuccccugagauccugcaggccauggaggagggcaagggccacuacggcccacagugugacugguggucgcuuggagucugcgccuaugagcugcucuuuggggagacgcccuucuaugcugaguccuugguggaaaccuacggcaagaucaugaaccacgaggucuggacaccaggcucugggcuuccagagggggcagugggaccccugagucugugugguuggaaguaccggcaggugaggcuggguuccuggacacuugacccagccugcccccucccccgacccacaggaccaccugcaguuccccccggacgugccugacgugccagccagcgcccaagaccugauccgccagcugcugugucgccaggaagagcggcuaggccguggugggcuggaugacuuccggaaccauccuuucuucgaaggcguggacugggagcggcuggcgagcagcacggcccccuauauuccugagcugcgggggcccauggacaccuccaacuuugauguggaugacgacacccucaaccauccagugaguggcaaaggccacugcaggaggggagcugcccuacccccuuguuggcugggggaacccucccucugaaguccccuggggugggcugggggugaggccuucagacaccggggcuuaugauuuauggacucccagacugacccguuccagccaccauccgcuggcccagccucuuccagccaaacuggggugggggagcaucucccacaggcuccccaugcuugccugcacugaggugggcugugucaagggaagggccucugaccacagguaucauucuauuaacuagaauccguauaaggaagaaaacucccagcagcuccuaggagacuugugggagcuggggguuuguuuggguugggcuguguuaccccccugaguucccaccugugcaggagguggucgcaccuggucccagggggcuccugggccuugggccucgggccuuggccuguggacucugacucuccuucccucucccucugcaggggacccugccaccgcccucccacggggccuucuccggccaucaccugccauucgugggcuucaccuacaccucaggcaggugaggcuaguccucacacaccuggugggaggcucgggguugccugaccuggaggacacugggcgcguagcccacuggggcccugggaaggagggcagaagggcuccccaguaucugcauguggcaggugcucuagcccucauccucgggguccuggugaagccacacccagguccugcugggccacaugccagcacauggcucucauggcgccuuccacgaaggucgagggugcgcugcaccuagagccagaggugcaggguucgaaggccccuacugcucccaggccucacuuuguggcucuguaaaaugggugggauggaccaggcgugguggcuuaugguuguaaucccagcacuuagggaggucgaggcggguggaucgccugaggucaggaguucgagaccagccuggccaacauagugaaaccccaucucuacuaaaaauacaaaaauuagccgggcgugguggcgggcgccuguaaucccagcuacuugggaggcugaggcagcgagaaucgcuugaacgcgggaggcggagguugcagugagcugagauugcgccacugcacuccagccugggugacagagcgacucugucucaaaaugggugggauuaucuccaccuacucccauucgaggggcuggccugagaccgcagugagguccuggugcggugugcucugagguggaaggaaaugggucagauccccacuccucuagaccagccgggccacugucaccacauccuguccucgacagcccuggggagaggccuugucaccaccaucuuccccuggggaaacugaggguaaaauacauuggguucgaggugauacagcuuguaagggccaggaugaggguuuaaaccugggccuggacccggagccugugcccugcagcugcuaccccgggcugccacccguggcaccagucuggggucucccgagggcagggucuguuuuggcuguuucacaauuaaugagugauucgguccaggaggauggaggagacucuguggggugagguuucuaccaacaaacauggccccugucccccuacagucacaguccugagagcagcucugaggcuugggcugcccuggagcggaagcuccagugucuggagcaggagaagguggagcugagcaggaagcaccaagguacugggagcggcugggccgggccugggugugcuggcccuaggggcugcugcugcgggaauggaggaguggacucaccuguggguaccaccuccccuccagaggcccugcacgcccccacagaccaucgggagcuggagcagcuacggaaggaagugcagacucugcgggacaggcugccagguaucccuuccgcccaccccccccccccccccagggcugagucccaccugggcucggguccugcccugcccuggacaagcuguaugauccugggagagcauuuuauacucucugagcccgcgugugggaaacaggccaaggagacuugcuccugggcugagaggcuggggccgccagcacucgaggucucagugacucuuccuggcagagaugcugagggacaaggccucauugucccagacggaugggcccccagcugguagcccaggucaggacagugaccuacggcaggagcuugaccgacuucaccgggugagggcugggugaggugggugagggcugggugaggugggugaggugggugaguggcccugggcuccauggacgguucgugccugacucugggccuuguccuuccccgcucccuccccugccuccucaggagcuggccgagggucgggcagggcugcaggcucaggagcaggagcucugcagggcccaggggcagcaggaggagcugcuucagaggcuacaggaggcccaggagagagaggcggccacagcuagccagacccgggcccugagcucccagcuggaggaagcccgggcugcccagagggaggugagugaccaggguggguagggacagcaccugggcccugcccccagugugccuggagggagcauggggagcuuggugggagaugcugccucccgguuguagcuggcagaggcuaggccaggggaugguggcugggacggggcagucugggaguccaugccuccucauguccacuguggcuggcaggucuggaguccaugguaaggugggcagaggggcugccgagggcagaguuggcaguggccugccucugcaccccucacagcuggaggcccagguguccucccugagccggcaggugacgcagcugcagggacagugggagcaacgccuugaggagucgucccaggccaagguagucaaguccucccccuuggcaagaggugcuuccccaccagccugaccccacucagagccucagggccaggccugugucccaggugggugggccauggcaucuugggucucugcccugacccccuccauguccccaagaccauccacacagccucugagaccaacgggaugggacccccugagggugggccucaggaggcccaacugaggaaggagguggccgcccugcgagagcagcuggagcaggcccacagccacaggugagccaggcagcugguggcagggaggggccgggccuggccugggcggugagucacggccuuggccuucuccuccccaggccgagugguaaggaggaggcucugugccagcugcaggaggaaaaccggaggcugagccgggagcaggagcgggugagcaggguacaacagacggaggguacaacagacggacaaggcaauggggagccaguugaggggugggcaagcugcagccagugagcaggguggacauggacggggcucggggugcugggguaccuacagggagacggcagucccaggacugcuggggccuggggcugaccuuuccucuggccggccccagcuagaagcagagcuggcccaggagcaggagagcaagcagcggcuggagggugagcggcgggagacggagagcaacugggaggcccagcucgccgacauccucagcuggugggugccaggggugggucgggguggggaacgcaggcgagacugagggcccagcccaugacccugagccccuucccauucagggugaaugaugagaaggucucaagaggcuaccugcaggcccuggccaccaagauggcagaggagcuggaguccuugaggaacguaggcacccagacgcucccugcccggccacuggugagccccagagaugccccugggggcuggcuugggcaagucacugaccuuccgugagcucagcaucccugcuacugaaggucacuacuggagguggggacaccaagcucaugagagauagugauuucccugagcucacagugggucauuggcugagcuggagcuuugagccuggcuggguggcauggguagcaggaugcucugguagcagggggucccugaggcagccaggccuagaaagcaucuuauacgggugcuccguggccaccaggaccaccaguggaaggcgcggcgacugcagaagauggaggccucggccaggcuggagcugcagucagcgcuggaggccgagauccgcgccaagcagggccugcaggagcggcugacacaggugcaggaggcccagcugcaggcugagcggugaggcuaggggcaggcacugggggccagggcccgcacagaggccaguggcgagcccuugccauucuccccagccgucugcaggaggccgagaagcagagccaggcccugcaacaggagcucgccaugcugcgggaggagcugcgggcccgagggccagugggugaguggcugccaacugcuugccccggagccaggcucccccgcggccucccacuugccaagggggcuccacgauggccuggcagggugguggagacaggagucuguuccuggacucugccgcuuacuccaucaucugugaccagcacuucuggagugccugcugugcccagcccugccccacccuguggucauuucccauuuuacugaggugggaacugaggccccuccuggacccuaguuccucaggccagggaccccaggccagugacccacccuuucuuugcagacaccaagcccucaaacucccugauucccuuccuguccuuccggagcucagagguaaggaccaggccaaggggcuuguuggggagaaguucugggagaggcacagggaccuugacuuugcuccucucucucccacccccagaaggauucugccaaggacccuggcaucucaggagaggccacaaggcauggaggagagccagaucugaggccggagggccgacgcagccugcgcaugggggugaggacagguggguccaucguagggggccugggccccgcccuugcccgucucaccugcucccccgcccuccugcaggcuguguuccccagagcacccacugccaacacagccucuacagaaggucuuccugcuaaggucagugcccagaggggcaagcagggugggggcaccaagcaguucugccaggcugaaugggcacuguggggacacuccacgugcaucguggcuagcaggcacaauugggguggaggugguggcgaugagcuugccugccgccauagauuggcugggacucggaggucacuguugccuggcucagccccuugucuuuccugaccccucagggauggggcauggggcccugggaggccuuggguaauggcugucccccuccccagcccggcucacacacgcugcgcccccggagcuucccauccccgaccaagugucuccgcugcaccucgcugaugcugggccugggccgccagggccuggguugugauggugagaguccccacccacuaugcuccagccacggucccagguguguggcccuggcauacccaggcuguuucucccaucccagggucacuggcaccugcuggucaaauuuccuccugcucagcuuuguuccuuuucucacuugaugaggaauuggggacaguucgggugccaccguggcuucagggaagcuggcucuggacaugcccccguccugguuuggggcuguccccucccagccucaccucauccaccuucuccacuuuccccacagccugcggcuacuuuugucacacaaccugugccccacaggccccacccugccccgugcccccugaccuccuccgcacagcccugggaguacaccccgaaacaggcacaggcacugccuaugagggcuuucugucggugagugggggccgagggaggggaagaugggcauggggggcugagggucccugcagcccucccaugcuugccuuuccgccaggugccgcggcccucagguguccggcggggcuggcagcgcguguuugcugcccugagugacucacgccugcugcuguuugacgccccugaccugaggcucagcccgcccaguggggcccuccugcagguccuagaucugagguaggugccgggcaguggcauggggcaagggacuagugguaaggggggcagucagggacagggagauuucugaccuguucugugaaccucccagggacccccaguucucggcuaccccuguccuggccucugauguuauccaugcccaauccagggaccugccacgcaucuuuagggugagugccugggaugagauggagcagccaccauccaccuccccaugcugucccagcucuggccacuguccccccacuucauacugcccucuugggccagcccacaaccacagcacgcuuuccacgugagcaccuggcccggucucaccucguuuaggaucugcuguggcuucccaucgucugcggggcucggggugcuccugaccuagcccuugaggccccaaggcucugacccugcaggccucccagcccucucccuuggcaccugucucugcucuggucacaccuugcucucuccaguucugaaggcgcccugugccugugugcaccacauucucaguccuucacaucugucuuugcacgaaauugccggcccugcacuggagcccagccccucaccuaccuugacuacuccugguuaguuacucgucccucaggcuucagcagaaaugucuggucuccugggaagucauccuucacuucccggccccgguuugggucccucuguguucccacuaggcccguccuugccccauuauggcgcuggucgcauggcucuggaguugucuguuugccugucuggccuacucccugcugcugacagugcacgcuaggcccccggggcacagcggcugcuggaggcaggaagggagggaggacagauggcucugguccacggcccuccagcugggguccuugcccacaggugacaaccucccagcuggcagugccgcccaccacgugcacugugcugcugcuggcagagagcgagggggagcgggaacgcuggcugcaggugcugggugagcugcagcggcugcugcuggacgcgcggccaagaccccggcccguguacacacucaaggaggcuuacgacaacgggcugccgcugcugccucacacgcucugcgcugccauccucggugagcugguggaggggacuggaggaagcaguucaggccugcgggagugcuggugucuaggaauagucccaagggccacugcuacugcccauucccugcagccacgagacacagacugccuugcaccacguaugugcuccagccuccugugugcauggcugggcccccagguagggggccuggcuuauccccacuccauuucgcugugccucaguuucugcuuuuuccaaaagaaucucaagcaaguggaaggaacaaaggcuuuuuuuuuuucuuuuucuuuuuuugagacagagucucgcucggucgcccaggcuggagcucagcagugcaaucucagcucacugcaaccuccgccucccagauucaagcgauucuccugucucagccuccagaguagcugggauugcaggcaugcaccaccucgccuggcuauuuuuuguauuuuuaguagagacgggguuucagcauguuggccaggcuggucucgaacuccugaccucaggugauccacccaccuuggccucccaaagugcuggaauuauaggcaugggccaccgugcccagcuggaacaaaggcuuuagaaagagagaaacgaagguucaguccuggcugucucacuacaagcugggggacugggggagcugcuguagaaccacccagagccucauaacaucuccuggguggagcugcgaagagcuucacuugugcucagccuugaaccuggggcucagcagggcucuucuguaacuaaggcugggaaagaggcaugaaacagagcuccuuggcguuccccagcagcugaggcccugagccaggcccggcucucagggcgggagacacaggagagguugugcgggucccuggagcagucgggaaccagaggggaggggauuuauugagcaaggggcucugcugaacccuccccugcaucacuuccucgcuuccucagaguugcucugugaggaaguaccaucguuguccccaguuuacauaaggaaaccaaggcucugagaggugacaugacuuacccaaaaucccacagcucaagaugaugggccucaccccaaccccucuggaaaagccuguccagacugggagagaagggucagugaggcagggacagcgggauuauugccacccccauuuccucaagauaaacaggcacagcagggcagguggacugcccaaucuccgugucauugagugggacugcugaccucugacccucugccucccucuaccagaccaggaucgacuugcgcuuggcaccgaggaggggcucuuugucauccaucugcgcagcaacgguaccuaucaaagcugggcuagggugggcgugggcaggggcagccccagcgggcagaggaggauggggaugggucacucuucaaccaccugccagugacacucuccccucgccaacccugcagacaucuuccaggugggggagugccggcgcgugcagcagcugaccuugagccccagugcaggccugcuggucgugcuguguggccgcggccccagcgugcgucucuuugcccuggcggagcuggagaacauagagguagcaggugccaagauccccgagucucgaggcugccaggugcuggcagcuggaagcauccugcaggcccgcaccccggugcucuguguagccgucaagcgccaggugcucugcuaccagcugggcccgggcccugggcccuggcagcgccgcauccgugagcugcaggcaccugccacugugcagagccuggggcugcugggcgaccggcuaugugugggcgccgccgguggcuuugcacucuacccgcugcucaacgaggcugcgccguuggcgcugggggccgguuuggugccugaggagcugccaccaucccgcgggggccugggugaggcacugggugccguggagcuuagccucagcgaguuccugcuacucuucaccacugcuggcaucuacguggauggcgcaggccgcaagucucguggccacgagcuguuguggccagcagcgcccaugggcugggguaaggccugcugagggcuuggcaggggggccaggcaccuucagugggugggugaagacagggucccgccucaacucaugagccuggcauuggaggccuuuggugccaguuugcauccuccagcccaacaacacccugucccacccucuguggcuugcaggggaccuuccuuuuccauggcugagcucaugcuccucuccugccugagccgcucuccuuuuguuucuaucuagcaaacuuuuuuuuucuuuugagacagggucucugucugucaccaggcuggaguacaguggcacaaucucgacucacugccaccuccgccuccuggggucaagugauccucccaccucacccucucgaguaacugggggcacaggugugugccaucacgccuggcuaauuuuuguuuuguuuuguuugagacagaggagucucacucugucgccaggcuggagugcaguggugugaucucggcucacugcaaccuuugcuucccggguucaggugauucuccugccucagccucccuaguagcugggacuacaggugcacgccaccacacccagcuaauuuuuguauuuuuaguggagacgggguuucaccauguuggccaggcuggucucaaacuccugaccaagugauccaccugccuuggccucccaaagugcugggauuacaggcguuagccaacgcguccagccuaauuuuuguauuuuuucagagaugggguuucgccauauugcgcaggcugggagucucaaacuccugaacucaagcaauccucccgcgcggccucccaaagugcugggauuacaggugugagccaccggccccggccuguaccuggcaaacucuuaacuagguaccaccccagugucagcucagggccuggagcugguaggcgcuccaaagauaaccgcugcgauugcuguggucaccauugccuucgugcuccccgcccugcuuccccgucauugguccuuuccuucucuuugccccacucucucuccguccagaccugugucacggcucucaucgccuccacuucaugacuggcuuggugcacuggggucccacagaaugggccggggcugguuuccucauccacaucaagcccccagcccaggguggcacacuccaggggcgaugggcuuggaggaaugaguggaagagugaaugaaugaaugaaugaggcaguggggcagucuggugcaugcacaaguaacuagcaugauggguaagggcuggaagagaggggcagaguguccuucgugagcaauggcucuuugggguggggccugcagguugggugccgcauaucacccaagcugcccagggccaaaucgcagcucucaggaccagcugagugaccugaccuugaccaucacauggcuccagggguuccauucccucaucuggaaauuagggauuauaacaguaguacuugcucagaguuguuagaaaauuaaggcaggaaaagcaugucguguuuagaacugagccaggcauguggugagugguccaggguuaucucugauuugauguggaggcugggccgggcgacagggagucuucagaggaaggaccuuagcguggggcaugguaguuacugugcuguggcaggggacaagguguucccuguggaacagagggggaaacagcucagaggugccuggcgugcccgcaggguaugcggcccccuaccugacaguguucagcgagaacuccaucgauguguuugacgugaggagggcagaaugggugcagaccgugccgcucaagaaggugaggguccgccagagcccugggguagcgccggggguggaggcguggccugaccgcugugccugcugccucaggugcggccccucaauccagagggcucccuguuccucuacggcaccgagaagguccgccugaccuaccucaggaaccagcuggcaggugagggagugcguguguacgggugugugcguuccccagugcgcacguguggcuguguggcccugaaugccagcugacugggccccgggaaugugugagcacagcccagcucuccacuucucccacagagaaggacgaguucgacaucccggaccucaccgacaacagccggcgccagcuguuccgcaccaagagcaagcgccgcuucuuuuuccgcgugucggaggagcagcagaagcagcagcgcaggugcgcgugcacgacgcgggggcugaggcuggguggggccgccuccgcuuguggacgggucgaagggaggguggagcuucgccacccacuacuuacaccuccgcccacagggagaugcugaaggacccuuuugugcgcuccaagcucaucucgccgccuaccaacuucaaccaccuaguacacgugggcccugccaacgggcggcccggcgccagggacaaguccccgguuaguccucuggagccaaucacaagccacuuuggugaggcugagccaauaaccggccucuguggugagcucuagccaaucacgggccgcuguaauuacuccuaaggccugggacucacacuucugcuaccugggacuuaaguaaaaccaggcugggggcccaguggcguucauuuguccuggucuguugugccuugggccucuuguccuccuugugccugcuagucccagccccuccgcacugucacccaacaggcucccgaagagaagggccgaguugcccgcggcuccggcccacagcggccccacagcuucuccgaggcguugcggcgcccagccuccaugggcagcgaaggccucgguggagacgcagaccccaguaagggcagccccucagccuccagugugccaccccccaccccaaguuucuacccccuuuggaucccugaaaucugaucuugguauuuuugucuccucgucugcugcuggagcagugaagaggaaacccuggacaucccuguccagcgagucuguguccugcccccagggaucgcugagcccugcaaccucccuaaugcaggugagcggguccgggaggcuuguccguccccuauucaaacgucaggcaguuccguuuuaugcuaggccuugcacagugaccuaggcuagggaacaagcugagcccaucccugcccucgauucuacgagaugcagauucuuaccugucucaccccaccagugggcaccagcaggauccuggaugcaggccagccuaggugggaaucuuggcucugacuguuccagcuguguggcucugggcaaaaugcccaaccucccugaucuugucuuaccuguaaaaugaugugguuucugggaggccugcaugagcugaugauaccugcgaagggcucagcauaguaccuggcauggggaaggugccacagaaggggagcucuugggauucuuuuuuuuuuuuuuuuuuccagauggagucucacucugucacccagacuggagugcaguggcacaaucucggucagugcaacccccaccucccacauuugagcaagucuccuaccucagccucucccaagucgcugguauuacaggcaugcaucaccaugcccagcuaauucuuguauuuuaaguagagaugggguuucauuauguuggccaggcuggucucgaacuccugaccucaagugauccgcccaccuuggccucccaaaguguugggauuacugaugugagccaccaugcccggccacucuugggauucuuaauagaggcccaguccacagcagggaguuggggggucagaggagggagcaguccauucugaaugagggcaggggaaaaccuaagagaagccagggagguucccauucccccugcagccacgucuacagcacacacauccacccacucccgucacaccaggccacuuggagcccuggggcuugccauguucuuccacaccugcaggcucuugccccugcaguccccucuguuuugaaugccuuuucucuaucuucaccuuaaccaacaucagacugcccuccaggugacccaccaggaucaucuucaaaggagccuuccuggccgcuuggucagguagucauugccucccuggggcuggugccaccuuugccaccccgcucccuccacaccuuccuugcagcuucugcugugcuguggguuucuucuggugccuguucuccucuguugacugugggcuccuugguggugggggucaggcuucauucuucugcccagaguaaagcauguggucgacugaaggaagaauggagugaaugaacaaagggacuuugaggcugggcgcuguggcucaccccuguaaucgcagcacuuugggaggcugaggcaggcagaucacuugaggucaagaguucaagaccagccuggccaacauggugaaacccugucucuacuaaaaauacaaaaauuagcugggccugguggugcaugcuuguaaucccagcuaccuggugggccgaggcaggagaaucacuugaaccugggaggcggagguugcagugagccaagaucaugccacugcauuccagccuccagagcgagacucugucuccaaaaaaaaaaacgaaaaacaaaaauuaacuaggcaugguggugcaugccugucaucccagcuaccugggaggcagaggcaggagaaucacuagaaccugggaggcagagguugcagugagccaagaucaugccauuauugcacuccaggcuaggcgacagagcaagacucugucucagaaaaaaagaaaaaaaaaaggacuuugaguccauucaaaguuaaguaggagcucuccagguucuuccagugacccauuuaccaccucuacuccucaccucacaucuggcuuccuccaggggcccugauacagugggugauggguccuaagggggccuccaggacccaccagcccuaugaggaaagaguucuuccugauccuaccccuugacuuccuuuucuuucuccugcaggucucagaacggccccgaagccucccccuauccccugaauuggagagcucuccuugaugcccucuguuagggcccaccccaaucccagggcagaaggacaugagggagcaaagagcuugaggaaugccauacuccggcugguccgggacauggaaauucggacucagggaggacccgggcugggcaaugacugggagacuugccuggguucccaggacuuggggguccugacucccagcccucauccugccuuaccccucuguucccagccccagccuuucuaagccauugggaauagaauggccccuuuuguucugguguccaggggugauugugccaaagcucuuauuuccagugccaagcccccagaggcuuguaagaguugggaugagggauggagagggacugggucucugggaacagguuggaggucuuaucuguggacugucugacucccagcugaggccaagauggggcauguccccgucucugcuuagcgucugggugagaaaaacaggcugugauccagaagaagggaagauagagaaggagggaaaggauguaggcgaaggaggugagagacaggauaggaggaaggaaguggaggaggaggugauaggaauuggaaggagguagaagccgugcagaggaagaggggagagggacgaaggaggagcgaugaagaagaggagggagacaaaaagagggauggaggagagagggagucuggagaacaaaggguccuuucucuggggaggggugcagugggcggggcugacacugucagccaauccucccaucggggaagagaauccuggacagggacaggauggggaggguauuuauaagggcuuuuuggugggagauggguacccagugggggccacuggagggucuccgggcacacucuggcccuucccagaaagggggucguuuuucucgaaucuucaaccaguuguguauuggaaacuagggcgcauuuuacuauugaucacagucauuauauuguuauuauauuacuauuuuuauuaaaccuccccccacugaaguguggggggcaaaauaaguauuuaucuccucaaaugccacauucccaggagggacagacccugaugcucugugaggcgcaagaaaccaauaaagaugccgggcgcgguggcucacgccuguaaucccagcacuuugggaggccgaggcgggcagaucccgaggucaggagauugagaccauccuggcuaacacggugaaaccccaucucuacuaaaaauacaaaaaauuagccgggcguggugacgggugccuguagucccugcuacucgggaggcugaggcaggagaauggcgugaacccgggaggcggagcuugcagugagccgagaucgcgccacugcacuccagccugggugacagagugagacuccgucucaaaaaaaaaaaaaaagaaaagaaaaggaaaccaauaaagacagcuuuguaagcugcuggcc

SEQ ID NO: 18699 - RNA, 16491 nt, Homo sapiens
ccucagagccacgggcgcccgccccgccccgcgccgccccgcgccggcuccgcagcucgcgcccgcccgccugccggcccgcccggcgccgggccauggcgcugcugcgggaugugucgcugcaggacccgcgggaccgcuucgagcugcugcagcgcgugggggccgggaccuauggcgacgucuacaaggugcgacgggacgggcgggagagccgggaggagggugccagccccgcaccccgcggcaggaucuagcccccggccccgccccccaucccgcuucacccuccgccccugcaggcccgcgacacggucacguccgaacuggccgccgugaagauagucaagcuagacccaggugagggcccgggucgggccucugcgccagaggaagggcagagcgcccgcgggcgcggggugcgggcggaggguugacguuuccgagaccccugagaggcgugccccgggaggugcugucaccugcaccugccuggcccggagggaggcacucugugcccauuuugcagaugggggcacugagucagggcaaccccagcgcgccuuccccaugaugcuuugugcuucccaggggacgacaucagcucccuccagcaggaaaucaccauccugcgugagugccgccaccccaaugugguggccuacauuggcagcuaccucaggugaggcugccuuauccuccuggccccaggcagcccccaugugaccugcuuugugcccaccccagcucuuugucccuaggaaugaccgcuuguggaucugcauggaguucugcggagggggcucccugcaggagauuuaccauggugaggccagggcuccaggccccagcaggccccagccuucccccaccccuaccccacugggguaccagaggggacucugggcccuggacuugggcuccucuccacuccugccuggcugugugaccuugagagaaauacuguccaucucuggguucaguauccuagacuaaacugggaggggacguggccaacaccgcuuucauuuaacagugccugcugcuuuucccacacacgguagccugggagggugggcaugacccccgggcccccaagccagccucucccuuuuccuuucagccacugggccccuggaggagcggcagauugccuacgucugccgagaggcacugaagguagcugggccugugaggugcccacaccucuggucuccagaagcugugggccaggagcccagaugaccagcagggaggcggguggagugccucggguggggcuggcccgaggggcuguagguccuggggaaaaggggccccagcccuguugccggaagcaguccauuucccucuuggcucagucacuuccuguuuggggagaggggaggaagaagcagccugaguggggggccccaguccugagaggggguuuggggaggugggacagugcuggguggcugcucucagggacuccucuuugucgccaggggcuccaccaccugcauucucaggggaagauccacagagacaucaagguaggcaccuagcugggggcacuccuggggagggaggaggaggcccucgggggcaccagaugggauugucucuccuccauucccacagggagccaaccuucuccucacucuccagggagaugucaaacugggucaguacccuggggacaccaucagggugagggcucuguggacccuccccggcuacccuggacucaaggguugggugucacugggcaagucacuuugccacuugagucucaguuucccugcuuagaagauggaacgguacucccucccugcuggaaaauagaggagguugggucugcacggaguugacaugggaccaggcacuccgucagggauagagggugguugaccccucucaggagagggaccuggccuugccuagggccugcggcagcugugaccaagcggggccaccugcccgucugagcccugccaggugcagccgagccagagcccugggcgugggagggugaguggcagccagagggcuggugagaguggcuguuucuccccacagcugacuuuggggugucaggcgagcugacagcgucuguggccaagaggaggucuuucauugggacucccuacuggugaggcugcgccuggggcggagggguaggggccacagagcagggcacccggccaucccaucugugaccccaccucuaggauggcucccgagguggcugcuguggagcgcaaagguggcuacaaugagcuaugugacgucugggcccugggcaucacugccauugagcugggcgagcugcagcccccucuguuccaccugcaccccaugaggucagcccaacacuugccccucaccugacccuugaucugcggccuguggccccugaccucgcgcccuccacagggcccugaugcucaugucgaagagcagcuuccagccgcccaaacugagagauaagacucgcugguaagggccacacccugcugccgggacccccuuuucugucagccccauaguggacaaacagccucugccaacucccggggggcaaccccaagagcccuguccuuucugggcuacuacagaccaucugagucaggggccugguccuucuguggguugaagacccagcguggucaggaaagaagggcagaggguugguggaggagccgcugugucgcaaggcagcguugcucggccaguggcccuuggccucggcuggcuccuuccugggugggcccagcagacgccucuggaggggugguagggcagcuggcaggacacccugcacgagggcuaaccuggaucuggcgcuggggggcucuugugccuucuaggacccagaauuuccaccacuuucucaaacuggcccugaccaagaauccuaagaagaggccgacagcagagaagcuccugcaggugggaggcagggggccgggagagaggcccaguacucaaaagcagggcccuggaucaggggccaaccugaucaccccccucccccacuuuccagcacccguucacgacucagcagcucccucgggcccuccucacacagcugcuggacaaagccagugacccucaucuggggacccccuccccugaggacugugagcuggagguaggugaggggggcuggaaagugagucuugggcuggucugcuuagaaagagcccgagggugauguugguggagguccuuuaacuggcaccauuccagcucagggagcuggccucagcugagcccucccauuaggagucucugucaugcugacuuuuguuuccuguaccacccccuugauaggucccugcccuugaguccaagcugaccaugaccacgacugugccauuuucuugcuuucugugugaucuuuggcacugcucuguguggguucucucaucugugaagugggguuccauuuuauuuuacaguagucccagagggcugucaugaaagcaaaacgcacuggugcgugugaagcuccuagagcagccccggcaugaggcgcgugccagguguguccacacuguuucuguuuuuccuuagaccuaugacauguuuccagacaccauucacucccgggggcagcacggcccagccgagaggacccccucggagauccagugugagucugcagcaggggcugugugugugcagauuuuggggggccugugugcacauggauuuggugugaguagagguccauccugagacuccagcuccuucacucuuguacucugggccccccaguucaccaggugaaauuuggcgccccacgcaggaaggaaacugacccacugaaugagccggugagugggcaggccuugaggggaagguggugcccagagguggggcagggaggucggauggaggccgagcagcucaaaucaagggagauuugaagcuggguggccucgggccuugggccuuagacuguccaagcaagccuguccuacccagggaccuggaggguuaggggcuccuuccugggccaaguucuuuuaggugggugucuggaagguagcacagagaccaugccuuucccaaaaggaggccgucaugugccugagcccucacccuacccugcucagccucguuuucccaccuguguguccccaguggucugacuuucugucucugcccucaucggcucugucacuggucucuccucaccccccagccugucucuuccucccucgcugucuguugcccuuucuuucacagucuucagcucugccucccacugucugucucucucaucuucuguguguuuccaucucaccuuucccgucugucugucugucugucuuuccuuuccugaaucucuugagcgcccucucacguugcaucugucucugcuucuuccccggucucuaccuugguuucccccagugggaggaagaguggacacuacugggaaaggaagaguugaguggguaagugagguauggggaagcugcaggggguggcaggggcggcagaaaggcugaccucugaccgggcgugguggcucaugccuguaaucccagcacuuuaggaggcugagguggguggaucaccugaggucaggaguucaagaccagcuuugccaacauggugaaacuccaccucuacuuaaaauacaaaaauuaggcugggcggguggcucaugccuguaaucccagcacuuugggaggcuaagguggguggaucaccugaggucaggaguucgaaaccagcuuugccaacauggugaaaccccaucucuacuuaaaauacaaaaauuaggcuggcugugguggcuuacgccuguaaucccagcacuuugggaggccgaggugggcggaucccaaggucaggaguuugagaccagccuggccaacauggugaaagcccgucucuaguaaaaauagaaaaaauuagccggugugguggcaggcgccuguaaucccagcuacucaggaggcuaagacaggagaaucgcuugaacccgggaggcggagguugcggugagcugagacugcaccacugcacuccagccugggcaacagagcgagacuccaucucagauaaauaaauaaacaaacaaaaguuagcugggcaugguggcccacgccuguaaucccagcuacuaggguggcugagguaggagaaucugggaggcagagguugcagugagccgauaucuugccauugcacgccagccugggugacaagaaugaaacucugucuuaaaaaaaaaaaaaaaagcccggguguggcucaugccuguaaucugagcacuuugggaggccgaggugggcggaucacaagggcaggagaucgaaaccauccuggcuaacacggugaaacccccucuguacuaaaaauacaaaaaauuagccgggugcgguggcgggcgccuguagucccagcuacuugggaggcugaggcaggagaauggcgugaacuuggggggcggagcuugcagugagccgcgauugcgccacugcacuccggccugggugacagagcgagacuccgucucaaaaaaaaaaaaaaaaaaaaggaaagguugaccucugaccccuuuuccccacugcccaggagccugcugcagucgguccaggaggcccuggaggaaaggugagggaugugggccugggggaggggcaaggggcagguggccuuggugccagucacaccucaugccucacgccucaucucccucccacaggagucugacuauucggucagccucagaauuccaggugccacacagagggaggcuggagcugggauccaggccacugcagaggguacgauuggagugggaugugguuacagggcaaccugguaacggccgggcugggcccugccccuccuaccaggagcuggacuccccagacgauaccaugggaaccaucaagcgggccccguuccuagggccacuccccacugacccuccagcagaggagccucuguccagucccccaggugagucucaggcuugggaggccaggaggcagccccagggugggggcuacagcaggaaauuacagcacgccugugccugcaggaacccugcccccaccuccuucaggccccaacagcuccccacugcugcccacggccugggccaccaugaagcagcgggaggauccugagguaagagggugcuacagugggguggggagacgggcggcuacagcugucauaucagcccugacuccuuuccucccucccagaggucauccugccacgggcuccccccaacucccaaggugcauguaaguguuugccccaagcccugcagucccacagcccugccacccaccaccccugcacucccucgccagccucuugccuccucugcagaugggcgccugcuucuccaaggucuucaauggcugcccccugcggauccacgcugcugucaccuggauucacccuguuacucgggguaggugggggcagggaggaagcgggagcccaaggaaucccucagcuugggccaggggccaugucugaccucugaccccaugcccaaacuggcagaccaguuccuggugguaggggccgaggaaggcaucuacacacucaaccugcaugaacugcaugaggauacgcuggagaaggugaggcccggcuggcuguggggggcagaggccuugugggggccuggggugcugaccaucugucccucuguggccuccagcugauuucacaucgcugcuccuggcucuacugcgugaacaacgugcugcugucacucucagguacaaggugggaugggcagggaggcaggguccgcaggggcuccagcgccucagcauccugcccaccaacaccccaggccuggccucuuccuguuucugcagggaaauccacgcacaucugggcccaugaccucccaggccuguuugagcagcggaggcuacagcaacagguuccccucuccauccccaccaaccgccucacccagcgcaucauccccaggucagggaucuugggcgugcagggagcgggaggcagaggggcagggaggggcuggaacauggccuugccaguuccugggauugcagcaaucuuagacguguugucucucugagcgcccguuuccuccucugucaauacaauugauggccuucccacccccucccgccggcuuguugggaggcaagaaggagacaguggaugugaaagugcuuuccaaguuguaggagcugugguuguucggauguggggcuugacaguuaagcaaacguuuacugagcacuuaugcuauguuggccccuaugcugggcuucgggacauggagaaucccaugaguccucgcuuucaagaaaugggggagaugggcaaguccuugcuuucaaggauucccaugaguccuugcuuucaaggauucccaugaguccuugcuuucaagaaacagcggggcuggguguggugguucaugccuguaaucccaauccuguaauccgaggcagaaggauugugugaggccauguguuugaaaucagccugaaaacacagggagaccuugucucuacaaaaaaucaaaaaagucugggcgggggggcucacgccuguaaucccagcacuuugggaggccaaggcggauggaucacgaggucaggagauggagacuauccuggcuaacauagugaaaccccgucuguacuaaaaauacaaaaaaaauuagccgggcgugguggcacaugccuguagucccagcuacucgggaggcugagacaggagaaucgcuugaaccugagaggcagagguugcagugagccgggaucacgccacugcacuccagccuggccgacagcaagagucugucucaaaaaagaaagaaaaaaagcccaaaaaaucaaaaaauggggccaggcgcaguggcucaggccuauaauccuagcacuuugagaggccgaggugggcggaucaugaggucaggaguuuacgaccagccuggcuaauauggugaaaccccgucucuacugaaaauacaaaaauuagcuggguguaguggugcgcaccuguagucccagcuacucgggaggcugaggcagaagaaucacuugaacccuagaggcagagguugcagugaguggagauugcaccacugcacuccagccagggcgacagagugagacugcaucucaaaaaaaaaaaaaaaaaaaaucgaaaacuuagcugagcauggugauguaggcauggcguuguguguugguggucccagccacucaggaggcugaggugggaggauugcuugaacccaggagguugagguugaagugaacugugaucgcgaucguaccacugcauugaagccugggcaacagagcaagaccuugucucaaaaaaaagaaaaagggaaauguggacaguuagcagccgguacugagguccaguuagagggagagcugggagguguggagaggccucagagaccgggcaagcuugggagguucgaaagugugucaggguuucuaggcaggugagguagggaauggcacuccaggcagggggaagagcaaguauauguuaguauguguuggggcggagcagccuggugagcuggggagcuguuaagaguuugccugggggccaggcacaguggcucacgccuguaaucccgcacuuugggaggcuuuggcgaguggaucaacugagucaggaguucgagaccagccuggucaacauggcgaaaccccgucccuaguaaaaauacaaaaauuagccgggcaugguggcgggcgccuguaaucccagcuacucgggaggcugaggcaggagaauagcuugaaccugggaggcggagguugcaaugagccgagaucgcaccauugcacuccagccugggcaacagagcaagacuccgucucaaaaaaaaaagaaaaacagaagagaaaaacagucagauucugauucucuuuugcaaguugagccaguaggauuuccugaugaaagagaaagaggagucaaggauggcuccaagguuuuuggccugggugucaggaagaaugcagcugucaucagcugaagguggagcaguuucagggggagcugaauucaauuuuguugcaugaacaugcuuauuagaugugcaagugggaccugcgucaguccauggcuugguggggcugggcucugaagggaggggcccugggcuaugggcccccgacauugucaugaccagguggguggugugggaagcaguggacugagugcagaggguaggggaggccaggccaguggcugcaacagcuggggagcucaggagcccccuuccugcaacgugcucacuccaggaccacaucuggagcccgguggccuuggggcuuccugagcucaguccccaagugagucugcuuuggcgcaggaccuacaggaaacaggcccaucagagccccaacaggucacaggcagcuuugagcuuguguucgggaaauggcagaggcacagugagcacuuugaaugcaaagaacagagaacuggaguuguuuggagaaaaaacaaauacaaaauauaugcuuuugucccauccaaagaccagauggggaggagagugggaggaauguggggagagggagggacgaggaccagggacagugagagacagacauuggcuuccuccauguccuggcagaagguacaaacaggacaugggccacuggguggagguggcagggcugcugacaggaagccccauuccccagaggaagaaacaggcugagaggguccccuggaggguuaggggacacucaguggccaaggcaacggccccucugauaacuuuuccucacuacuucuaccccgacagcaaggcaagccacccccuggccccacagggcuguugccucugcuggagaagcagagggcaggccauuugccuuuugaaguucauucacugccccgggccuguuuucccaucugugaaaugggccgugugcagucugugcaaccugguggggcuggagccugcauccuccccagccccuccaugcucucauuucuucauuccuuuuuucuuuuucuuuuuuuuugagaccgaguuucacucucauugcccgggcuggaguccgauggcacaaucucggcucacugcaaccuccgccuccuggguucaagcaauucuccugccucagccucccaaguagcugggauuacaggcacgcgccaccacgccuggcuaauuuuguauuuuuaguagagacaggguuucucuauguuggucaggcuggucucgaacucccgaccucgggugaucugccuaccucgaccucccagagugcugggauuacaggcgugagccguugcaccuggcaucauuucuuucuuuauacccugccuuuaccugacaaggacuuucagugacucaaaauagguggaaaguccuaauaugggaugauaggagcuggcccucugugagcacacacgauucccagcacugccgagagcaccuccccuguauuaacucaugaagccuucacugugacucucugggguggggcccgccauuauccccaaucuacagaugacgaaacugaggcauggagagauuaaguggcuugccuggagucacacagagcuagaagcaauccugagacccaaaccccuggccuggauggagacacucccuccuggcuucagggcugggagacuggcuucagauccuccaccuuucccagcuguucuuggggcaaguuacucugugucucugagucucagucccuuacuuguaaagagggaagcugauagugcccaccucauagggcucugcaggggccuugcccauggauggcaucccagacacaggcccugguuaucaccccuacaggcgcuuugcucuguccaccaagauuccugacaccaaaggcugcuugcagugucguguggguaagaaaugggcugggcgggguggggcggggccugguggggggcagcgcaggcccagcccggugcccacugccugcuccccugccagugcggaaccccuacacgggugccaccuuccugcuggccgcccugcccaccagccugcuccugcugcagugguaugagccgcugcagaaguuucugcugcugaaggugaggggcgguggggggaggcccagggcacccucagagcucuggggggagaaauggagaccugagcaucccugcugcccccuagaacuucuccagcccucugcccagcccagcugggaugcuggagccgcuggugcuggaugggaaggagcugccgcagguguguguuggggccgaggggccugaggggcccggcugccgcguccuguuccauguccugccccuggaggcuggccugacgcccgacauccucaucccaccuggugagcagaagggccaggcugcugggggugggugugugugcaugagagaccgagggagggaggcagggagggccaaggcucccaaacuaggcuccccacagccaguggcuccacagagaccuugagggcugccauguggggucuggggcccacagccucccuucaacaagcuucaccugggcuuccauaaaaggguucauuagacggaagggcuuggcagcuaagaaaauccuggccaggccgggcacaguggcucacgccuguaaucccagcauuuugggaggccaaggagagagaggggcuugagcucaugaguuugagaccagccuggacaacauggcgagacccugacucuacaaaaaauuagcugggcauguugaugcacguguguagucccagcuacuugggcugaggugggaggaucacuugagccugggagacagaggcaguugugagccauguucgcgccacugcacuccagccugggugacagagugagacccuaucucaaaacaaaaaacaaaaacaaaaacaaaaacuggucaacauugcuccgggcugcagggaagaggcagaucuggcaaggcagggccuagaggccccauucucagccaggaagcaggacuccagguguuguggcagcuuggggugauaaugagcagugauggguaagggagaaaggagggcgcacguaguuaaggcaccuggugccaggcccugagccaggggucucacacacaggauuuuauucuuuauuuauuuuuuuauuuuuugagacagagucuugcucuguugcccaggcuggagugcaauggcacgaucucggcucacugcaaccucugccucguggguucaagcuauucucuugccucagccucccgaguagcugggauuacaagcaugugccaccacguccggcuacguuuuguauuauuaguagaaaugggguuucgccauguuggccaggcuggucuccaacaccugaucucaggugauccacccgcuucggccucccacagugcugggauuacaggugugagccacugcgcccagcccaggauuuuauuccugauccucaugauagccucucaaggcagugccaucuugucuguguuaugaggaaacagaggcuccgagagguaaagugauuuguaccaggucacacagugacugggucacgaggccugguccccuuaaaccuggagcccucccguggcuccccgugacuccuccuccacuccccaugagcccuaggacgggucacucauccucucagagccucaguucccagcccuggagggagaugagguuucccagccccacagggcuguugugaggcugacgugcccucauggccaagggcugucuguagccuggcccccguauccucuugggguugggggacugguggcucagccaggccaugucucucuucucugccugcagaggggaucccaggcucggcccagcaggugauccagguggacagggacacaauccuagucagcuuugaacgugagugcccugggggcagggcuuagggcaggggacuauggagguaaggcgaccacgugggucugccuucccagaagggagccuccccguccccacucaccaauuccuucccugugcaggcugugugaggauugucaacaugcagggcgagcccacggccacacuggcaccugagcugaccuuugauuuccccaucgagacugugggugagugagccagagguggggugcaggccuuucccuggccuggagcacguuguugcucaggggccuggggcuggcgguaggaugaggaggcagauccccuagccccucuccugagccauccuggucaccugaggucagugaggaccccuguggcccagacccaggcucaggcguggcugagggggugccaagaugggugcagggcugaugguggccuggcccccauagugugccugcaggacagugugcuggccuucuggagccaugggaugcaaggccgaagccuggauaccaaugaggugaguggggcccagggaccuugcuguccccugccuuguggucccuaccucuuuggaaaggaccuacuggaguggccucagugcuucccaccugucuucccaggugacccaggagaucacagaugaaacaaggaucuuccgagugcuuggggcccacagguaggcggugguacccuagccuccccuucagaugccccugaggccagagaaggggcugauguaccaagugucucccgcccugcccccuacuccucucuccuccagagacaucauccuggagagcauucccacugacaacccagaggcgcacagcaaccucuacauccucacgggccaccagagcaccuacuaagagcagcgggccuguccaggggcuccccgccccaccccacgccuuagcugcaggcccuuuugggcaaaggggcccauccuagaccagaggagcccaggcccuggcccugcuggggcugaaggucagaaguaauccugagaaauguuucaggccuggggagggaggggagcccccgacgccucugcaauaacuggaccagggggagcugcugucacucccccauccccgaggcagcccagucccuagugcccaaggcagggacccugggccugggccauccauuccauuuuguuccacauuuccuuucuacucuuucugccaagagccugccccugcauuuguccugggaaacacgguauuuaagagagaacuauauugguauuaaagcugguuuguuuuaguccucuggucccucuggguagggggagugaacccaccucaucucccgccuccuucccuccaacacacguuucugugggcaccacagaagggcagggcccccaggguuuuggagaagccagguagaggugacaggaggccauggcccccagcagccuucuaggggcacugugccuuccccugcauccuugcucagaacugacccucagcuuugcaguuugagggcucugcuguaguuuagcaccccaaggacucaugcagauggggggaccucaacaaagggacucucauccagggcacccuugccccacguaggaucucacugggugaccccuggaagggcccaggaggagcccccagagggcuguucccuccauucccauggaggcugcugcccauggagguagccugugugaccuguauccccugccuccaccuacugccuagguguuagaccaggaacaucagaugacagcacgaucaucagauuggaugggaaggcuagccuguguccgucuaccagacucccaagggcugccucagugccaggcccuggggucacuaccagaaacagaccagcccccagggagggcguccuccuugcuggagccugcaucuugagggcauggccauucuccuguagcuugugcuuacgcugucauucuccaagggucugucugcucagcucugaaugccagggcccccagggcugggcauccucuuuugccccaggcacugaucagccgcucuugacuggagccuuugggcagcugcagcccaggaggcaggaugggaacugccuugagggcccacagcuggggggcugggaaggugggggcaggguggggggaacagcuggagcaaaggccccauggucaccccuacauucaaggcagguguuggaggaagaccuuugcaccugguggguggcaauaaagacuugcggagugacgugguagguggauggcagccaugcgaguaggcucagugguucccagggugucacacuguccccucagccacccuccagcagaguuucaacuguucugacucuguccagugacugggaggguuucuuggcuggaauggggagccagcccaggggagggaacacaucucuucacaccaggcauucacacccauguucccgugagccccaaggagggugaggggcaccuuccaaauuggggucggugguaacagggauacaaagugaauuccuaacuuccaauuuuccagauuucucggaggaauguugggaccagggugggguaaguggggacagggaggugagcuccugcucagcaaaggcccugaccaaaggcgcccuggggaggacuggcuuuccguucaccaaccggccagcagcagacagugccuccuuguggcggaucuucccggaccucagauucagucuggaaacgggguuuggacugcagaguguaaacugccaaagugggggccucccauaaaacgcuugcugccagcaaaggcaggccaagagcaaagaaaggccgagaaaccagggaauaugcacugagagacuaacacuuuaaauuuuauuuauguauuuuuaaaugcguaaccuuugcccaugguacauauuuuuuuaaauacagcagagauauaaugaagucucccucuuaccccguccccagccacccuggucucaguuacuuaugaacccuucuagaaguauuuugcguauuuaagcaauuugguauauuuuauucuuggcgauuuuuuauauacguauuaacauauuccacauacuguacugaccuugcccuuuaaaaauauauccuggggggccaggugugguggcucacaccuguaauccaagcacuuugggaggccgaggcgggcgaaucacgaggucagggguucgagaccagccuggccaacauggugaaaccccgucucuacuaaaaauacaaaaaauuagcugggcaugguggcgagugccuguaaucccagcuacucgggaggcugaggcaggagaaucgcuugaaccugggaggcggagguugcagugagccuagaacaugccacugcacuccagccugggcgacagugcaagacuccgucucaaaaaaaaaaaaaagagaaaaaaauauauauauauccuggagaauaugaauguauuaaauuaucacaugcacccugaaaagauauguauauauccuggagaguuuugcguuaaagaucucccuuuaaaaaaaaauuuuuuuuuuuuuacagcuagugguauuccauuguguauguuucccauaacaaauguuaaugaccugcagugagaucccuauugguggaaauuugaguuguuuuuacuacuuuuauauuacaaacaaugcugcaauaaauauuauuaggcuagugccccu

SEQ ID NO: 18700 - RNA, 15389 nt, Homo sapiens
caguucacgcaguaacaaaugaagugcgcgcugcgacaccucccagcccaccgaacuccgccgccauuuccucgcuuggccuaacgguucggccaaucccagcgcgcaucaagaaggacugaggcuccgccaaucggaggccgccgauuucgacccuucgccucggcccggcccaauccaggccccggccccgccgcccccggcccgcccccgcggugcccucucuccucccucuuugugcgucucgcgccgccgccgcccgccgcgugagaggacgggcuccgcgcgcuccggcagcgcauucggguccccuccccccgggaggcuugcgaaggagaagccgccgcagaggaaaagcaggugccggugccuguccccgggggcgccauggcgaccggagcgaacgccacgccguuggguaagcugggcccccccgggcugcccccgcuccccgggcccaaaggaggcuucgagccgggcccuccgccugcacccgggccuggggcggggcugcuggcucccgggccgccgccgcccccgcccgugggcucgaugggggcccugaccgcggccuuccccuucgcggcgcugccuccgccgccuccgccgccgcccccuccgccuccccagcagccgccgccgccuccaccgccaccgucccccggcgccucguacccgccgccgcagccgcccccuccgccgccgcucuaccagcgcgugucgccgccgcagccgccgccaccccagccgccgcguaaggaccagcagccgggcccggccggcggcggaggaggugagucgggccgagagagcgcgagaggcgucgcgcggacgggcccggccgccugaggggcgcgcggcggcggcgacggcggcugcacgcggcaggggcgcgcgugcgcgcacggggaggcccgggcggaggcgccccugggcgcgcgcggccugguucuagggccucgagugcgcacgcgcgcuguggggggagggcugggcgggcgggaggcgcucugugcgcagacgcagugagguggccgggcugugcggcgcaacuguauagacugggggcccacuauugcuguccaguccgcuggugucgggaacagggguggcggguguucagcgcuggacggggugcuagcugugaaugccagcagggcgugaaagccucaccugaugacgugcagcgacucccuucuggucuugaggaaccagaaugggaaccguaccaaggauagcuccucugcuucuacagcaaggcaggguuuucauccgggagagguuggcaugcuucagaugaugguugggucugaucuuucuuggucucuuuuggggagagaauuuuaguuuguuuuuuuuuuuaaaucuguucaguauguuuagaucucagucugaucggcugcccugucgcuuuguuuuaaaaagcuuuucccucugauccuguaccccuugggaaauagaaggacucuuuuguggcaaauguagggaguuucugccuauguacggggaaaggagaacuuggcugcuauuguauagguuguugaauuuuugauagauccuuuuaagaguucagacccucaguguccaacuggccaggaaaacugaaugcugaucuuggcuaaacuuaugaagacaaaggugaucuuguugaagaauugggcuuuucccacuugguaggguguaacuagguuuaguugugguccggccucucguacaaaagugacuggugaggggaguggagguggguggagcccccagucccaucaggacugcuuuacaaaucuaugauucuucaguguauuuuugucuccccuggggauuucagagcacucaugguugauguaguaucuaucuaacacucucugcagccauaugcauuaagauuaccacguuuauauaucugacaguuuuucuagacaaaagaaggugaaauguuaacuugccugaccaaggaccacauacccuuguaguggccauaagcuuuaaaucucugaucucugagguuuguuuucuguuuuuuuaauguuuaaguuuuagguuaagcucucagcuucacagucugcugaguuucuguguaguaccuuaaauacccuuagcugucuguugauaacuacuuguauuuacaucggauggauuuugucucugccuuuuagacuucccaaguaagaagcggaagaggagccgcuggaaccaagacacaauggaacagaagacagugauuccaggaaugccuacaguuauucccccuggacuuacucgagaacaagaaagagcuuauauagguaaauauacguucugcauccaaaugcacuuugagauuguuacgauuuauucugagcaagaucugcauuuuuugaaaguuugagauuguaguuaucuuuuuugagaugagauacuuucacgacuuugguaucaucugucaguuuuugcccagugaguucugcauuugcagcuccuuguuuuggucuguucguaacugcaguguucuccaugaguaucaggaagguaggguuucacuuaggaguaagaacaguccccaguccagcagccacccuuuucagcugcuguucauugccaguugaugaggugagugucaucugccucucuggacaggccccaguggagaacaccgcagguacuguaaaccaaguacuuuucacagcguggccuuucaccauaauuuuauauuucucccccuaaaauguggucuuuuacuuuuuauagguacuuucugaaaaaaaaaaaaugacaaaaagugguucugaaaguguguuuacaauuuaccccuuuuuauuuucuugaauuuaagaguuuaaccuucccuucaacaucuuuucugguuuggucuauggagagcugucuuaaaaugaaggcucuuguauuuacuuuuaaagaacucugcugggaaagggauauugcauggauauggaaugaagugcuaggauaaaaagguuuuauuugcugggagguuuugagaauuaaugacuauccacaguggaauugaaauuaaccucaaaauugcuuuuuuggaaaaaaaaguuuuuaaugcaaguuuuaucuuuauauaccugugcagcugucucaaaaaaguucacuuuauaaacauuuccuacuaaccaaauaaacauccccuuuggaggaaauucgggcaaagaccuccuaaaccuacgaggcuguggccuucacaaccaaaaagcuucaaggccagcauguuacuacuuuugagggucuuaauuuccuguuuuuuagacugcugagaauuuugaggcguuggaauugucugucuccuuucacaguacuacuaauacuuguucuuuccccuacuguuccugucuacucccacccauuccauugugucucauauuagacuagucugggucuuuacauccuugugaaaugccccuaguggagugauaucccaagaacacaagcauacuuagaagaugggaagagcacaaauucuuuauaucuccauuucuguuuuuguggagggcuaguuaguucacugggcccuaaggacuauuuauagcuauaaucaaaauagaaucaaaggagagguguaguucuccacagaagagaaugacccuuuuuauuuagaucaggccccacaucuccauagucagcuaggaagacucaccuucuccccucagugaaggugacuuucaccucgaguuguugagcuuaauacucaacugcaaagucagaacuuuuuaggcauaaaggagcuuggggaaccaugugucuuacuacuuuucugucucccacgguacauacugcuuuguccaggaugcccucaauaucuuuuuuuuuuuuuuuuugagagacugagucuugcugugucgccaggcuggaguguaguggugcgaucucggcucacugcaaccugcgucucccggguucaagugauucucccaccucagccucccaaguagcugggacuacaggcgcacgccaccaugcccagcuaauuuuuuuuguaguuuuaguagagacgggguuucaccauguuggccaggauggucucgaucucuuguccucaugaucugccugccuuggccucccaaaguacugggauuacaggugugagccacugugcccggccaguauuuucuuucgauaauaauggguuuucauuucuucaggguuuuagugugugggugugguauagcccuguggauguauuuaaaguuagaaggaaucuuugguuagacacgcauuaauccuaucuuggagccagcucaguuuuaacccaaccuaguaacauuugcccuuauuggagaugccugcugaaaauucucagaugcugcgaagguaaggaacaggugguuauuccgcauguugaagaaagcugcucuggcucugcaguucccauuaucuuggaaaaucagcuguguaacauuucccuggcgucacuggcaacuuuugugaaacccucaucucucuuuuucaugcacagccucauuggucaaggcccgagggccaaguacauuguccuugaacacacauuccauucuucuacacgccugcuccccauaugaacagugagccugaaaacaaauucuuagcacuuuaugguuacugguuuauuaagauaugugguuugucauuuaauauuugaauaaauauuucauauaauugaauaagagcugcagguauugggagacccuuacuaguacaggucugguuguacagaaagaguauguacaaauuucuauaagguguugaauuuuguuauuaaaugucuuauuuaaggaauuuuaaauguauuaaugaaaaugaucuuugcucaauugguauuuuuccuugucccauguuaauugggucucauuuugggcuauguuuaacauuuaaugaagaaaaaacucaauucuugcccucaaguaauuugaugggagucggguauuggugacguaacaugguuuaugguucuggguaccaaugguaagcaagccuugguggggaggaagaggugaaacaccuccuaauaauugcuuggauguuagccuuagugaacagucuuuauugcuaaccccucuuccaacaaacuguuugcuuccuuaagugauaaccauuuugaagugaaaaaaaccuauagauguaaaaggacuccugccgauaggugguuggggguuuuugcuucaauguguucacugaucagucgucccuuucaaagucuccgaguucuucaugcuuguuguugagauuugagauguuuauugguaacauugucuuuuuuccauccuuuuuuuucuuuccuaaccugguuucuuccagugcaacugcagauagaagaccugacucguaaacugcgcacaggagaccugggcauccccccuaacccugaggacagguugggaaacaguuuuaaccagcugacaguaacgcuuuuaccuuuuucucaauacguuuuacugguggcaacauauugugucaguucaauaaaaucauaguaugacgacuguacccugaccacuuuggggauuaagguuuaauuagaaauauguauggucagucaacaguuagaaaauuggaauaaaacuuaaaaauguugggagaauaaaaaguuacaggaaaauggacaacugguuuccaauugguaagcauguagaucuuaaccugauuuacccacccuuaggggacagugagguggcccguuaaccugccuuuucaguaccugcuuuggccaaaagcccagggcauagaguuuuucucacagguacacagugcagggacuaaaaauauuuuugagcaucacugaacuugagcaagccaggagcucuggucagcucauugcugcagucuuccugcucaugguuuugagaugguuucaaaaucagaugagauuucuaaccaacuucuuucacugccaguuaacuuucagccuuggccauugccuuggggguguugggaggggccagaauauucucaccuauuuugggaaggcaugcaaccaacccuaaauuacuuuuuuuuuuuccuuaaagggagcgugggccucaaacagcuguggucaugucauuucaguuugcaguuucucucaccucagaaaaauaaauugugugggggagaugaacuuuuuuaaacuggaauuuuauuagcugauugaacagcuaaaauuggucauuuaauuagaagggcaguaagucucucccucucacugaauuuucucuuaguacauacagaauaguugaaaagacuuugcuuuaaaaaguaguguuuuugguuuuuguuacccaguuaauagcuuauuaaaucaggaagaugauguaauggcuuuagaagucacucacucaugcaucuuucuuccgcccuuugccaggaaacauuaacuuccuuguuucuccauauugacucuuuaauuugacuuacuacauuugcuauauuuuaccuauagauagauuuugguuguaggguuguguuguguuucguuucuuuuugaagauuuuuuuuuuuuuuaaauuuacauuguaggucauagaccacaacuguuuagugccuuuuuggccuuuuucccuuuaauaauaugucuacaggucaccagucaauuccuccaaagguugaauuuuuaacaaaccuucuuugcuuccuggauaacugggauuagaauuuaguugaucuagccgaugccuguuggaggugaagaagucgggccagucuaaccucuagaauacuagcuuuugccuuucacuucugcaauuugggaggagguuaaacuguugugaggccuucacauggccaauugggugcugguaagacuuguuuuuguaacuagcuaagaaugcuuaauucuagacagcuguggggugggaauuagaaaugucaagcauguuagaaauaaaaccagagcaggguuuuuccucccuucuauucaguuuugaaagaggcccuaaugccugauugguuuugcuuuugagcccagguuggagggaaaugcauggguuuucuuaauuaagauaauuucuuaaaaagguguuauaucacuuaagccacuuuauuguuauuuugaugcugcuuaacuugcacaguaaaaacauguuuaaaacuuuucuuguagacuuaaauguauaagaugguagucuaaugagcugggguauguuugcuuuuguucacucuuaauggauugugcuaacaguuuauacaaaugcuagaaacggaggugucauuuagccgucauuagccaugaacaaaccugaccuuuuauuccaucguguguguaacguggugugacaugguucccuuuaggcugaagacagugggagcagccgaguucaguccuugcucuccaacuaggcaagguucucucaacuaaaccaaggguauaggagucuugauuacuuucaguauguuuuuuuaauaaccugauccacauggucucuucccuucuugcagcugcuacuaaauuuucauucagaauaucaagcuaugguccuuuuuguaaucuuaacucaaaauucuaggaguguaaccucucuuuuuuauuaccgcaaaauccagcugugguaaacugaccauuuuaucauuacauuuuuuuacuuguagcaacagcauuuuacuccuuaaaaaaaugagagagagaaaaucugcuuucuggacuuguaaacucugguggagaaucauagguuuuccccuugcuguuugcagguucagacccuagacaaguaugaccaaaucugcauuugcagccucucgcagaagcugcuuuagcacuuuaacguuuuucucuacccagacuccccaaccucgaacagccagaaaacagguugucuccugggccuuggacacagccagccaggccauugaaggaaaagcaaagacgaagcgaaccaucucucuccauugugggggccaaguagcugcaguagccuucagucccaguugcauuggguuaaagagcucauacauacuauguguuagggguacagaagcuuuuccucauagggcaugagcucuccaagaguuaaccuuuugccuaaacuugggguuucugugguucauaaaguugggauauguauuuuuuuucaaauggaagaaaauccguauuuggcaagaagacuccaggggaugauacuguccuugccacuuacaguccaaagauuuuccccaaagaauagacauuuuuuccucucaucacuucuagaugcaaaaucuuuuauuuuuuuccuuucucacacacaccccagaccccuaacguuaagccagcuuccaucuccccauuccacacgaucuugaguagcacacguuauggucgguuccuccgaagaguguuguauuagggucugagaggcagaggggcugggaaagacuuguuauaguccgugugggaaugagagaagucggugcagaauaguaaacgggagucuguuucccacagguccccuuccccugagcccaucuacaauagcgaggggaagcggcuuaacacccgagaguuccgcacccgcaaaaagcuggaagaggagcggcacaaccucaucacagagaugguugcacucaauccggauuucaagccaccugcagauuacaaguaagcggaggggcucggucaucugggaugaagacacaugcagaucaugggugaccugcugggaugggacaguauugguacuacucaccucuugccucaagucacccauaauuagcacuugguaccaauauuugguuuuagaaaagccgcuggcugugucauucuccagaaaugugcggugacacaggcuuuucuuucuuagaccuccagcaacacgugugagugauaaagucaugauuccacaagaugaguacccagaaaucaacuuuguggggcugcucaucgggcccaggugaguaacugcuggucuauaggauauagaauuccuuuagagccugugagauguguccguuuugugccuaauuggggacuguuggcuuacuuuuccccuuuuugguaggacauuucauuuuggcugaauuaaugccuuucugugagaaggugucuuaacuuccccacuagugcggagaagucaaauccucagguuuacuguggcugaccauaauauagaguucauggagcucuuggugggaaaauccaauucucugcgcuugugguuucccaccaaugccaaauugguccagccucucuucccucuugagugugaauuugucagguauaaacuuagucauuucugccucucuagagggaacacccugaagaacauagagaaggagugcaaugccaagauuaugauccgggggaaagggucugugaaagaagggaagguugggcgcaaagauggccagauguugccaggagaagaugagccacuucaugcccugguuacugccaauacaauggagaacgucaaaaaggcaguggaacaggugagcggugagcccagaaaggaagccuccuagcagaaaccuagguggaggcccuaagcacuuaacuguccauugcauuuucacuagauaagaaacauccugaagcaggguaucgagacuccagaggaccagaaugaucuacggaagaugcagcuucgggaguuggcucgcuuaaaugggacccuucgggaagacgauaacagguaugugaucaguuuaaaggagaguguagagaccugaagaaccuauggaaguagagauuguucccuugcauugaccucuuuuuccuuuaauaggaucuuaagacccuggcagagcucagagacccgcagcauuaccaacaccacaguguguaccaaguguggaggggcuggccacauugcuucagacuguaaauuccaaaggugaggggcuggcucuugcgguuuccugguagccugcgaugugcaggacaacuuuucuggcacauucauugguugcuguuaaucuuaccaagagaaacauccuuucuguuaguguggucuguaauggugugauuuaaagcccaggaugauuagaaauaggcuguacagauaccccuguuuguuugucuugagcccaagaaaacuggaaguuuccauuuuggguauguuuuuacuggggcucaauaggaaauucacugcuuuugcuguucagaauugguucaagaagacuaagcaaucucuacagauuucugaccaguugcaagucagcacucgauaucaacacuuucugacuggcuggcgaauauguaagguuuuguuuaggaaguucguucuggcaguugugccagucuugcauagauuuuccuuuccucaaacugggaaugaaguuugaugaaauugacuugagagaaccugugcuucaucggugcucagggucuccugugcucuucgcccaggggccccucuacucuggugaucccagaugcagaacugggcacgaaacugaagaucugaugagacuguugagagccaugcccaguaagggguuagaaagaugugugaugaucuggugauugaauucuucagaacuuuccauauguugguuccucaggauaaaagcuuccuucuuaacaaguuuuuccccuuucucuguuugugucccccaccccacuucaggccuggugauccucagucagcucaggauaaagcacggauggauaaagaauauuugucccucauggcugaacugggugaagcaccugucccagcaucugugggcuccaccucugggccugccaccacaccccuggccagcgcaccucguccugcugcucccgccaacaacccaccuccaccggugagccugggggcuggcucucuuggucuggcuuccccauucucuacugcagagacugggagcuauggccacgugguuuggguagagcagacaauggauguggauggcaacauuguucuuccgggaucucaggccaguuuggggacuucucacuucgggaagaccuuguucuuguguucugguccugugucauaacccgaagaacaauguugccacuaggaggcgcaggcagggacguuggcaggaaaugcucucacguagucucucaugucuaccacccagagccgcccacccuggaugaauucuggcccuucagagagucggcccuaccacggcaugcauggaggugguccuggugggcccggagguggcccccacagcuucccacacccauuacccagccugacaggugggcaugguggacaucccaugcagcacaaccccaauggacccccacccccuuggaugcagccaccaccaccaccgaugaaccagggcccccacccuccugggcaccauggcccuccuccaauggguaaguaagugucagaccagaaaccuugggggcuuugggauaagcaagggguuacgucaggucgcuguuggcuagaagcagcucucaaguggcugggcaaugugcugggucugccuggcuugccaggguuguggcucuggaaggagcaagacuccauucugguucagggagugauucuguguuggguaagcacagaccugccuuuuacaggcaugguuuucagaacucgcguaaggauagcaacugagguuaucacagggguggcuucccuggccaguuccaauguccugcuaagucccugcucuuuccuuccaucaagaucaguaccugggaaguacgccugugggcucuggggucuaucgccugcaucaaggaaaagguaauggcugucugcuggcugugggucuucaccuaggcuugggugaguggggguucuggcccaaguccccgccuuucccugaggccucaucuuugccuccaccuguccacagguaugaugccgccaccaccuaugggcaugaugccgccgccgccgccgccucccagugggcagcccccacccccucccucugguccucuucccccauggcaacaacagcagcagcagccuccgccacccccuccgcccagcagcaguauggcuuccaguacccccuugccauggcagcaaagugaguagaauauuuugggcuugugggggugggugggauggggguggggcugacaggaaccauagagccucacacaagcaggcaggugucuugggaugagccccugggcucugcugggguuguaaacagaaagggccuccugguccaggggguggaggggcaucuugaagaggagagcugauguuuggugugguugugucuggggagagguucgugggggccuggaggggagccugcuauuguagguagggggccagaaguccagacccucgcaggcugagugagcggcuggcuggacugagccuggugcauaugggucgagugggauggugcaugcuugcucuggcaagggcugcgauuggggugagagacugcagaggugggacugggcaguggggagacagcagcuguggccuugagguugaaugugccguucggugguggcggcggcugggcggagggacaucagagcuguucuugugucugguaccuuccccucagcccuuccaggggcauuggugacaaagggcuuacucuguuaagcccagagaccucgaggcugaccccaggguaguccugcccaccccuccacuccccaucaccagccccgcccacccgccccccaccaccguaccgcaugccaagcaaggagcaggcgccccucgcccccaucccaaggcagcagccgcagacagccgcggugugcccccgcgcgugugaccuugggcuucuuuaccaccccagauacgacgacuaccaccacgagcgcuggcacaggguccaucccgccauggcaacagcagcaggcggcugccgcagcuucuccaggagccccucagaugcaaggcaaccccacuauggugccccugccccccgggguccagccgccucugccgccuggggccccucccccuccgccgccuccaccgccugguuccgccggcaugauguaugccccgcccccuccuccuccgccucccauggacccuucuaacuuugucaccaugaugggcauggggguggcgggcaugccgcccuucgggaugccuccagcucccccaccgccuccaccacagaacuagacuuguuuuuuaagaaaauauauauuauauauagagagaauuggucucguuuaaacacgccgaaccucaccauauggagccagacauugggacgcacgcaugugauugugugugcacgcaugugugugugugcacgcacugggcugggccaagcgacugaggauucgcuugggaacgggcaggugguaguaggggcgccagcuugggcucuccuggcgccccguagcaucgagugucuucuuugucuucuuucucuccucacccaacucccuuugccucuccccaaaccgggccgccaggaucccuccccgcggcggcgauggcccgagccaugagagugaggacuuuccgcgcccauuggugacccuuccaggcagacagccucagcaacgccccugguggacaggaugguucggcaaagcagccugaguuauuuuuguggacggaaucggaacacgcuggcuccauaucgugaaauuuuuauuaauuuuuuucuuuuuccuuuguuacuucuuuaucuuuuccuuucuucagacuccguccaaggagaugcucuccccggucuucugcugcaauuuagauuccuuucccuucucuccaguucuccuucccuuaccaaggagaggggagcaaaugguuuugggcaagggcuuuggccauucaugucaagcugguuguggguuuuucaaggugccauagccacccccaaagauguuuguuuaaagcgugggguuuuuuaaucucugccacccuugucaagggagucuuguaaaguugccgaggguagguucaucuccagguuucgggauucccauccguccuggcgauccugccagcagugggugggcagccugagcucccucgggcucgccugccagccuggaguucuuccugugcuccuugaucaccugagcugccucagauuccauuugguccucuccuuccuggaaggcuuccuuuuauguuuuguuuuaaucccaaaugucugaauguuuugcaguguguagggguuugagccccuuguucauucuccuuccuuuuuccucccgcuucccucuccaugaagugauucuguugacaauaauguauacugcgcguucucuucacugguuuaucugcagaaauuucucugggcuuuuuucgguguuagauucaacacugcgcuaaagcggggauguuccauugaauaaaagagcagugugguuuucugggucugcuucuuuauuuucuuuuuaaugccugccccgcccgguuuuucuuuucacauaaacuuccucuaccaccagcagcagcagcagcaccaaaggugccuuaacuuucguucagcaccagguccgggggggugagacugugggugguuaauuagggaagcccaccaccugccuccuguguguggcuuugguggugggagcucaguguguggguggcuccacagucuccccuuuggugacuaguuaacaucgcugagaaccaauuuugccccuccuuguucacugcucauuuuucuagucucuguccuuugaaggcuuuuuccuggggcucagacguccacguuugaugagcuccaguggugauuugugccuggaagcugccaccuaaggcccugggccuggggaggcaucaacacuaaaggucaagccaacuaauccugccugucaggcacagagcagcuaaaauuaaaaccgccaaguggcuuuuuuccuucucugcuggugacuugcagccugccagcgcuguaggcuuuggcgggggucggggggacaggauaaagugccccaucuugugcuuugcaagcacuuuucaaagggucuucugcuuuuuuuccaugucuugggcggcgaguggguaguuacuguuaggguuccagaaaaauccauguggagucuccaccagguagugagguccucuccugggcagaggugccuuagagcugcccugguuccaccugccucuccuuccuucagggcggcugagggacaguaggcucccccagcaucuggcugcuggggccagcaacuggccugggcugcuuuccagcugugagcuagggcuggcuacugcuguuuacuggggugucuggucccccguccaggaggccugugcuuugcuaugggucugccaggcuugaggagcccucagaagcaaggcaggcucagugcguuuccccagccaagcccuaaacuucggcucaccaaaaggaggacaucuuuuuugccuuuguccuuaaguggcagaaugggggcagggccuggggccuggcuacccucuuugaccuuggcuucaccucauugcuucucccacaagcuugguuucccuggugggcucauugggugguuaauuagcucuuugaagcucuggaagcggcaaaguggcgcuauguggguuuuagaaauaaaaucaauaaaugacuuaaccacagcuuagcua

SEQ ID NO: 18701 - RNA, 17945 nt, Homo sapiens
agagcgggcgggagccgcagccgcagcgaggccggcgggcgggagcgcacggagguggggucggccaggccggugcgggcuccuugcggcaggucccaagagugagugggcgagcgcgggcggggcgccaggcgaaggagggcgcggcccccagcgacuccccccccgcccagggcggcgcgggcgggcugggggcggcgagcggguggggagucugcggcccgggucugggagagggggcagcggccacgagagcuaaggcgcgcuggauccccggagggcggaggaccuccacggugcacccagcuuuucccagccaccuuccagcggggcccucccccgcguacccccauuuggcagaugagaaaauugaggcucccagaggccaagugauucucaaggucacacgaggaagcgguagagccaggcggggacggcucuggguggcucuuaggaaaaguccgccugagaacuccguacaggagcuccccuguccuccagccugggggagugaguauguguagggccgggguaccuuuccguggggcaaggcucugccaaaaucugggagugaggggagucagggagcuggggccgcagggcgggcccugcaccgcaaaugggaggggggcgacggaaugggcgugcgcacccaugggggugugugcaugugugugggaguguacaugcguggagaggcacugccuugcgugugugcacacgugugaggaugucagcgccuguguggccgcgggacucaaggcuggccuggcucaagugaacagcacguccaggaggcgaccucguccgcggguuugcauucugggguggacgagcuggguaugugugccugaggguuucuucgugcaggugugcacagggugugggugccauugugugugagagacggaggaugggaggccggugccuguggcccggugcguguaagugcggacgccugcaccuccacuuagguccccggccuccgacgaauaacuuggguguggaguguuugccccugccagggugcguaugaccccgccagugaccggaguugcuaauggugucaugcacccaccggccacccuuggcgcgagcgccccccucuggacacccugcuccgugcgcgcucacaguucgccugugcggggccggggccagggucaggagccggggauagggaggaagagggccuguggacaagcugagccgggaccccugggaccuuugcggagguggccugggagcgcucaguucccaggcucaggcuucccgcugacgccuccuggccgcagcgggcuccccccgccccaggaauguuccucucccauccaguccgccuccccuagggcaggcccccugggggcugccgcagccccgccucgccuuccugggcucccgggagggggcgaggcgggcaggacgccuggguucucuccccccaccucccauaccagggagaaauuccuccgagguccccucaggcucuggguucccaaaauaacccugcgggggaagggaggcuguggagggagggaagcgggaggggcgcagagccgagcugcggggugcugcaggugccucuggggagagggcgcgaggagaaggcgcccugcggggggcugggcgccagccaguccugggaucuugguucguccccauccucgugaagccccucggccuucccgcgacuccgagggugggccggaagccucucugcggguccguuucccaacuggcggguugcaccaucccgggccagaccguuuaaccccgggaguggccgcgggggacaacuccgccccuguccagcagggggcgugcccgccccgccccguuucugcccgcggggccgcucccccgcccgcgacuccgcagacucccgcucugccucucccgggacagggguucgguccgagcccggugggaggcucccggagcgcagccugggcccagcccaccccgcgccggcggccauggcaggcacccuggaccuggacaagggcugcacgguggaggagcugcuccgcgggugcaucgaagccuucggugaguggcucgggagggcacacggagccugagccuagccccgagucugagcccgggucccugccucccaggcacaguccagggcacagcccugacccggacccacccugcuccgcagcgugcagucucuuuaacgaaagccuccuccgcaacgcagggcagagagaugcacgcccuucagacagaugagguuucccuucucuagccuuccccagcggcggcgaagggagggccgggucccggacucugacacuugaggggcauuaucugucucccggggaauccggaggaacucgcuaucuccggccugggagcuguuuccggcuaauggggggcggcuuaucuggugaaggggugccccuuccccccaagcgcucaggaaaugaccucuggauucuugaccccggggaacccaggcuccuuccgccccagcugguuccccuccggacgaugggcggcucgggcgcuccccuccuccaguccucagggcgugccuaucucucgcccaccacaccuuuccucucuaauuugccuccugcucucggaguccugggcaagcaggaggugggcggggucgagcgugcacccgaaggaccgauaccuggcggguugcggggugaggaugaggcaugguagcugcggacccagcucagccaccugucuuugacccuucggagucagaugacuccgggaaggugcgggacccgcagcuggugcgcauguuccucaugaugcaccccugguacauccccuccucucagcuggcggccaagcugcuccacauauauccuucgccggccuugccaaggcccccgccgucggagcccaugcgcagccccucugcccagcccaggugcagaaugagccucgcuccuaaguauaggccacuccuuaucccagagcucaggcgucgucccagccuccaacuagggccuaggcucugcccccuccuugcuccuagcgacucgguccuguccccaggcucuguccccagccgaggccuugcccuccuucucccuagagucuggggccugccccugcuucaggcuugggugcgccccgugcaucucucucucccagagcccaggcuuugcuuucagccucccucagcaccuaguccuccacccccaccuccaaccccucccagagcucaagccucacccccagcaucuccgcagagcgcaagccccaucccuagaacgugucuccuagaaccaggccccgcccccagccucccuccacgcaggccucccuuucuagaguuaagcggccuccuuaacccucuccuucaccuaccaacaaucccggaaggacaacuccaauucccugcaggugaaaacgugccaccuggucaggugagucuuuccccuggggcucuagccccuccccuuucucccuucucucuggcuucaggcuggccuggaggagggggcagggcgcuguuucugggaguggguuugaacccuggcuuguccgggugggcagugcugccacaggcucaccccuuccugggucugggccuuaauuuucuuuucugcgcagugcgggugguugucucaagggucuaauguacacuuggaguggcgaaggaaagagcuggaaccauaguuugagggucuuuuugcuuaggugacuauaaucucaaauagcuccuugcagccugcugggugauggugggggaagggcuaucuugggugacuccccgcuccuccagguacuggaucuccgccuucccagcggaguuugacuugaacccggaguuggcugagcagaucaaggagcugaaggcucugcuagaccaagaagggaaccgacggcacagcagccuaaucgacauagacagcgugugcguggggggagcacagagggcugggggggcacucaguauccuauaccaucugugcuuaauaaaugucuguugaacugaaugagugagggucauguugcucucucgcuuaaaaaccuuccauggcucccuauugccuucaacaugccuccucugggcagcuuggcguuccugccucaucuuccacugccaccacccaucccacacaccuccuccuguagcugcgcugggucggcuccccgucggcugagcucucgaguccuuucucaucauggugcucugcucauaucaucccccuugcugccuccuccguguuaccaagacucaguucaggcaugaagucuccgugggcucugaggguucggggcucuuccgggguagaauuugucguucccaccucuguuuuccauggcacuuuguacagacuccuguacaaagaccucuguacaugugucacgcuguuuugugaucauguguuucugugucugucucccucaguagacugugagcuccucgagggcaggaaccgugucuuacucaucucuguauucccagcgccuagcacagugccuggcacagaguacguuguucauaaauguguguugagugcaugacggggucgggggagaugaggaggaguugcugggacugggaacauucgugccuaggacagugccucgcauuauguagguucucaguaagcgugaauggugugucugugugaguggggggccacgagucaugcgcauguccagcaaagggcucacuaccccugcccccccagcccuaccuacaaguggaagcggcaggugacucagcggaacccugugggacagaaaaagcgcaagaugucccuguuguuugaccaccuggagcccauggagcuggcggagcaucucaccuacuuggaguaucgcuccuucugcaagauccuggugcggcccgagggcuggggggucagggguccaaugugggcuggaagagaguucuaggaggggcagggucccuggcguaggcugggucacagggugcaucagggguuucaguguaaccacugaaggucagcuggagggugaggaguggcuaucagugaggggagaggccagcaaggugcugaggccacuccucaugcccccaguuucaggacuaucacaguuucgugacucauggcugcacuguggacaaccccguccuggagcgguucaucucccucuucaacagcgucucacagugggugcagcucaugauccucagcaaacccacagccccgcagcgggcccuggucaucacacacuuuguccacguggcggaggugccugccccucccucccggugucucccaaccaccccacaugccagucaggccaacccuucccuuccccuaacccacugccuucucucuagauaagcugggccaaauucugggcccacucagugacucccugccucuccguccccauuugccuuccagaagcugcuacagcugcagaacuucaacacgcugauggcaguggucgggggccugagccacagcuccaucucccgccucaaggagacccacagccacguuagcccugagaccaucaaggugccugggacuggggaggggccggugcuucccaggucugucuucacuggguccucccagcagcacugggggcugggcacagcuguccucauuugauagauauggaaauggaggcucagagggguuaagugcuuuucucaguuugcacaauggcaacagcagagugggggcucacaggucgucagggaccccaaagcuaguacuuuuuuuuuuuuuuuuaagacagggucucucucucuguuguccagacuggaguucaguggugcagucacaagcucacugcagccuugaacuccugagcucaaucgauccucccaccucagccuccugaguagcugggacuacagguguacgccaccaugccuaauuuuuguauuguuauuaauuuuuuuuuuuuuuuuuagagaugggguuuugccauguugcccagacuggucuugaacuccugggcucaagugauccgccugccuuggccucccaaagugcugagauuauggcuugagccauugugccuugccacuuguaguuucuucuuuucuuucuccuucauuuuuuauuauuuuugaaguauuuugaaguauugaguaacauacauauagaaaaguauauaaaaacauaugagacugggcguaguagcucacaccuguaaucccagcacuuugggaggcugaggugggcagaucacgugacaucaggaguuugagaccagccuggccaacaagguggaaacccaucucuacuaaaauacaaaaauuagccaggcaugguggcacgcaccuggaauccaagcuacuugggaggcugaggcaggaggagaauuacuugaacucaggaggcggagguugcagugagccaagauugugccacuucacuccagccugggcgacagagugagacuccaucuaaaaaaaaagaaaaguauauaaaaacauaugaauaguuuaaagaaaaauuguaaagaaaacacuguguaacuacugcccggguugggaaauagaaccuugccaggcccccaagcgcccagcacuuuagagcauaacucccuccccacgacuuuugcaaugaugaucuugcuuuucuuuauagcuucaccauguagguaugcgguccaaaacaauguggggcuuuuuguugucuguuuugaacuuucuaugaauggaauguuguuuguguuauuuuaugucuugcuuuuuucauuccacaugguucugagagucuuuucauucugucauguggagcaauuguuuuuucauuuucauugccauauaauauuuuauuguacgucuaccccaauucauuuauuuauuuauuuuuuugagauggagucugucucugucauccaggcuggagugcgguggcgagaucucaucacugcaacuuccgucuccuggguuuacgugauucucgugccucagccuccugaguagcugggauuaugggcucguaccaccacgucuggcuaauuuuuuguagagacaggcuuucaccauguugccgaggcuggucuugaacuccugagcucaggcaauccacccgcuuuagccucccaaagugcugggauuacaggugugagccacugcccccagccuaccccaauuuauguauugauucuauuguugaauguugggguuuuuccuuuucuuuucuuucuuucuuuuucuuucuuuuuuuuuuuuuuuuugagauggagucuugcucugucgccaggcuggagugcagugacgcuaauuuggcucacugcaucacugcacccucugccucccggguucaagcgauucuccugccucagccuccugaguagcugggacuacaggcaugcaccaccacacccggcuaauuuuuguauuuuuuuaguagagaugagguuuccaccauguuggccaagauggucuccaucucuugaccucaugauccaucugccauggccucccaaagugcugagauuacaagugugagccaccacgcccagcugguuuuuccaguuuuugcuguuuggacgggguggcugaguauguucuuccaggucauuguccugugcugccuugccucccugagccucuguuucuccuguuaaauguugaugauucccugcauccaggccugguuuagagguguggugcuuuuggcagugaguauugccuugaauucauggcaaugaauucaauccccaggggcugagagagccagucgugggggacaguaagggagguuuuuacucuuucaccugucccugacccugacuccuccucacccccuccuacauuuccagggcugagguagggaggauaguuguggggguaugacuccucuguccuuuguccccagcucugggagggucucacggaacuagugacggcgacaggcaacuauggcaacuaccggcgucggcuggcagccugugugggcuuccgcuucccgauccugggugugcaccucaaggaccugguggcccugcagcuggcacugccugacuggcuggacccagcccggacccggcucaacggggccaagaugaagcagcucuuuagcauccuggaggagcuggccauggugaccagccugcggccaccaguacaggccaaccccgaccugcugagccugcucacggugaggagcagggggcagggagguggggagcugggcaccagggguugacaguuuccccagguccuggcugugggcguggccuggggcucuggguucuggccaagaaacugagaucuagcgugggcucugggguuuggaguggaugcugagaagggguccaggcucugguuggggcuguggacugaggucugaucuccaggcugguauguggacugugggcaguuugaacugggccugggucccggguugaguucuggcaaugggcuguguucuagggcugggccaagcucugcauucugugggcaggggugguuucuaagcauggcccugggcucggagugaaguucugggcuuggcuuuacacuuggucuuggggucuagggugggaguuggguucugguuuagauccagacaagguucuagacauugggcuggggcuuaaguguuaagguuuggaguggauucuuagcugcuucugggcucuggaggggaucaggguugaaaucagagcuucuggcuggguuccgaccuggcuucuucccugacaucuuggcaauauguuguguucaagguuuggggccaugcugugguuugaucugugcgcugggaugacauggggguugcugugcuguguucuaagccaggcuuuguccugagucuagcuucugacccgagcucugagcugagcuguggccucuaggucgaccuuuggcccugggcucuguggcugugggcaggggccagugggggugaucagaucugugugucccaggugucucuggaucaguaucagacggaggaugagcuguaccagcugucccugcagcgggagccgcgcuccaaguccucggugaggggguacucccuccucuccacucugcccuucccuccugagaaucccaggaugugaggaugggaagagcucuuagcagccaccucacccauccaucuuguaggacagaggcauccuggggguagggcaguaguguugggcagacuucccucucccagggauuccccucucuguuccccggggcucugggcuuccccugccucuggcccuagcucaggcccgaccauuuccauagccaaccagccccacgaguugcaccccaccaccccggcccccgguacuggaggaguggaccucggcugccaaacccaagcuggaucaggcccucgugguggagcacaucgagaagaugguggaggugagcuccugcggagccugagcaguguguggggagaggccaguuugccggagcacugcccuggaagccagcacgaguguccuguucaagacccagcacucagccccuaggagucacagggccuggcaggccagcugcacggggcugaagugccccuggguaggguggggguggagguauggaacggggguggugucagagaccucucugagacacaccucaucaaauggacugggaacgugggaagggacaggaccugauguccccuuuacucuccccucuucuggcucugcgugucccucugcgugccccagucuguguuccggaacuuugacgucgauggggauggccacaucucacaggaagaauuccagaucauccgugggaacuucccuuaccucagcgccuuuggggaccucgaccagaaccagugaggagggcuggggaccugggggagagggaaggcaacucagcccacuucugccugggcuucaguuucuugugugcaagaugaggucacugagccagaugaucuuggccugggaagcugccagugugggaaagggcacuugcuuuuguggggaggagaggcugccagcuguggaggcgcagugguaucucacaaauucagacagauggggggcuccaccugagucuugcaaagacugugaccuggggacuguggcuacaaaagugcuguuuuauuuguggagcucacagcugucaagaagugugggcaacuugagcuccuggauagucuguucuaaugaauagauaagaaagguuuguaauuagcaguacccaguuguuuaucaacaguucauaugcugacaauuuggaaaaacagcugguucucugaaguagguuaaacaugcccccugaagccagauucaugcccuauuuuugcugagcagaaaaaacuccauucaaaauuuaaaguccaucucaggucgauuuauuuuuuaauguuaccuguauuucaaaaaucuguuguuuuuuauuuccacauuacaaaaauccacgguaaaauaaaaucuaggugguaaaauaaauuuauagugaacaaaauguuuaaaguaagaagugagaggccaggugcggugccucacgccuguaauccuagcacuuugggagacugaguuggcaggaucaauucaggccaggaguuugagcccagccugggcaacagaguaagacccugucucuacaaaaauuauuauuauuauuuuugagacagagucucacucuguugcccaggcuggagugcagugguacaaucucggcucgcugcaaccuccacuuccuggguucaagugauucuccugcuucagcuuccugaguagcugggauuacaggcaugcaucaccgugccuggcuaauuuuuguauuuuuagcagagaugggguuuuaccauguuggccaggcuggucucaaacucuugaccucaagugaucuaccugccuuggccccccaaagugcuaggauuacaggcaugagcuacugcuccuagccuaaaaaaauuuuuuuugggcauggguggcacgugccuguagucccagcuacucaggaggcugaggcaggaggaacccuugagcccaggagguugagacugcagugagcugucaucacaccacugcacuucagccugggugacugcgcgagaucacccccaucaaaaaaaaaaaaaagaaaaaaaaaggaagaaaugaaaguccccucuuuccuuuuccacugguagaaguugccaugauuaagcacuguuaacaauauuaagcuuggcaguauguggauucuuccagucuucuuuucccaggcaggugcacauugauagagauuuuguuuguuuggugucuguuucauggacaaacaggauuagagcauaaaucuaguucugcuuguggcuuuuaucauagcugcuuuauuucuucucccagauuuuaggcagagguaguugaguuccauguuuucucccuggguugguggguggauuuuuaucuagaccaccuuuucagugagaaugacccuuugagacgauggaggccucagcuucaugcagcggucucagccuuaacccuccaccuccugcaggccccaggcuguguguguguguguguguguguguguguguguguguguguguguguguuggugagggggaagcccugguuggguaucaaaaccuagcaccugguucggcaggagggagaccagcaccggcucccaggaccaggcccagcucaccacuucauuguaaagcucccucuuuguuucuggaacuuggguguuuccauuucuuucuuacaaaauuaucuaugcauuuacagcaauuguugauauaucuuuaggcagcaucuagguacuuguaguggguucucuuuuuucuuuuuucuuuuuuuuaaucacccucucuuuuuuuugagacagagucucacucugucgcucaggcuggagugcaauagcgcgaucuuggcucacugcaaccucugccucccagguucaaguaauucucaugccucagccucccaaguagcugagauuacaggcacuggccaccagacccggcuaauuuuuuuuucuuuuccuuuuuuuugagacggaguuuugcucuuuguugcccaggcuggaguacaguggugugaucucggcucacugcaaccuccgccucccggguucaagugauucuccugucucagccucccgaguagcugggauuacaggcgcgcgccaccaugccuggcuaauuuuguauuuuuuuuuuuuugagacagagucucacucugucacccagacuggagugcgguggcgcgaucucggcucacugcaagcucugcuucccggguucaugccauucuccugccucagccuccggaguagcugggacuacaagcacccaccaccgugcccggcuaauuuuuuguauuuuuaguagagacgggguuucaccguggucucgaccuccagaccucgugauccacuagccucagccucccaaagugcugggauuacaggcgugagccaccucacccagccuaauuuuguauuuuuaguagagaugggguuucaccauguugcgcaggcugguauugaacuucugaccucaggugauccgcccgccucggccucccgaaguucugggauuauaggcgugagccaccgcaccuggccuaauuuuuguauuuuuaguagagauggaguuuuaccuuguuggccaggcuggucuugaacuccugaccucaccucaggugaucugcccaccucggccucccaaagugcugggauuacaggcaugagccacugugcacccggccuaaaaaucaccaucuugacagaacuucacgccuugcuuuuuguuuuuuuucaucuuugugcuuguuuuccacuuaacccuugaucacagacaucuuuccauguggauucauguagaacuaccucauucguuagaacagcugcagaguauuccacugugcgguuaguccaucauuucccuaaccauccuccugcugauggacaguuagacuguuccaguuuuucaguaugauucuaugccaggcugccaugaacguccuuuuacugauccacucaggccaguauuucuguaggagaaauuccuagaagugggauaauuggaucaaaagauaugcacauucuaaauuaggagagagacugccaaacugaccucagacaagguuguaccaguuugcacccccaucagcagcguacaagugccugcuucccaacuuccucgccaacaguggaugcuauaaaaagcuucacaauuuugccagucucauuggcaaaugguaucuugguuaaauuugcauuucuuuaauacuaauggggguaggguaucuuuucauauguuuauuggccauuuauuucuucugucaauugccuguucugauuccuuguccauuauucuacuggguuuguuggucuuuuucucauugauuuuuagaaucucuguuaauggauauuaacccuuugcuguugaauguguuugcaaauauuuucucccugucugucauuuauguugucuuuuuccauauaaaauuuaaaaacuuuugugugcucaauaugucagucuuuuccuuucuggcuucuuggauuuguguucuguguagaaaggcccucagccccucaagauuauaaaauuauuauaucuuuucuuuuuuuuuuuuuuuucugagacagggugucuugccaugucacccaggcuggagugcaguggcaugaucuuggcucgcugcaaccuccaccucccagguucaagugauucucgugccuuagccucccgaguagcugggauuauaggugccugccacuaugccuggcuaauuuuuuguauuuuuaguagagacggggcuuugccauguuggccaggcuggucucgaacuccugaccucgugauccacccgccuuggccucccaaagugcugggacuacaggcguaagccacugugcucggcccuauauuuuuuucagauagccaguuauccuaaugcucccuugauuugauggaccaccuggaucacacauuaugagcccccucauaagcaggugggagucucaagcgagggccagucccgaugggaauagcacuugguggcugaggacccuccuaucugugcagacacuguuguaaaacuucacaugcaucaucuaauuuaauccucaccaaaauccuaugaaauguaggaaugaucauuacacccauuuauagauaaggaaacggagggacagggagauuacuccgcuacaggucaagaggcagggaaguagagcugcgauuugaacugaggucugugucuagaacacgugcucauucuuucccuaaaauguauucauaggugaaaaagggcuucugcggaaagcccuggguuaugugggaaacccuggauuuacagcugucuuuccagcaggaugaugcaggagagagagggaugcgauuucucccaaucucuccuggucccagaacucauuagagaguucucccugcugagggcucccgacugguguugcacacaguacacuucgggagcccgaggcugaugguuccauggaaaguacacagucauuuuaguuugcacaccaagugugaagugggcaggacaggccacuguucugagaaggaacccagggaaagggacuggcccaagaccacacacugguuagcggcacuucccacaucugccugaccccuaguccagugccgccuuuucuuuacucugcaacaggaguccaaaaucaggaguuccaugaggacacugggaacagugggauggguuaggccagcgguggaugguucuggggagggcccgagcugaagcgcccccgcaacuccccacagggauggcugcaucagcagggaggagaugguuuccuauuuccugcgcuccagcucuguguugggggggcgcaugggcuucguacacaacuuccaggagagcaacuccuugcgccccgucgccugccgccacugcaaagcccuggugagagucccuuucccggcucacggcccaagccacgccccuccagccccggccccgcccucccuucuggccccgccucugccagagcccuucucaagccaggaaaaccugguaauucuauuugccucuccuccugugguucugcccggggcccugaggcgggcucuaaagcccuagucucacccucaagaaggaagaaguagagucaucaccucuaaaucccuccucccaccacggccccuccucuauugcagauccugggcaucuacaagcagggccucaaaugccgaggugagauggaaugacuggaagggcugcugggcaguguuuuuuuuuuuuguuuguuuguuugggagaguuacuguuuugguggggcaauugccaaggagugaaguaccuuaaaaucagaggcgcauggccgggcaugguggcucaagccuguaaucccagcacuuugggaggccgaggcgcgcagaucaccugaggucaggaguucaagaccagccugaccaacauagcgcaaccccgccucuacuaaaaauacaaaaaguagcugggcgugguggcacccaccuguaaucccagcuacuugggaggcugaggcaugagaaucgcuugaaccugggaggcgggguuugcagugagccgagaucacgccacugcacuccagccugggcaacagagagggcucugucucaaaaaaaaaaacaacaaaaaaacccccaaaaccaaaaccccacaaaaucagaggcucaagaugacugaugugaagggaguggcguuuaagaggccauuuauuuugaugacgcagcugcccaggaacagagaacaugggagaaggcauagacugacaauuaggaggaggagaacacuuuggaaggagacucuuauuuugguggggcagcugcucaggaacaaagguuccugguaggggggcacaagccugcgggaugggauggaggguauucugaccaaugucccuggcuggcucuccauuugcucucccccagccuguggagugaacugccacaagcagugcaaggaucgccugucaguugagugucggcgcagggcccagagugugagccuggaggggucugcacccucacccucacccaugcacagccaccaucaccgcgccuucagcuucucucugccccgcccuggcaggcgaggcuccaggccuccagguaagagggagucauucuguacuggccuguggagggaaggaugcagggcuacuggggcaaagaacgcaggauggaagccauuccaaagugcauaauucucuuuuuguggugggauaauaaagaagggacaggccgggcgcgguggcucacgccuguaaucccagcacuuugggaggccgaggcgggcggaucacgaggucaggagaucgagaccauccuggcuaacacggugaaaccccaucuuuacuaaaaauacaaaaaaaaaaaauuagccaggcgugguggcggacgccuguagucccagcuacuugggaggcugaggcaggagaauggcaugaacccgggaggcggggcuugcagugagccgagaucgcgccacugcacuccagccugggcgauagagcaagacuccgucucagaaaaaaaaaaaauaaaaaauaaagaagggacagguaagggugccagaaaguggccaggaagcccuggaccuucugaggcugaggagagagacccuaauuuauaaagagguauaaaagugaaagaggcuucaagauuccaguuacagucuuauuuuguuggagggguuaacaaaggauuggagaagguguuauaugagccauuggcuugccuuucccuuucuggcugcucuggaggcucuucuggggaaagucccuugcccugauaauguccuggcagcucucuugggguauuugaugguuuuaggucaguuugcugaaugacaacuggccaaaugauuauuuugcugagaacaguccgaacaacuauguuaaacuggggucuaagguaguugaucacaacuguuuggguuggcauaaguccucaaaaaacagaggcaggcacagggcauacauccucaaaaauagaaaagauaaauccauuugcauugagccuuccagaagugcuggggucuaaaaugugaaauacacacaaaauugacauuuaagcaaacugcgcugacaaaucuguggcugaaaaagcuguggcaaaacaaaaacauagaaaaagagccucaaaaauugggcugaggccgggcaugguggcucacgccuguaauccuagcacuuugggaagccaagguggguggaucacccgaggucaggaguuggagaccagacuggccaacguggcaaaacaucaucucuacaauacaaaaauacaaaaauuagcugggcgugguggcaggcgccuguaaucccagcuacuugggaggcugaggcacgagaaucgcuugaaccugggagguggagguugcagagagccgagauugcgccauugcacuccagccugggcgacagagagagacucugucucaaaaaaaaaaaaaaaaaaaaaaaauugggcugugaggucaugcagggaauugauuuuuggugggugggucugcuucugggaugauguggaugccucccguggagaggggaaggguugaugaagucccagggaccuggaaguguguucugcagcaaucccccucccagcagagauccgugaggaggagguacagacgguggaggaugggguguuugacauccacuuguaauagauggugaguccucccacagcuggcaccagagcuccccacugagggcugggggggagcuggggaguaucagggaaaugggugcuuuauccaaauggcuccaagccaggugggcuacuaccuuguuguuaggggggugucuuccucacaaccuguuuuucucuucccagcugugguuggaucaaggacucauuccugccuuggagaaaauacuucaaccagagcagggagccugggggugucggggcaggaggcuggggaugggggugggauaugaggguggcaugcagcugagggcagggccagggcuggugucccuaagguuguacagacucuugugaauauuuguauuuuccagauggaauaaaaaggcccguguaauuaaccuucaccaucagcgccua

SEQ ID NO: 18702 - RNA, 11265 nt, Homo sapiens
auuuaaaguccaucucaggucgauuuauuuuuuaauguuaccuguauuucaaaaaucuguuguuuuuuauuuccacauuacaaaaauccacgguaaaauaaaaucuaggugguaaaauaaauuuauagugaacaaaauguuuaaaguaagaagugagaggccaggugcggugccucacgccuguaauccuagcacuuugggagacugaguuggcaggaucaauucaggccaggaguuugagcccagccugggcaacagaguaagacccugucucuacaaaaauuauuauuauuauuuuugagacagagucucacucuguugcccaggcuggagugcagugguacaaucucggcucgcugcaaccuccacuuccuggguucaagugauucuccugcuucagcuuccugaguagcugggauuacaggcaugcaucaccgugccuggcuaauuuuuguauuuuuagcagagaugggguuuuaccauguuggccaggcuggucucaaacucuugaccucaagugaucuaccugccuuggccccccaaagugcuaggauuacaggcaugagcuacugcuccuagccuaaaaaaauuuuuuuugggcauggguggcacgugccuguagucccagcuacucaggaggcugaggcaggaggaacccuugagcccaggagguugagacugcagugagcugucaucacaccacugcacuucagccugggugacugcgcgagaucacccccaucaaaaaaaaaaaaaagaaaaaaaaaggaagaaaugaaaguccccucuuuccuuuuccacugguagaaguugccaugauuaagcacuguuaacaauauuaagcuuggcaguauguggauucuuccagucuucuuuucccaggcaggugcacauugauagagauuuuguuuguuuggugucuguuucauggacaaacaggauuagagcauaaaucuaguucugcuuguggcuuuuaucauagcugcuuuauuucuucucccagauuuuaggcagagguaguugaguuccauguuuucucccuggguugguggguggauuuuuaucuagaccaccuuuucagugagaaugacccuuugagacgauggaggccucagcuucaugcagcggucucagccuuaacccuccaccuccugcaggccccaggcuguguguguguguguguguguguguguguguguguguguguguguguguuggugagggggaagcccugguuggguaucaaaaccuagcaccugguucggcaggagggagaccagcaccggcucccaggaccaggcccagcucaccacuucauuguaaagcucccucuuuguuucuggaacuuggguguuuccauuucuuucuuacaaaauuaucuaugcauuuacagcaauuguugauauaucuuuaggcagcaucuagguacuuguaguggguucucuuuuuucuuuuuucuuuuuuuuaaucacccucucuuuuuuuugagacagagucucacucugucgcucaggcuggagugcaauagcgcgaucuuggcucacugcaaccucugccucccagguucaaguaauucucaugccucagccucccaaguagcugagauuacaggcacuggccaccagacccggcuaauuuuuuuuucuuuuccuuuuuuuugagacggaguuuugcucuuuguugcccaggcuggaguacaguggugugaucucggcucacugcaaccuccgccucccggguucaagugauucuccugucucagccucccgaguagcugggauuacaggcgcgcgccaccaugccuggcuaauuuuguauuuuuuuuuuuuugagacagagucucacucugucacccagacuggagugcgguggcgcgaucucggcucacugcaagcucugcuucccggguucaugccauucuccugccucagccuccggaguagcugggacuacaagcacccaccaccgugcccggcuaauuuuuuguauuuuuaguagagacgggguuucaccguggucucgaccuccagaccucgugauccacuagccucagccucccaaagugcugggauuacaggcgugagccaccucacccagccuaauuuuguauuuuuaguagagaugggguuucaccauguugcgcaggcugguauugaacuucugaccucaggugauccgcccgccucggccucccgaaguucugggauuauaggcgugagccaccgcaccuggccuaauuuuuguauuuuuaguagagauggaguuuuaccuuguuggccaggcuggucuugaacuccugaccucaccucaggugaucugcccaccucggccucccaaagugcugggauuacaggcaugagccacugugcacccggccuaaaaaucaccaucuugacagaacuucacgccuugcuuuuuguuuuuuuucaucuuugugcuuguuuuccacuuaacccuugaucacagacaucuuuccauguggauucauguagaacuaccucauucguuagaacagcugcagaguauuccacugugcgguuaguccaucauuucccuaaccauccuccugcugauggacaguuagacuguuccaguuuuucaguaugauucuaugccaggcugccaugaacguccuuuuacugauccacucaggccaguauuucuguaggagaaauuccuagaagugggauaauuggaucaaaagauaugcacauucuaaauuaggagagagacugccaaacugaccucagacaagguuguaccaguuugcacccccaucagcagcguacaagugccugcuucccaacuuccucgccaacaguggaugcuauaaaaagcuucacaauuuugccagucucauuggcaaaugguaucuugguuaaauuugcauuucuuuaauacuaauggggguaggguaucuuuucauauguuuauuggccauuuauuucuucugucaauugccuguucugauuccuuguccauuauucuacuggguuuguuggucuuuuucucauugauuuuuagaaucucuguuaauggauauuaacccuuugcuguugaauguguuugcaaauauuuucucccugucugucauuuauguugucuuuuuccauauaaaauuuaaaaacuuuugugugcucaauaugucagucuuuuccuuucuggcuucuuggauuuguguucuguguagaaaggcccucagccccucaagauuauaaaauuauuauaucuuuucuuuuuuuuuuuuuuuucugagacagggugucuugccaugucacccaggcuggagugcaguggcaugaucuuggcucgcugcaaccuccaccucccagguucaagugauucucgugccuuagccucccgaguagcugggauuauaggugccugccacuaugccuggcuaauuuuuuguauuuuuaguagagacggggcuuugccauguuggccaggcuggucucgaacuccugaccucgugauccacccgccuuggccucccaaagugcugggacuacaggcguaagccacugugcucggcccuauauuuuuuucagauagccaguuauccuaaugcucccuugauuugauggaccaccuggaucacacauuaugagcccccucauaagcaggugggagucucaagcgagggccagucccgaugggaauagcacuugguggcugaggacccuccuaucugugcagacacuguuguaaaacuucacaugcaucaucuaauuuaauccucaccaaaauccuaugaaauguaggaaugaucauuacacccauuuauagauaaggaaacggagggacagggagauuacuccgcuacaggucaagaggcagggaaguagagcugcgauuugaacugaggucugugucuagaacacgugcucauucuuucccuaaaauguauucauaggugaaaaagggcuucugcggaaagcccuggguuaugugggaaacccuggauuuacagcugucuuuccagcaggaugaugcaggagagagagggaugcgauuucucccaaucucuccuggucccagaacucauuagagaguucucccugcugagggcucccgacugguguugcacacaguacacuucgggagcccgaggcugaugguuccauggaaaguacacagucauuuuaguuugcacaccaagugugaagugggcaggacaggccacuguucugagaaggaacccagggaaagggacuggcccaagaccacacacugguuagcggcacuucccacaucugccugaccccuaguccagugccgccuuuucuuuacucugcaacaggaguccaaaaucaggaguuccaugaggacacugggaacagugggauggguuaggccagcgguggaugguucuggggagggcccgagcugaagcgcccccgcaacuccccacagggauggcugcaucagcagggaggagaugguuuccuauuuccugcgcuccagcucuguguugggggggcgcaugggcuucguacacaacuuccaggagagcaacuccuugcgccccgucgccugccgccacugcaaagcccuggugagagucccuuucccggcucacggcccaagccacgccccuccagccccggccccgcccucccuucuggccccgccucugccagagcccuucucaagccaggaaaaccugguaauucuauuugccucuccuccugugguucugcccggggcccugaggcgggcucuaaagcccuagucucacccucaagaaggaagaaguagagucaucaccucuaaaucccuccucccaccacggccccuccucuauugcagauccugggcaucuacaagcagggccucaaaugccgaggugagauggaaugacuggaagggcugcugggcaguguuuuuuuuuuuuguuuguuuguuugggagaguuacuguuuugguggggcaauugccaaggagugaaguaccuuaaaaucagaggcgcauggccgggcaugguggcucaagccuguaaucccagcacuuugggaggccgaggcgcgcagaucaccugaggucaggaguucaagaccagccugaccaacauagcgcaaccccgccucuacuaaaaauacaaaaaguagcugggcgugguggcacccaccuguaaucccagcuacuugggaggcugaggcaugagaaucgcuugaaccugggaggcgggguuugcagugagccgagaucacgccacugcacuccagccugggcaacagagagggcucugucucaaaaaaaaaaacaacaaaaaaacccccaaaaccaaaaccccacaaaaucagaggcucaagaugacugaugugaagggaguggcguuuaagaggccauuuauuuugaugacgcagcugcccaggaacagagaacaugggagaaggcauagacugacaauuaggaggaggagaacacuuuggaaggagacucuuauuuugguggggcagcugcucaggaacaaagguuccugguaggggggcacaagccugcgggaugggauggaggguauucugaccaaugucccuggcuggcucuccauuugcucucccccagccuguggagugaacugccacaagcagugcaaggaucgccugucaguugagugucggcgcagggcccagagugugagccuggaggggucugcacccucacccucacccaugcacagccaccaucaccgcgccuucagcuucucucugccccgcccuggcaggcgaggcuccaggccuccagguaagagggagucauucuguacuggccuguggagggaaggaugcagggcuacuggggcaaagaacgcaggauggaagccauuccaaagugcauaauucucuuuuuguggugggauaauaaagaagggacaggccgggcgcgguggcucacgccuguaaucccagcacuuugggaggccgaggcgggcggaucacgaggucaggagaucgagaccauccuggcuaacacggugaaaccccaucuuuacuaaaaauacaaaaaaaaaaaauuagccaggcgugguggcggacgccuguagucccagcuacuugggaggcugaggcaggagaauggcaugaacccgggaggcggggcuugcagugagccgagaucgcgccacugcacuccagccugggcgauagagcaagacuccgucucagaaaaaaaaaaaauaaaaaauaaagaagggacagguaagggugccagaaaguggccaggaagcccuggaccuucugaggcugaggagagagacccuaauuuauaaagagguauaaaagugaaagaggcuucaagauuccaguuacagucuuauuuuguuggagggguuaacaaaggauuggagaagguguuauaugagccauuggcuugccuuucccuuucuggcugcucuggaggcucuucuggggaaagucccuugcccugauaauguccuggcagcucucuugggguauuugaugguuuuaggucaguuugcugaaugacaacuggccaaaugauuauuuugcugagaacaguccgaacaacuauguuaaacuggggucuaagguaguugaucacaacuguuuggguuggcauaaguccucaaaaaacagaggcaggcacagggcauacauccucaaaaauagaaaagauaaauccauuugcauugagccuuccagaagugcuggggucuaaaaugugaaauacacacaaaauugacauuuaagcaaacugcgcugacaaaucuguggcugaaaaagcuguggcaaaacaaaaacauagaaaaagagccucaaaaauugggcugaggccgggcaugguggcucacgccuguaauccuagcacuuugggaagccaagguggguggaucacccgaggucaggaguuggagaccagacuggccaacguggcaaaacaucaucucuacaauacaaaaauacaaaaauuagcugggcgugguggcaggcgccuguaaucccagcuacuugggaggcugaggcacgagaaucgcuugaaccugggagguggagguugcagagagccgagauugcgccauugcacuccagccugggcgacagagagagacucugucucaaaaaaaaaaaaaaaaaaaaaaaauugggcugugaggucaugcagggaauugauuuuuggugggugggucugcuucugggaugauguggaugccucccguggagaggggaaggguugaugaagucccagggaccuggaaguguguucugcagcaaucccccucccagcagagauccgugaggaggagguacagacgguggaggaugggguguuugacauccacuuguaauagauggugaguccucccacagcuggcaccagagcuccccacugagggcugggggggagcuggggaguaucagggaaaugggugcuuuauccaaauggcuccaagccaggugggcuacuaccuuguuguuaggggggugucuuccucacaaccuguuuuucucuucccagcugugguuggaucaaggacucauuccugccuuggagaaaauacuucaaccagagcagggagccugggggugucggggcaggaggcuggggaugggggugggauaugaggguggcaugcagcugagggcagggccagggcuggugucccuaagguuguacagacucuugugaauauuuguauuuuccagauggaauaaaaaggcccguguaauuaaccuucaccaucagcgccuagaaucccgggggguagggggaugguauacuuuacaggaugacaaucuugggagcuagaacuuuguagccagagaaacuugggaggucuggaaucucaugugucuggagucuuggggaagagaaucuuagaagcagaaaaccuuggaacauaagaaucuuggggagggucuaggaucuugaggagaccagauccuuggacaucuaaaacuugaaacuaguaggucugcacccgagaauugcagggccagucaugcauacccaaagccuucagcccauggccgaaauucccuugcuggacagggggccuuucagccccugcuuggacgcuuccaguaacagggcccucacugcaggaaucgugggagggagaggggcagcacagaguugcuggcugucggggaagggagggagggcccugggcaguccgagggcccugcugggcuugugccucagggugggggcugcacuccuccgccuugcagccuccuggccuggugcugcugccagccggaaggacagugacuuccagaggaaaugcauauugauccugcuuucagccuccggugguggcuucucccaacccagcucuucccuccugagccugcagcacggagguuuugggggucacugcuaccuaaagaaggcuaaggccacuucugaggcuggucugggaguuuacuaaagguucugaagcugggccgggcugccccugggaucaggagacuccagacagcaguccugacaaugggaacuaccuccucagucccccaaacugggaggugucccacagcagcuguaggauuguccuagggguggagaccugagcaccuuccacuccaaagcacaguaucugugggccuggcaguggccucaguucccccaugagugccccggucccccaccccaggguuuccccacaucacauccaucccugcuuugagaccccacucccccuggccuguucuuuauuuugggucacucccuucucuuuccuggucauaucucuccugcaggccuacccuguguugggccccccagcccugucucugcaucgggugccccccugccccuccuucuguccucagcccccuccgcccuucccccucuugaggcuguaauauccguuucacgauuugggggcugaguugcuauaacaacagacggcgauuguguugugaagagcagcucgcuccugugccgccugccuccugugcugccuccaucccugcagcccagucgguuccucuuggcuccucucgucacuacccuccaguuccagucuggccucuuccugguguguguguguguguguguguguguguguguguguguguguaugcaugcaugcauauguguguccaggucugccugcccgggaugugacaaguagcggucuucaugguugcaugugucugaauuuggugucugagcuucacauuguaugcgccugugugcaugugugugcauggacaugcaugcuguaucugcuguguuuccccucccccauguguccccacuggccuuugcacaugggagaagggcaugugcucagcauaucacucaacuguccacauuggguggguaccugugugugguguguguguguguggggugugucuugaaguggcaggucccaaaugcuuaggcaaucugaaccuuggaccuugcagagaggagagaugucccuguaggugggagggacagggagaugcagcagcugcccggugaccuuuucugcccuugaugggcaaagcuggggguagggaaaggagacaagugcucauacuuaccucccucccugcccaggcuccucuguaagggucugagucugucucugugagccauugcaucugucugucuaugcccugaugccuggauggacaaggggugugugugugugugugugugugugugagugugaggaggcugcaggaagaggaacagugggggaugggcaggaaagugggcuguggggucagggaggcgauuucgcauucauaggcccugacgcagcaguuccauucucuggcuccuucauuggcuuugguggggaugcccugggggucucuccaaggucagagugggcccuaagucugggaccuggcuuagggaucacccuucucgacuccuaggaaaaacuccuugcagccugggucccccucuuaccccuucacaggcuggggaaggaguuucccacccgggggguugguguccgcauuaagccacucaguaauugaccacucucuuugaagugccugggcagggguccaggaugacugugggcagguccccugggugcagcuguucugggcaugcauuaauugccugguguagguaccugugugcacaaguguguguguucuugggcaguauaugcuuccuguggguguguuaccaugguggggcauuucugcagguguucuuaugugucucugggaaugcccaguguucacagauaugugugcauggcugugagugccccaauguccaugcauuggugguugaauguaaguguucuugcauguugccucuggcuaaggaagugccaacuaccaccagcugugcagaucacagacccugcaacagaaaccaggguccuggagugagcuggcagaauggucuggcacacauacacacacacacucugucucucacugucucauucagcagcccagugaccaaccucgggguauacacacuaagugccaguguguguacacuuuuauuggcggagugagugaagggugucccccagucccccacacucauacacaugcacagugaugcauguacccuuacaggagagaccugcgccccccagcaccacucuaacugaaacucauggaugggaggaggagaacagagaagggggcugcugccaggugcccucagucaccaggcaugugcaggcgcaacccugcccccacaccuacucguaccucgguccaggguuccaggcagaacugagaguuuggccucaaacucugggauucccaugaggcaggacugggaaacccccaaguuccuaggucuaccccgcccccaucucugccuuuccuucccccaccgccuccgucuuuaucccagcaaagccccuuccucuucaguucugggggcuccaagccaggggcccuccggacggugggaggugggggccaggcuaccgacuggaaaaagcccccagcagccauggacccaccgagucccccuucucuaggcuccucgaagcccgggcccgccccuggggguagccagcagagggcgcugcggcccaggccccgcaucagcccugcucucgcggcgucccaagucgggguccacagccucuccuucggcuugucccagccccgcgcugcgcgaagaccugcuggccguggggggagggugcgggacccaaggccccgaacuaaggggcgaggggcgaggggcgagagugcuuggguucccggaaaagacacugaggccggguuuggggcccgccugguugggggcccgggcgcccgagaaccucgagaggcugggaggagcgcgggugcuggggccgggacgccu

SEQ ID NO: 18703 - RNA, 339 nt, Homo sapiens
gcuuagucuugaauaugcucaaccucaauucuagacuccccuuugggggugggcacaccuugcuugggugagaaugggguucuuggguaguuccagucaggggccuucugugcccuaagggcagaagggggcuaacuuuguugggccagcaguccccagaggaaggagaguuggggaggaaggggagaucaggaauggcugguggucccccuggucagggauggcauucucuaguaaguggggcccacaugcacugaaauucaguuuuucuuaggaugcagaggaguguugggugggcggguggcaucugugcuaagugugcaccugugaguauuuucc

SEQ ID NO: 18704 - RNA, 4384 nt, Homo sapiens
ggggugggagcugguuuguagagaaaggcugcugccaagguaagcucuccauagugccugcugccuaagaggguggagggggugggguguuuagaacucagcugcucuggccugugagagagacgcccacucccuucccuagauaccuagccuggccuggcucagaggaaaugccugaggaauauuacuccccuuccccuggaaaagcauaacgagccccaauucugugccaggcccacugcuggagguuagggagacagauaggacccgggccguuggcccuucccuggcagugaguacaaagccaugccuccaggacagaauugggauauggugucagagacacucaaggcagggagcauccucugccuggaagaggagguguuuggccagacucugagaugucagcagggaaggguguucugaauagaaggcaaaggucagguagagggcuggugguauggaccagcaggaaggaccccagaggcacucaggguucaugcagggaggggaacccugccaugauugggcccagguuacgaccgcucgagaggcugccaacccuccugagagcugacagcugaguuugccccuuaccuggagaccagggugcuggcuuuccuugucuggaucccagguggguacaggaagacauauuuguucauccaaaggcuagaggucccacaagagccaagccuuggccucauccugggccuggagccuaauaccccaguuuuauagaugaggaaacugaggccuagagacuggaagaaacuugcccacagucacacaggaacucagugacagaacagguguucugucauccaaguuagcauccaagccaagagucaagcagccccaacagauuccuggaggcauugggaggaugacuuagguuuucuugggcuccucaugagaucuagcccuuccccggccucacucaccuugcugggcaccuacaccuggugaucuugggaaguccugcccacccaggccucagcauucuuauccauaacgagcugggaucagauagucccagcuccacaaaacaugcuacuuugcucguagcucaaaguuuuucacugugacugagccuuuggagggccaggagcccugggguuucaaaaucuaggguguaggugagccccuggccaggggagauuggagucgggugggaagagcagccuggggagcucagcaagccuucaaguucaauggaaaggucuuggccacaggcuggcuggcguggccaaggacagcucuguaacauugcuggagcuugugaucugaagguuggcaacaguguuugaacucagggcagaggcagagggcuguggguggguggggagcaggagaagagcgccaagaugugaagguggaauguggcuggccuggcugcaguggggcugcaguggggcaggcgggaccuggcaguggaggcccuggggugcuuuaccaccaagaggcugaggggcuucugggcgugaucuaugaagaccacacccugcagagaccagcgagaggcacucagaugugggcagggcuuaggcugugcugaagagagagccagagaggaaaccuccaacccucgucaggcccagaggugccccugcaagaggagcaaguccucccaccagccaccuagagcugagccccagcucccuucuaccccaaaccaggagguugcacaauuuugguuugagaggaggaccaggaggcugaugggagucacaguuguugacucaguggcugaugggaauuguguucuacacuccuccaaggacugaugggaguuauaguucucaccuuuugggggcugaugggaauugcaguuucugcccaagggacuccaguuaucagaccuagagauggggagacccauucuccccucacaaagcccuccccucucauucccaugggcccuauuuagcaggugcuucccucccagauggcuguguauguauuuucuuuucuuuuuuugcuuucuucuucuuuccguuguuuuguuauuguuuuaacuauaauaagagggccagaggcagucaagcccuggccagguccuggcggcccauggggguucuggggagggggaggggggaagucagugggggucagagguggagggugaagaaugagaaaguuggggaguuaggcuuagcucaggaaccaugugucccugcccacuccccuccuuccuugccccucccuaccucccugccucuacauggcuucucuccaccccucccagaguccuacgggacaggacccugcuccagugguauccaacuccucccugcccacucuuccucaugggccaccucaccucccacuuucgaugucucgccucccguggccacccugcaauuagcuuuccaagcccccucccguggccguccccucccaagaccucucacccauguagcaaucccuacauggcugccugucaugucccuacucucuaagcccuccugcccacuguuccucccuccccgacaugcugacaccaagugguggaaaccaccccucagccccagccugcccugugcagaguucagcuuuguguugaaugagggggagagggacaagugagggcggagagagaguucaggaggaggcaggaugcgcagggagcagagagugagggagggagauaccgaacagauagacagaaaacguuguacggaaaaguuguuuuuucuuauuuuuuuuccgggagaacccgcuuacacagcucuguuuguaauuuuuuucuucaugcuaaaaucacacggccuauuuguugauguaaguugccugaauuccgugguaugcuaucuucuuuuuuaaaaacaaaagcaaaaaaaaaaaaaaaaagcaaaaaaagagaaaaaucuagaaaaaaaacccuaaaagauauuguuguuagguuuguuuaaaugcugcuguuguaucuguuuuuaaagccuuaaaccaguagaguuuuuuuuucuguuucuuuucaauuuccuuuccuuucuguuccuuuugauuucuuaagacaaacaaaagaccaaaacccagagagucacagagcccgugcguggggugcccagggcaucugagccgcugcccgcuuaaagcgcagugcucggccggcuggcgggcgggcccagcccgcucuagucuccgccaaagccaauuggaaccgauuugggugugugaggcuguuguuucucucucugugccggccgccugcgcccuggcccucgcugacgcccucucuuuucucuucucucucuuguucuaggaggagaguuaauauugcccauuaucacggaggacuccuuagaccccccucccguggccacccgaucccccuucgugcccccgcccccuaccuucuaccccuuccucacgggagugggcgccacccaagacacgcugcccccgcccgccgcgcgccgcccgcccucugggggcccgugccaggccgagcgggacgacagcgacugcgaggagcccaucgaggccucgggcuucgccuccggggaggucuuugacuccagccucccccccacggacgacgaggacuuuuacaccaccuuuccccuggucacggaccgcaccacccuccugucaccccgcaaacccgcuccccggcccaaccucaggacagauggggccacgggcgccccuggggugcuguuugcccccuccgccccggcccccaaccugccggcgggcaaaaugaaccaccgagacccgcuucagcccuugcuggagaacccgcccuuggggcccggggcccccacguccuuugagccgcggaggcccccuccccugcgccccggcgugaccucagcccccggcuucccccaucugcccacagccaaccccacagggccuggggagcggggcccgccgggcgcaguggaggugauccgggaguccagcagcaccacgggcaugguggugggcauuguggcggcggcggcgcucugcauccucauccuccucuacgccauguauaaguaccgcaaucgugaugagggcuccuaccagguggaccagagccgaaacuacaucaguaacucggcccagagcaauggggcgguggugaaagagaaggccccggcugcccccaagacgcccagcaaggccaagaagaacaaagacaaggaguauuaugucugagcccccggcacugcgccccacugccagcugccccuccugggagggcccgggaggagggugccacccucucccugccaggggccuggggacccucucccuggcugccucaggcuucucuuacgaagaggaaacgcaaaaaaagaaaaggaaaaaccccgugcucgcccccuuccuccugccguccacugcgcggccucgucagucccggggcugacugucccucucagcucug

SEQ ID NO: 18705 - RNA, 13127 nt, Homo sapiens
ccgcgcagggcggggagccgggaggcggugccggcgcccgccucggccccggaggcggcaccaggaagcgcccgccccggccggagccgccauguaaccggcgccgcccggagcccgagccgcgcgggccccagcgacccgcccgccaugggggacgaggacgacgaugagagcugcgccguggagcugcggaucacagaagguggguguggggccugacugcggcugcccggggcaggccgggacgggucauggaccggcugggcucauucgcccccugugcccacagccaaccugaccgggcacgaggagaaggugagcguggagaacuucgagcugcucaaggugcugggcacgggaggugaggacccccauccaccgggcaggcgucccaggcgcggugccccugaccuccugccugcucacucuugggccugggccaggccacugagcaggccccccacccuuucccggcacagccugccuugccugccccgcccugccucgccagaguuugcaugcccacuuccagggcacuccacauugacaucacuccucccuccacgguccugugcgugcauaccccccuggauuugccaacacccuggggagggggacuggcgccccucucaagugauuugcauagcuccucccuuucuuccaauaugggaucccccucccacauuuugcaaaugccccagcgcugguuugcgcaucccuuccccagccaggugcacaccucugccucccuuccuugcacuggcaucuuuucacauccaucugaucucucgcagguuugcauaugccccgcccccaugccucgcagcaggcccccuggagaugcaugcuccccagccugguuugcacauccuuucccugguuuugcugggcacccucccggggugugcacacccuuuccuuagaaggcucugccagcuuuuugcacaccugccuguugccccagcuccuucgccucauuugcacacccuccuggguuggcaucgcccccaccccccaagccugcaccaaucucccgcucacagcccacccuccacccacucgcugcucccacagccuacggcaagguguuccuggugcggaaggcgggcgggcacgacgcggggaagcuguacgccaugaaggugcugcgcaaggcggcgcuggugcagcgcgccaagacgcaagagcacacgcgcaccgagcgcucggugcuggagcuggugcgccaggcgcccuuccuggucacgcugcacuacgcuuuccagacggaugccaagcugcaccucauccugggugagcgcacaccacaucccaacgggguugggguggcugggggcaggcgaggccaccugacggggcugcuuccugacuuccacugcaccucccagacuaugugagcggcggggagauguucacccaccucuaccagcgccaguacuucaaggaggcugaggugcgcguguaugggggugagaucgugcuggcccuggaacaccugcacaaggugggugaagaccuggccgcaggcuguugcuauggaaacugggucugugccuuggaaggaaucugcacgcagggcagccucaggcuucccccugggcuuccuggggggccaguggugagcugggugggaauuggagcugcuuccccuggaccccuugcaggaagccucaacguugccuggugggguccccuccccuggcaccuccucgaaggggcuuuccucuuucagggaacucggggcugcguucacagaacuuccucaaauggaaaccucacggccuggcuccuaaggccuccuugaaauggagcucuucacacagacuuuccucucucugggaccuuggggccugauccacggggcccuccuucuuuguuuuauaucuuaaauggccuuucuuauucaguggcucugcccuggagacccccucuacaggcagaugacuuucucuggggggucuccuuauccugagcagggccaggagcuggaggagcuggggaggguuucggggaggaagccucagcaccccucuugcuccuaccagcucggcaucauuuaccgagaccugaaacuggagaaugugcugcuggacuccgagggccacauuguccucacggacuucgggcugagcaaggaguuccugacggaggaggugaguggaggccaccucugccugcagugccccauucaauccuucuccuuccugccucuuccugcucugggccugcauucuggggcugcagaagugaauagcuccaagaaguuuccacagcucagcucuccaaccucacaaguugagcgagucuuacucugggccuuguggggcacuggggcacaggagagguuucgacaucuaagcaggaccucuugcccucccagaaagagcggaccuucuccuucuguggcaccaucgaguacauggcccccgaaaucauccguagcaagacggggcauggcaagguagguuggcagggaaguggggcugggggagguggaaagguggggugugaggcaggggagaugcaggcccucaccccggcuccacccggcaggcuguggacugguggagccugggcaucuugcucuucgagcugcugacgggggccucgcccuucacccuggagggcgagaggaacacgcaggcugaggugucucggugaguagggcuggacguggagggcggccagagggcugcagggccugccugggcagggcuguggguggggggcuugcugccccugacacccccccaauccucccagacggauccugaagugcuccccucccuuccccccucggaucgggcccguggcgcaggaccugcugcagcggcugcuuuguaaggauccuaagaagcgauugggcgcggggccccagggggcacaagaaguccggaaccaucccuucuuccaggugaggcugacucagggccccauaccuccuggugcauacccagguggggcugcuguuccagguugagguugugccuggccaguuucacuuuauuuggaaauccccccagagaaagaaagcaagugugugucagcuagguuucucuucacauccauccccacugaaacuuggcagauguguuccugaaagaaaggauucuagguucauuggcuguuggggcugucagggauuugagaauggauuggucgguccuuucacuggacagacccagagaaggcaggugaccugcccccgacggcacaguaaauggugccgaguugggaauagaccuugggucuagauagaucuccugcugguccaaaucaguacggaaacccacacuuauggcuuuuagcacccacccaggcauuuuguucuuuguccccgucccuguacagucugugugccugucauucagauggacgguugaucagcacacauggguguuugcucacuuguuaggagcacacacauguuagagugcagugcagagugaaucuggccaugcgagaaugcacugacucaggggcugggccuggccagcgucaucgcccagcaggacuuuguaacagucaauaccuacugugugucggcccuuugcggacaugaacucauuucacccucacaacuaccugauucuuauuuuuuagacggaguuucacuuugucuucugggcuggagugcaguggcacgaucucggcucagugcaaccuccaccucagggguucaagcgauuuuccugccucagccucccaaguagcugggauuacaggcacaggccaccacgacuggcuaauuuuuauauuuuuaguagaaacgggguuucaccauguuggccgggcuggucuugaacuccugaccucaagugauccaccugccucauccucccaaaguguugggauuacaggugugagccaccacgcccugccacaaccaccuugauuuuuguccccaucuuuacagaugaggaagcugaggcuccaaacaauuaaguacuuuguccaggaagugauggagcucagauucaacccaaggcugagaggcuugaaugccugugcuuaauggucuucugcuuaaguguaggcaucagauuugccauccgucugacaucuaaacaaaagcacccauuucuggguacuuauugugggccagguacuguguuacucauacuucgagugccaucucuuugaaucuuccaagcccugggagggccugccugagaugauuucuuacauaggaaucuaugucuuugaggugaagaugucccuuugcacgggguggggaaagcaucugagcaguguugguuucuuucagugaauuccguaagcccacccuucaccuaugcugggugcugcgcuggauacuggaguggguugaccagucauacaggagaggccccaaggucuucaaggccugauguguggaaggguguuucccuccuucugucuuuucuuuuucuuuucuuuuuuuuuggagacagagucuugcucuauuucccagagugcaguggcaugaucauggcucacugcaaccucugcuucccugguucaagugauucuccugccucagccucccgaguagcugggauuacaggugcgcaccaucauggccagcuuauuuuuguauuuuuaguagagucagggauucaccauguuggccaggcuggucucaaacuccuggucucgugaucugcccgccuuagccucccaaagugcugggauuacagacacaugagccaccacgccuggccuccuucugcuuuuucuuggacagcuucuuuggugagagcagugcucagguccuuggugguagaacuggagccuuccagcuugagucagucaucuuggcuacaucgacaaaaaguccaacucaaaauggugauaucuguuggaaucaaguuuggugcuagccacagagaucagaaugaacagagugaccuaagagguuuacuuauaaguaaaccuuuuauuauacuuacuuauaaauaaguggcuuacuuauuuuucuuuucacauaaaagaaguccagauuagcagaccagggcugccgcagugucuucacagugccacauugucuucaggaauccaaacucuuccucuucuuuuuuuuuuuuuaauuuuuuuuuuauucuuagcaaguagcuucuaucccugggguugcuucaugguccaacaugguugcuggagcucuugccaucuaagcugucucccagguagggagcaggaggaaggagaaggggcaaaaggagcacaugccaccuagcaaccucccucuucaggaucuguuccuggaauccuaccuaauaauuuuuuucugauaaguuuuggucaccccuaacugcaagcaaguuuguaaaaauauucuuuuaauuguguauauugguucguggaauaaaacuggggcuaugguacuaaggaagacagggagaauggauauugagcaggcaaucaacagauucugccgcauuagcuuaaacauaaaugggcauguuuuggcucucauaagugaaaaggucgagggaaaguggucugacuuaaggcaagaccacauccaggugcugaaacuaugucccuugguucugcuuuuucugcauggggacuucaucuaacccugagaggguccccagcaguuccagaccacauccucuuagauuuaaguccagcaggagaaagagauuuguuuuucacgccaacucuuuuuuuuuuuuuuuuuuugagaugggguuuucgcucuugucgcccaggcuggagugcaguggcgcuaucuugguucacugcaaccucugcuuccuggguucaacugauucuccugccucagccuucugaguagcugggauuacaggugugcaccaccacgcccagcuaauuuuuuuuuuuuuuuuuuguauuuuuaguagagaugggguuucaccauguuaaccaggcuggucuugaacuccugaccucaggugauccagcugccuuggccucccaaaauccugggaucacaggcaugagccaccacgcccgaccuuuucacaccaauucuauuaaaaguuccagaacugacuaaguguggugucauggugguucucuaaggggaauagggauuguguuaccagagggagagagaagccagggaggcaggaggaacagcugcccaccccaaaugccagaugggcccuugccucauggaggaacugcccagugagggugggcugaguggagggaguuucucguuccuggccuuugacaccugaccucugauucccuucccucagggccucgauuggguggcucuggcugccaggaagauuccagccccauuccggccccaaauccgcucagagcuggaugugggcaacuuugcggaggaauucacucggcuggagccugucuacucacccccuggcagccccccaccuggggacccccgaaucuuucaggugaggggaaacucauggaacccagaugcaggagagaugagauguugcugucugccucagcccuggcuggcccgaggacacugccuaggccuuguguccugauugggacucagcgucuccccuagacgucgccacuucagugggaccuaggguugucagucacagagaccacccaggcaggauguguguuugauaguucaugguuuaucuuuaaaccuucuguuaauuucccuucuauuccaucaucucuuuauuguuauguaaaaauauuguuugaaauuauucacuugcggcugggugugguggcucacaccuguaaucccagcacuuugggaggcugaggcagguggaucacuugaggucaggaguucgagaccagccuggccaacauggggaaaccccgucucuacuaaaaauacaaaaauuagcuggauguggugguaugcgccuguaaucccagcuacucgggaggcugaggugagagaaucccuugaaccugggaggcggagguugcggugagcagagaucacaccauugcauuccagguugggcgacugagugaaacuccgucucaaaaaaaaaaaaaaagagaucuucacuuucucacguggacaccuaggaggagaugcauguugauauuguggcuuugcaugcccuuggcauagcaugguacacuccuggagggucagguccccuccaccgaauuuuuuuuuuuuuuuuuuuugagacggagucucacucugucuccaggcuggagugcaguggcuagaucuuggcucacugaaaucucugccucacggguucaagcaauucuccugccuuagccuccugaguaguugggacuacaggcgugcgccaccacacccagcuaauuuuuguauuuucaguagagaugggguuucaccauguuggccuggauggucucaaucucuugaccuugugguccgcccaccucggccucccaaagugcugggauuagaggcaugagccaccaugccaagcccccucuacugaauuuuagaagcuuacaccuuuuggacaaguccaaacucccuuugcuugggcauugaggcccuucaugaugugguccuugcuuagaaccuuagccucaguucucaucauuuuccuacuugaugcucuggagggcaugaucgaacugcucagagguuccagaauauaccucugugccuuugcacuugcugcuccugcuaccuggaguacauucucuacagcagucuacauggcaagcuucuaccccucuuuuaggccuccuugucugcucaccuggcccagggggucacccuuucuuugugcugcaguccucuguggacagcaucuccuucugugcaguuuaucauguugccauaaugauauuauaucauuaucacuaaauaaaccaguaugguuuguuuaauagacagaccaaguauggcuggauaagucccuucucugaagcucuuagaauugacaacucugugcuugaauguccacauuccauuccauugucucacagcccucaugauaaaguucuuucucuugaauugguagguacuuucauucauucauuuaaugauucaaaaauguguagugagugccuaaaauauuccagguacggaucuggguacuacauuuuuaggagaagaugacacauaguuuauuuuuaaaauuauuuuuuaaaauuaauuaauuaauguuuuagagacaggaucuuguucuguggcccaggcuggagugcaguugggcaaccauggcucacugcaaucuugaacuccugggcuugagugauccucccaccucagccugcccaauagcuaggacuacaggcaagugccaccacucccagauaauuaauuuuuuuuuuugagacgcaguuucgcucuuguugcccaggcuagagugcaauggcaugauaucggcucaccgcaaccucugccucccggguucaagcgauucucgugccucagccucccgaguagcugggauuacaggcaugugccaccacgccuggcuaauuuuuguauuauuaguagagaugggguuucuccauguuggucaggcuggucucaaacuccugaccucaggugaucuaccugccucagccucccaaaguacugggauuacaggcgcaagccaccgugccuggccacaacacgcaauuaaaaugacccuuaaaagcuccucaaauugccaggacauggaucuuuaggaaaagcaaagaauuaacucugccuucuuuuugcauuucuucaguagcuccccuugcagaagaagccaaaguccggcuugaaagggaggaauaaguuuuuuuuccucagcggauagaguuggauucucauaagcuaagcgugaacucaggccacacuuucaauauauucauugguccuuucagugccuucagcccuuggcaccuggggaggaauaaguggucacucugaugagaaaguuggggucacaggcugguggggacagacauggccccaagugauuauaaaaccagguggaauaaaaaguguccacacauccuguguguaccagaaugcaacuggaacaccccccacugcccccuuguccagggucuugccuuugccugguuccccaccagagucuccucacccgcacccccaacccccaugcccaugcccauuccccggacucccgcccugcagggauacuccuuuguggcacccuccauucucuuugaccacaacaacgcggugaugaccgaugggcuggaagcgccuggugcuggagaccggccaggucgggcagcgguggccaggagcgcuaugaugcaggugggcugggcugggcuggguuggggggaaauugguuuuaggagaggccuaggcccggggacucuaggccuagauccaacuggcgcccgcagcgugagcucagcaagguccuaagccucuccgacauggggcguggcggggccgcggggcuaccaggugggaccucugacgcgccgccuucgccuucgccuucgccuucgccuccaggacucgcccuucuuccagcaguacgagcuggaccugcgggagccugcgcugggccagggcagcuuuucugugugucgccgcugccgccagcgccagagcggccaggaguucgcagucaagauccucagucgcaggugggagggcccaggcgcgggcagggguggggguggcagagcgcugucccgggggcggggccgaagcgcggcgaccguaacuccuucugcuccgucccccaggcuggaggcgaacacgcagcgcgaaguggcugcccugcgccugugccagucacaccccaacguggugaaucugcacgaggugcaucacgaccaggugauggcuuccggccaggggagggcggagagaaaaggggcaggcggcggggcuugggggcacuaugggcgggaucuaggggugaauugggcggggccuagcguuugauucggggcccaaagggaccagggaggcgcagggaguggaauuugaggggaguagggccugaggacgggaaggcggagcugaggauggacaagaaaagggacuuuggccgggcgcgauggcucacgccugugaucccagcacuuugggaggucgaggugggcggaucacuugaagucgggaguucgagaccagccugggaacauggcgaaaccccgucucuacgaaaaauacaaaaauuagccggacgcgguggcgugcgccuguaaucccagcuacuugggaggcugaggcacgagaaucgcuugaacccggaaggcagagguugcagugagccgagguggugccacugcauuccagccugggcgacaaagcgagacugucuccaaaaaaguaacaaagaaagaaagaaagaaaaaggacuuugaggaggggguucucgaacauuggcagggcccgaaggccgggggcggggccuggguggugggagggggcuugccgccguggguggguguugaccuuggcccgccacgccgcccgcagcugcacacguaccugguccuggagcugcugcggggcggggagcugcuggagcacauccgcaagaagcggcacuucagcgagucggaagcaagccagauccugcgcagccucgugucggccgugagcuucaugcacgaggaggcgggcguggugcaccgcgaccucaagccggaggugggcgagcugccucggcggcggggcggagcgguggcgccgggggcugccucugaccacuaccccgccgcccucgcagaacauccuguacgccgacgacacgcccggggccccggugaaaaucaucgacuucggguucgcgcgguugcggccgcagagucccggggugcccaugcagacgcccugcuucacgcugcaguacgcugcccccgagcugcuggcgcagcagggcuacgacgaguccugcgaccucuggagccugggcgucauucugguaugggacgcgguccuugaggcggggucagggucgcucggaccuggcgucuuccugaugugcagcagcacgagggaggggacaggggucaucuuggugggggcggcuggguuucguccgaagcugggaucggggugguucaaauacagagguggggucgcucuggugcuagagucggagcauccggguauuggggguuagaagucaggguucaccacgcgugggucucaggagugccccuaguggggagggugagugguucugugggagcggaggggucagccucggcaccccagccugggccggccucaccuuccccucacccuccuaguacaugaugcugucggggcagguccccuuccagggggccucuggccagggcgggcagagccaggcggccgagaucaugugcaaaauccgcgaggggcgcuucucccuugacggggaggccuggcaggguguauccgaggaagccaaggagcugguccgaggugcggagcuggaggucauagaccaugguuggggagggggacgcugggacagggauggucacugggccagguguccugguuggggauggguaggggaggagaguggggcuguuacgaucucuuuggggcucagccuuuacgccaggcuccuccccacacuuccuugccccgccuccagggcuccugaccguggaccccgccaagcggcugaagcucgagggacugcggggcagcucguggcugcaggacggcagcgcgcgcuccucgcccccgcuccggacgcccgacgugcucgaguccucugggcccgcagugcgcucgggucucaacgccaccuucaugguaaggggcagggucuguugaagggaaggggugggcgaagccucgagagguggggucuggggaggcccggccaucggagcacagaaaggcgaggugaggccgggcgcgguggcucacgccuguaaucccagcgcuuugggaggccgaggcgggcggaucacgaggucagggguucgagaccagccugaacaacauggugaaaccccgucucuucuaaaaagagaaaaauuagccgggugugguggcgcgcgccuguaaucccagcuacucaggaggcugaggcaggagaaucucuugaacccaggaggcggagguugcagugagcugagauugcaccacugcacuccagccugggcgacagagggagacuccgucaaaaaaaaaaaaaaaaaaaaaaaaagggaggugaaccgaauccgguggucggucuggaggccaaggcccugucggccuugaccuaggcggcuggaggcaaggucugggaauggaggucaaacuagaucuggaagccggggucaggcgggggugggggcacucacccuuuccuuucugccaggcauucaaccggggcaagcgggagggcuucuuccugaagagcguggagaaugcaccccuggccaagcggcggaagcagaagcugcggagcgccaccgccucccgccggggcuccccugcaccagccaacccgggccgagcccccgucgccuccaaaggggccccccgccgagccaacggcccccugccccccuccuaauccccaccacugugacccccuucccucauaggggcugugaccugggagcccggcucacucccggaggccucugccugcggcugaccugauccccaagggacuguccuuuccucuccuaccccaccccacucccagacagagcagaaguauuuuuauaagcagagaauuuuuuaugucuuaccagauagaguugcagggaagggggggccugcuggggagugggguuuggggggcccucucccaggacacugccucuucugggcagaaggccccuccagggggacugcuccaacaggaaagagccccucccccacuucuaagcacugaguuaggagugcuaacuccuaaacugggacccccuacccuguucuccccugaggccccguuccugggaggggcaccccucaacugucacuuuauggacugucugugcaauuacguccaccaaagacccguguuggggguacugaaggagaggcccugggggacccucugaagcauuucugccucacuuuaugucaucugcuucuccccuguuggggcuaaggaaggagauagguggcuccuaaaagaggaggccaucuucucacccaccccuuccucuuuggcacagcuacuccuggcuggggguggggccuugggggucugggcugggcauccauggucacugccucagcccagccaggcugugccuuugacuuuaaaauaaaaguccacccagugcuguguguggca

SEQ ID NO: 18706 - RNA, 17341 nt, Homo sapiens
cggggacuuccucuuccucucagggcaggugcagcugccacagugagacgggcaccccgacccgggcauggaggggggcaaggggcccaggcucagagacuuccugagugggagucuggcuaccugggugagggggcagguggcagcggguuggggaggggaagugagccccagccaggggcugguguuggcgcuggccgggggagggugaggcagaaccaggccggaggggagggcuggguucaaaugugggggauggagauaugguguggggggcuguggugagggaagaggggacagaggcacucagaggacgggugagaaggggugcuugggcucacuggggcaggucggaggggcucaggguucacucugcuggucggcugaccccucugggcuccucacaggcgcugggacuggccgggcuggucggggaggcggaggacucggagggggaagaagaggaagaggaggaagagccgccccuuugguuggagaagagauuccugcgccucagcgauggggcccugcuccuccgggugcugggcaucauguaaggggcaucgggccggggcgguggcggggaaggaucugagaggaggggaagcgggugggcggagccugaugcucagugggcggggccugagggacggugggcgaggccuguugacgggaggcggguccucgagcccaccuccggcucauagugcccccagcucccgagggggaccucggaugcucagaggccuugacggaccugcugccuggcgaguguggaaccugaaccaccuguggggccgacugagggacuucuaccagguaaggggucucgagggaaaggcggagacaggaggggaagaggagccccuucgggaaggcgccucauauagucugccucucugccuccaggaggagcugcagcugcugauccugucgccacccccagaccuccagacauugggauuugacccucucucaggugcucuccccacccacacccuccugccucugcccccgcacuacucuaccuuccccgccccaguuaaccccuuguggcaugugccuugcagaagaagcgguggagcagcuggaaggcguucuucggcuacuguugggagcgucaguacaggugagccggcggugggaaggaaagguuagggucgagcuuuggcgguagaggagggagauccugcaccagcuccccuuccugucuccccucagugugagcaccgggaacucuucauccgccacauccagggccucagucucgagguccagagcgagcuggccgcugccauccaggagguacugagacgguucggcagcccagacugguauggcaccugggacgcccuugccacaccgcggcuuccacugaacugcucuuccugcgccccaggugacccagccgggggccggcguggugcuggcacugucugggccagauccuggggagcuggcaccugccgagcuggagaugcugucccggagccugauggggacacugucgaagcuggcacgggagcgugaccugggggcccagguaggggcagcaggggcaucguggacucagguuggggaacuggaggaccaucagggagccgguugugcaagggagauggaaguuuggggcccaggcaugggguuguggucugaggucuugggccaucagugaugucacaaccagauggcccaagaccccagaccacaaccccaugucugguguugugguugggggucgaugugcagaggcauuggauaaguuaguccugacccuugaccccugaccuacagcggcuggcugaacugcugcuggagcgagaaccccucugcuugaggccugaggcucccucuagggcucccgccgagggccccucgcaccaucuggcccugcagcuggccaacgccaaggcucagcugcggcgucugcggcaggagcugugagugugcgcagccugggaaggggacugaguggagaggggcagauuaagccuggaugggacccuagcccugguggcuacgggaggggucaggccugggaagggcuggggguugugggcccccagacccucccuagacuccccuucccuccagggaggagaaggccgagcugcugcuagacucccaggccgaggugcaggguuuggaggccgaaauaagaaggcuccgccaggaggugcgcucacaugcuccccgccaccgcggcauucccuaaccuccccgcacccggucccauugccucccucccaacccggcuccuucccgucccuaaucccucuggcccgcggcuggcuguucccagcuccacaccgucuggcccaggcccaggcgcugucgggacaggccaagcgggccgagcuguaccgcgaggaggcagaggcgcugcgggagcgggccggccgccugccccgccugcaggaggagcugaggcgcugccgcgagcggcugcaggcggcugaggccuacaagagucagcuggaggugaggcggagacggagccgcggggcggggcgugcgcgagggggcgggccaggaggaggggcgagauugggucccgagggcagagaggcagguucucuggaggggacagucacagguggagaaaugggugaggacaaauucagggagguggcgucugggaaagggccuccagaggauggggcagguguaggggagugggggggcuguguaagugaugcagccuuggaaggagggcuguucccgggggggaggggcggggcauggacagaagggcggggccugcacaaagggcggggccaggggcgagggagaaaguaccugaagagaucuuggugggaagaagauggaagggaguggcggggccuagagacugauggggugcagggugggggagggaggcagggucugugacaggcugaggggaaggaguuugggacccucaggcgcuggagugcaugggggcugcguggcuaccgguucucccugcucucccaccaggaggagcgggugcucucgggggugcuggaggcguccaaggcgcugcuggaagagcagcuggaggcugcccgagagcgcugcgcccggcugcacgagacccagcgcgagaaccugcugcugcgaacccggcugggcgaggcccaugcgguaagguagccagagugaucccacuuggguugccccgucaccccaugaccccauugauucccuaguggucccuagugauucuugcaaccucugcucuuggugaccucuagugacccuccgaccuacacacucggccuggccaugguguggagggcuugucugacccuucccucacccccaggagcuggacucucugcggcaucagguggaccagcuggcugaggagaauguggagcuggagcuggagcuucagcggagcuuggagccaccuccaggauccccuggggagggugagggaccccacuggaagggcuggggugggggcuuccuaugcuuuccagcaguguacuggggagagccucugacucccucccuucucccaagccucugggguguguaugugaggagccaggcaguaaaggagggguccugaccucaucucucauccucagcaccccuagcaggagcggcccccucgcugcaagaugaggugagggaggcagaggcugggcggcuucggacccuugagagggagaaccgggagcuucgggggcugcuucaggugcuucaggggcagccagggggccagguaaguccccucccccaggguccuggccggcccuuccccuagucccucccugggccugacugucccucucguaugcccucagcacccccugcuggaggcaccgagagaggacccuguucuuccagugcuggaggaggcuccccagacuccuguggccuucgaccacagcccucagggcuugguucagaaggcaagggauggaggcccccaggccuuggacuuggcucccccggcauuagacucagugcucgaggcaucagcugaguguccccaggcaccugauucagacccacaggaggcagagaguccccuucaggcagcugccauggacccccaggccucagacugguccccgcaagagucaggcucuccuguggagacacaggaguccccggagaaggcuggccguagauccucucuccagagcccugccucuguggccccaccucaggguccagggaccaaaauucaggccccgcaguugcugggaggagagacagagggaagagaggcuccccaaggcgaguuggugccugaggccuggggguugagacaggagggcccugagcacaagccagggccuucggagcccagcucugugcagcuggaggagcaggagggcccaaaccagggccuggaccuggccacgggacaagcagaggccagagagcaugaccagaggcuggaagggacggucagggacccagccuggcaaaaaccacagcagaagucagaaggggcucuugagguccaggucugggaaggcccaaucccaggggagagccuggccaguggugucgcagagcaggaggcccucagggaggagguggcacaguugaggagaaaggcugaggcccuuggagaugagcuggaagcccaggcccgcaagcuggaggcccaaaacacggaggcugcccgccucuccaaggagcuggcccaagcgcgaagggcagaggccgaggcccaccgggaggcagaggcccaggccugggagcaagcccggcugcgggaggcaguggaggcugcuggccaggagcuggagucugcgucccaggaacgggaggcgcugguggaggcgcuggcagcagcgggccgggagcggaggcagugggagcgugagggguccaggcugcgggcccagucggaggccgccgaggaacggaugcaggugcuggagagcgagggccgccagcacuuggaggaggcugagagggagcgccgggagaaggaggcccuccaggcgguaggucagguuggggcucaccgcugggguugggaagcagaguuccaggcuguugggaguuacugauuccaucagcagcuguucagugggugcccagcacugagcuggggcuggagauagaaaggccaaguccaccccugccuuccaaaggugugccuggccuggggcacagagccauguccacugugugaugggggcgcugugggagggggugggacugccuaguacacaucuuggcucucuggcugcagcaguagacucaccuccaccccaggcauccuucuguaaaacagggguacuauuccuggccaccugggguggucuuaggaggaccuugggagacaguagcuguaaaggucugguucaugcuggcaaggguauguuguaaguguucaagcacugguuauucagagccaagugcuacgagagcccaugggagggugagcugaugcccaaguggaggcaaggaggcuuuaggaggagugaccauaaugucacuagguggggaggacauuuuguccagagggaauggcaugugcaaagacaaaggcauuaaagacgcucaggggcugggugugguggcucacaccuguaaucccagcacuuugggaggccgagguggguggauuacuugaggucaggaguucuauaccagccuggccaacauggugaaacccugccuccauuaaaaauacaaaaaucagccaggcgugguggcaggcaccuguaaucuguuacuugggaggaugaggcaggagaauugcuugaacccggaaggcggagguugcagugagcugagauugugccacuauacuccagccugggcgacagagcgagacugucucaaaacaaacaaacaccauccaaugaaacaacaacaaaaaaagaaugcucagggcccaggaggaagggaugaugagggccagcuuugaauguguugguccucccuccccaggcagggaaagccaggguagaacuguguggggcugcgcuugaggagggucaccuugguggacaggggagcuuggggcuaucaggacgcaguagccaugguguaaguggcagaggaagcugacuagggaggcaugggagugggugugagaggaggacuggacacuuuuuucuuuuugagacagagucucccucuguugcccagucuggagugcaguggggugaucuugguucauugcaaccuccgccucucagguucaagagauucucccaccucagccuccugaguagcugggaguacaggcacacaccaccacgccuggcuacuuuuuguauuuuuuuuuuuuuuugagacggagucucgcucuuucgcccaggccagacugcaguggugcuaucucggcucacugcaagcuccgccucccagguucacgccauucuccugccucagccuccggaguagcugggacuacaggcacccgcucccgcacucggcuaauuuuuuguguuuuuaguagagacgggguuucaccauguuagccaggauggucucgaucuccugaccucgugauccacccgccuuggccucccaaagugcugggauuacaagcgugagccaccgcgcccggccaauuuuuguauuuuuaguagagaugggguuucaucauguuggccuggcuaguuucuuucuuuucuuuucuuuucuuuuuuugagacagagucucccucugucaccaggcuggaggcgugaucucggcucacugcaaccuccaccucccagguucaagcgauuuuccugccucagccucucguguagcugggacuacaggugcaugccaccaugcccagcuaauuuuuugaauuuuuaguagagacaggguuucaccauguuggccaggauggucucaaucucuugaccuugugaucugcccgccucggccucccaaagugcugggauuacaggcgugagccaccgcaccuggccaacacacuuuuacuuauucauuuaaacauguuuacaggcaucuucuuggugccaggcccuguaccaggcucugggcacacagcagugaccacgaagcuagcaauccaguguuugggcguggcuucagcuuccuuccaagcuaaggaagggguuagggcuuuugccaugggggauugggcagccacugaaggcuccccaaugggcaaagugagcaaaguggucaggucugcgugugaaaaggcgcgaggaaggguguuugggccaaugggccccagugcuaggggaccugugagauugcaacacagguaggaacugagucauccugcacaggcaguuuccagucccauuucuguacagacaaggacccugaaauucagggaggaagaguaauuugcucagagacccauuaugaggaugggggguggggagaacacugcuggguagacauggggucaggcguugugcaagacaggcccaggguaaggggguucuggcgaaugugagagggaaggugagagaccaucucugggguccacucugugggguguggcugagaugcugucuagccgggcgaccugccuacuuuccagcuguguggcuuggggcaaguuacuuaaccucucugagucucaguuuucucacuuguaaaacuggaauaaaaauuguaccugccuuggcugggcacaguggcucacaccuguaaucccagcacuucgggaggcugaggugggcggaugaccggaggucaggaguucgagaccagccuggccaacauggcaaaaccccaacucuacuaaaaacacaaaauuagucgggugugguggcacgcaccuguaaucccagcuacucgggaggcugagguaggagaauugcuugaacccaggaggcagagguugcagugagccaagaucgcgccacugcaguccagucugggugacagagcaagacuccgucucaaaaaaaaaaaaaaaaaaaaaaaaauuguaccugccucacaggauccuguaagauaaugagcguagggagcuuggggcaaugccuggcaccuagaauggaccuguuccaugggagggaauggcagcagguaggcagugaaggugaggguagggcuggcgggcuggaagagccggcuccaaggacugagagggugggggaagcuagggacaaagggggaauuuugugagauuuccugguuggagcaggagaagguggcuggccagggggaggucagggaaccagggggucucagguuguccacuggguggggaagccucccaggcuugggggaggggguucuaggagggcuguggccagggcccggaggagggcagggcaggggcugggcgggagguucuauucaccgugccuccuaccccaguacuugcgcuaguggcugucagccagccaggcagcagugccucaucggacuuguaguuuuucagggagaggugguggccaagagugucaggaggugcagugccccuugggcaaggccuaggugcaguuauuaagccaggaagguaguuuucagcagcaaggcuuguaggcuugguuuccaaggcaggauuuggcuggcagcuggucaugggcagcuguccccgaagcuucauccugccaggccccccauguggcagaaugguuuggucucccucccucuggggcacacaggccagaaugggccucccgucuccuuccaaaguggugcagcccaaccgccaaaggccacaggucaccuagcuggcagcauccuggcgcccccugcccccccagcccccacugucagcuccugacuuccugucccuccagcccuccguggccuuuucccuguagccaaggucucucacccgacccaccucugcugagccucucuagcugucucgcugucacauggcugggguggcagcccaccgggcgcauccaccuuucacugcgcacaugaagaaccgugggcucagagaggugacggcacuugcccaacaugugucaccuaccgacucccagcccaggggccuuccucaugcccugccaggcuuacaacacccagcucuuucaugcccaauuucaagggccccaggcuuugcucccauuuuauagauggggaaguagagcccaaaggcuuaaugauacgugcccaggauggcaggucaaggacagaaaggcagcucucuugacucucaggccucugucuccggcugucuccugcccccuugcccugagccugcucugcuugcccucaggagcuggagaaagcuguggugcggggcaaggaguugggggaccggcuggagcauuugcagcgugagcuggagcaggcggcucucgagcgccaggaauuucugcgagaaaaggaaagccagcaccagagguggggacagggcugaggggaagaaugagggaggcaggggugugguggggcgagggugggguggggcugggugcuaaggauucuccuggcagguaccagggcuuggagcagcggcuggaagcugagcugcaggcggcggcgaccagcaaggaggaggcgcugauggagcucaagaccagggcccugcagcuggaagaggagcuguuccaggugaugccugcccgccugggagcugggggccaugccacccugcccuccaucccaugagcagaugccagggucaucuguccuccuagucuugccucuggauucuuggcuagcuacuugccucacuccccauguggggccuguuggagagagcacugugcugggagucagguggccguguugacuuaucuggggucucauuuuccccauucugcacauggacagaacuucugcuguggaugacugcuccgccugucucacccgagguccuccacugccuagggagcucaguguuuggcaucaaggaagccagcgaugguuucugauacccaggcugugugcgggcuccacacggagggugggguggugguggggcccaaucccaggcugccauccucagggagcucacaggacagucaggauagaggcaagaaaacaggugacaauaacuaggugccaggggcugugaggaggccaugcaggggcuugggagggugguacccagcaagauacccagcaggugcaugcgagucuaucagggaagguuuuguggagaaggugggguugaaacagaggcuuagagaaggccccacacagcagcucaugccuguaaucccagcacuuugggaggccaaggcagguggaucaccugaggucaggaguucgagaccagcaugaccaauauggugaaaccccaucucuacuaaaaauacaaaaaucaggccgggcgugguggcucacgccuguaaucccagcacuuugggaggccgaggcagauggaucaugaggucaggagaucgagagcauccugaugaacaccgugaaaccccaucucuacuaaaaauacaacaacaacaacaaaaauuagcuguuagcugggcaugguagugggcgccuguagucccagcuacucaggaggccgaggcaggggaauugcuugaaccugggaggaggagguugcagugagccgagaucacaccacugcacuccagcccgggugacagagugugacuccgucucaaaaaaacccaaaaaaacaaaaaaaacccuaaaaauuagccaggcgugguggcccacaucuguaaucccagcuacucgggaggcuaaggcaggagaauugcuugaacccgggaggcagagguugcagugagcccagaucacaccucugcacuccuggcuggguggcagagugagacucugucucaaaacaaaaacaaaaaaccaaauagucuuagaggaguagugggauggagaaguguuaugagcagaaggcucugccgcagagagacagaaguugagaagggcaggguggugacgguggagcuucaggaaccaggagcagggacuugugggauccaagggaaggcaugggauuggggcgggguggacuaggcuaaaugcugcuggcagggcagguccauaagcgcagguccuugaggcauccccaaggcacugcggcugucccgcaugaccucccagggacucuccuugcagcugcgccagggccccgcggggcuggggcccaaaaagcgugcggagccucagcugguggagacccagaaugugcggcuuauugagguggagcgcagugugagugugggcccacagugggcccuggggaggugccccgugcagugugaguguggguccacgguggacccugggcugggggguaucccgugcagugugaguguggacucacagugggcccgggggugggggugccccaugcagugugagugugggccugugguaggcacuagggggugcccccgccaccuggcuauugcuaacccccacuucugggcagaaugcgaugcugguggcagagaaggcagcuuugcaggggcagcugcagcaccuggaggggcagcuggggagccugcagggccgugcccaggagcugcugcugcagagccagcgggcgcaggagcacagcagccgccugcaggugggugguggcccgggugcccaucccugcccauguacugcccccuccugcuccuuuuggaucauccuguggccuuuuucuaucccagcucccagccagcugccccaccucuuccccagucucauuuauccuuguccucugaccccagccaccauuuugcaccauccucccugccacuaucuccuccuaccugccgccagcccccacaucuacacccaugucgcccugcgcucucacugucccagcccuccccuccacagggcgccauuagucccauucugcccugugccccuuccggacagccuggcccagccagccucugccgccucuccccugcucaccaucagccucuggcuggggcuuguacugccugcugugcccccagcccuuugccuccuccacaacucucucauugucuugggcccuaccgucugcccuuagccccccgccucucacucgauuuccagccagggguuccuccccagcagccccugcuucccuccuccauccuaggccgagaagucugugcuggagauucagggccaggagcugcaccggaagcuggaggugcuggaggaggaggugcgggcggcacggcagucccaggaggagacccgcgggcagcagcaggcccugcuucgggaccacaaggcccuggcacagcugcagcggcggcaggaggccgagcuagagggacugcuggugcggcaccgagaccucaaggccaacaugcgggcacuggagcuggcccaccgggagcugcagggccggugagcaucaccaaaugcccagcuccuccccuggcacccccuaucugccagagaagacuccccucagcaggucugacuccccaucaggaagcaccuccaccuccgcucugugaugccccggccacugcugugcccucugggguagcugugcuccccacacuucuggguugggcuccccguggggcucaccuauugggaguggugggcaccuggcauggcauucugcccaauggcuuccucugggggaccuaggcuuaggaggugacagacccccccgccccggguccagauaguccagccagcugcuugugguggccauagguucacacagcccucuuagccccuuguccaucccaggcacgagcagcugcaggcccagcgggccagcguggaggcacaggagguggcccugcuggcagagcgugaacgccugaugcaagaugggcaucggcagcggggccuggaggaggagcugcggaggcuucagagcgagcacgacaggugccgccccugccacagccucuagcagcucucaguggccccauccugaaaguggguugggggugugggguccugucuggccuccccuccccggcauaacuucucuggccagcacucggacuggggacccaggucccuuggagagcagcucuccuugccucccaagggcucagaugcugcuggcagaguugucucgggagcggggugagcugcagggugaacgcggggagcuacggggccggcuggcgcggcuggagcuggagcgggcacagcuggagaugcagagccagcagcugcgcgaguccaaccagcagcuggaccugagcgccugccggcugaccacgcagugugagguguggcuggagggccgguggggguaugggcgugugguggggcagaaagccuagacccaggugguccugagcugggucccacccuccgagccauggugccccccugccagcuauugacacagcugcgaagugcccaggaagaggagaaccggcagcugcuggcugaaguucaggcccugagccgggagaacagggagcuccuggagcgcagccuggagagucgggaccaccugcaccgcgaacagcgggaguaccugugagugggccgccugggagcgggguggggccugcauccccuuugggcguuccuggggagagcccuuagugagggccuagggacaggguuggagcugaccuuccaggucaguccaaucugcggcacgggaccagugcguccucgcugcagcuugugccuugcuacugccucggccucccugggccucacacccaccucucccuucucacuccugccagggaccagcuuaaugcccugcgccgcgagaagcagaagcucguggagaagaucauggaccaauaccgcgugcuggagccugugccccugccccggaccaagugagcagcccugucaccucccucaggcuggacauccugcuaaccucugccccugcccuggccucugaccccaggcccagcucagguccaggccccaugaaggucaaccuggccuuugacauccccaggacacccuuugcucccucccuccucccuguccugacccccucuugugcccucuugcccccaggaagggcagcuggcuggcagacaaggugaagaggcugaugcggccccggcgggaggggggccccccuggggggcugcgccugggggccgauggggcuggcagcaccgagagccuggggggccccccggagacggagcuuccugagggcagggaggcagaugggacaggugggucugggggucagguggccaggauggucccugccccacauccucugucccccaccuuggcaccugccucacugccuggccugcaugcgugaccccauuggccuucccugaggccugcccccccugcccugaugccaccaggggcucuuuucccuggguccuacagggucacccuuggcccacaccucccuccugccugugcuguccccgacccagccugccccauccgcagcggagcccaggaucugggaggugcaguggacucuagggagaggucauuguuccuagacugcagaugaggagacugaggccccgggaggggaagcuuuugcccaaggucaugcagugaguuaguaugaaggccagcacagggccaguguccugcugccccacucauuugccuggcuucucccccaccucugcaccuccccucccuggcccugggcagcuucacccacuggccccucuacuccauccagggcccuguuccucugacccccucccugcaugagccuccgcccccccccucugaccccuccccugcaugaaccucagcccccucuucugacccccucccugcaugagacucaguccccguucccuuccucugacccccucccugcauaagccucagccucccccccuccucugacccucucccugcaugagccucagccuccuccccuccucugacccccucccugcaugagccucagcccccacuucccuucucugaccuccucccugcaggagccucagcccccccgcuccccucgucugacccccucccugcaugagccucagcucccucuccccuccucuggcccucuccgugcaugagccucagcccccacuucccuucucugaccuccuuccugcaggagccucagcacccccuccccuugucugacccccucccugcgugagccucagccuccccccauucucugaccuccucccuacaggagccucagcucccguccccuccucucacccccucccugcauguaccucuugcaggguccccuuccccggcacccaugcgccgggcccagagcucccucugccugcgggaugagaccuuggcaggcgggcagcggcggaaacucagcucaagguucccgguggggcgaagcucugagucauucagcccuggggacaccccuaggcaacgauuccgacagcgccauccaggcccccugggggcgcccgucucccacagcaaaggugagggacaagggucacuguaccagccagccccccaacucuuuguggacccaccagcuccuugggggaggaggcuuccuucuuguccccugugucuccugcaagcucuguccacuuccgcacuggcccugggcccagugguugccuugugccucccaggaccuggugugggaugggagaacuccgcugagacccugcaggaacacgaaacagaugccaaccgagagggugagugggggacuguggaaggaguaguauucuuuguccugccuggggccccuggcagaaccucauucauccauucuuucauucgacaaugauccuuuaccaagugccaggugacgugcuggcaggggacacagcagggaacguucuggugugaggaggcagauaguaaacaauuugccuaaaaauaauuauuaucuacaacagcccuguccacuagaaauauggugugaaccacaugauaauuuuaacuuuuccaguaggcuuaccagaaaaagugaaaagagacagguacaauggauuuuaauaacauuuaacucaauaugccuacgcuauuaccauuucagcauguagccaguguaaaaaucaugaaugagcuauuagacgugauguuuuuuuuuuuuuuuugagauggaauuucacucuuuggcucacugcaaccuccuccucccagguucaaacgauucuccuggcucagccucccaaguagcugggauuacaggcaugggccaccacgccaggcuaauuuuguauaauuauuauuauuuuuuuuaguagagacgggguuucaccauguuggucaggcuggucucgaacuccugaccucaggugauccgcccgcuucagccucccaaagugcugggauuauaggugugagccacccagccagacgugauuuuuuucauaguaagucuuuggcaguuucggaggccaaggcaggcagaucacuugaggccagaaguuagagaccagccuagccaaaauggugaaaucccgucucuacuaaaacuacaaaaauuagccaggcauggugucccaugccuguaaucccaccuacucagggggcugaggcaggagaaucgcuugaaccugggaggcagagggugcagugagccaagaucacgccauugcacuccagcguuggugacagagugagacugucucaaaaacaaaaaacaaaaaacaaaaaaacauaguaggucuuugaagcacgucacaggccaaccccaucucaccuacuuagcuccgcccugggcagcucagcccuagacccggcuggaccaucaggaggcgcuaaugcucugggaagaaaggagagcaggggaggggucaggagcucaggagcucugggcaggcugguuggaguuuuaguaacuggggugcuggggugggccucagagaggaugugaaauuggagcaaagacuuggaggggagaguuugucguguggacauaccugagaacagcauucugggcagagggaaccgcugagggaacagcaggcguggugcagcuggaagcgggggguauuggcaggucgggggugggcagaaggugcucgagccugugggccuccugggacucugggaguccuccugagggaagcagaucucagcugagccuuucccucuaggcccugagguacaggaaccggagaaacguccccucaccccaucccucagccagugacaccgugggaacagcaggcuugggagugcagccuucucggcacuggagugucagcggaggccccaggcagcccaagagcucagggagccagggaccccaaggggaguccuuggacaaggaggccugggcccugagauccuccacggucagcgccggggcccggagauggagcugggacgaguguguggacaggggggauggcuggcccccacgagcagcuccaggcuggaguucugguucuuccagguggcucccgcugaggcagcggucucugggggaucccccagcugaaggaggcuggcaggaguuggcaagagaacccccugcccuguccaggugggaagcugagucccagugcugggggacuguggccugggcugaucuugagccuuaacuggacaugaggggcaugagaauaaagcugaacugcagccuccugagucuug

SEQ ID NO: 18707 - RNA, 4513 nt, Homo sapiens
cgcgccacgaaguugggguugaauuccacagggcagauacggaccucgguggccugcagggcggaggaguuuaggcaagcacuggaccccggcccaccaucccgcccgaaaagggaagacugccgccggcggguaccuggaggcgcagggggaagccacgggaccccaccccccgcacaugcgagcucagcagauuguggguaagcaguuucaugucgccgcacaaacucucgccaggccggaaccggaaaaaggucguccuccgcugccucacuuccggggaugcuccucucgaugcuauuggauagccaggagaaccggaaguggcgaacuugcuggaacuucucguguuugugggagcugagguagguaggugaaagaccugucgggucacgcgccgcuaccggaagcgucucagcaggagguuccuacggcgcacgcccagcuuuuuuuugccacaaauucuucguaagaugcaaaucauaugcaaaauagcugcaaugcaggagcucucguugaaugcaaaauaaacacauuuuacuccuacacaggcgccuaacaccgucguccucuguaucccacuuucgguuaaggggcagaaauaccgcccuaucuguaaauuaggcccauggaagccgagccgcaccucauuccuauaugcaaauuagcugcuccagugccgaaagcuccgccccauuuguaguugcgucggcuguccagcacccagugcaaacgaggcgugggucccggaagcucuguucugcggguggccgcucgcgccugcgcaguggaggcggcccaggcccgccuuccgcagggugucgccgcugugccgcuagcggugccccgccugcugcgguggcaccagccaggaggcggaguggaaguggccguggggcggguaugggacuagcuggcgugugcgcccugagacgcucagcgggcuauauacucgucgguggggccggcggucagucugcggcagcggcagcaagacgguacagugaaggagagugggcgucuggcgggguccgcaguuucagcagagccgcugcagccauggccccaaucaaggugaccgcuggcccggccgggccugacaucccccacuacccccauggcaauccccgucccgcuagucugagaguaucgcuuuauuuccugccugccagaccccuccccuccgcccgcccggcucaucccuucagaaggcccucguggcugcccaccuuucucgccaaucgugggggccucaccucccgggacagucccgaggcauuguguuuuuuguuuuuuguuuuuuuuugagacggagucuuucugugucgcccaggcuggagugcagugacgcaaucucugcucacugcagccuccgccucccggguucaagcgauucuacugccucagccuccugaguagcugggacuacagaugcgagccaccacgcccagcuauuguauuuuuaguagagacgggauuucaccccguuguucagauuggucucgaacuccugaccucaggugaaccccccccgcccccccccgccucggcuucccgaagugcuaggauuacaggugugagacaccacucccggccugauuuccccuaucuucugaaacagcugucccuuagcgcccccgcgggggcuuaccccaucccacuccaugaccuccccuccccccauggcgaauucccaccuuucugucuuucacucacuuccuggaaccguccccagggccuuggaccuucccccuucuccucccaaaccuugugagaccccauucccuuucuacuucauccugcucucaaccuuugggcuccucagaggcccucaccucugacucucucucccuacccacucuggucccaugaagcccucaaguacucuggggauggauccuucccccuucaaaagauuccuucuuuuguucuacaccuccuggguguaggggccuggacacccucccccaacguuccaccugccgcugcccuuccucuuccuccuccugagggugggacccucagaccuggccaagauccucucccuccauguugucagggacuccuccucacccccaaauacagcccucuagccccuguccauuuuauuccacuccuuuccuguaaccuagacagcauguuaugcaacccuuugcgacacauggggaaaccuucccucccuuucucuguugucaccaauggccccuuaagaggagcagggccaccuugaaacuuggaggauaugggguaacccagugggagcgggcagggagggcccuuggaaacugacagggcuggaguauccugcuggguuucagccccgguuccugcaggcacagcugccaggcucucuguucaccuuccugccucugguuugccccggcucccucaccccccuuacccuggaguccuuccuucuaggugggagaugccaucccagcaguggagguguuugaaggggagccagggaacaaggugaaccuggcagagcuguucaagggcaagaagggugugcuguuuggaguuccuggggccuucaccccuggauguuccaaggugaggcccuuccccuucugaagaucaggaccugggaucuuuuguguugcucuuaaguccuccacauaguccugauaggacuccuaaaaagcauuucagugccaucacaaaacaaguagagcuggguagagcugggcgcgguggcucacgccuguaaucccagcacuuugggaggccaaggcggguggaucacgaggucaggaguucaaaaccagucuggccaagauggugaaacccugucucuacuaaaaaugcaaaaaaaucagccggacaugguggcgggcgccuguaaucccagguacuggggaggcugaggcagagaauugcuugaacccaggaggcguagguugcagugaguggagaucgugccucugcaguccagccugggugaaagagcgagacuccgucucaaaaugaaaaaaaaaaaaaagaaaacaaguagagacugcaaaaagggaacaguaccaggaauguuggagaaaaacauacuacaauuaaauccaacaccccuguugguccugcuaaaugacaggcacuguggaaggugcuugggacucagauaaauaagacauagaucugcccauggaaaguucacgucuggaccauaaggcauuagguuucauucugagcuuccuaguggccaaggcaaaaaggaaauagaaugguuuagacagcucucauugucugaucaaagguguugaggcagagcacugaggagggccuggagauaaagggugggcugggggucagaugcaguuaucccuuugccgacccuuuguuccccuuccucagacacaccugccaggguuuguggagcaggcugaggcucugaaggccaagggaguccaggugguggccugucugaguguuaaugaugccuuugugacuggcgaguggggccgagcccacaaggcggaaggcaaggugaggugaggggccugcagggagucaggaccagguaggauauucuucuugugaccuuuacuuucucugcagguucggcuccuggcugaucccacuggggccuuugggaaggugaguguuccccugaccgccacagggacauggcagugcggggagcagugggggcccuuagccucuucaaggauuucugacacuuuucucugucucuucuuaggagacagacuuauuacuagaugauucgcugguguccaucuuugggaaucgacgucucaagagguaaaaguggagaguccucuguggagagaguccucugugggagagaguccucugugggagagaguccucuguggagaggguccucugugggaagagucgucugugggggagaguccucugugugggagagucgucuguggggagaguccuguguggggagaguccucuguggagagaguccucugugggggagaguccugugugggggagaguccucuguggggagaguccucuguguggagagaguccugugugggagagaguccuguguggggagagucuucuguaggggagaguccucuggggagagaguccugugugggggagaguucucuguggggagaguccucuguguggagagaguccugugugguggugaguccucugugggggagaguccucuguggggggaguccucucuggaguucucuugggccccuggcuguucacugccugucuccaugcccagccuccaagcccaggcugaugcagcuggcugggccccucuuuccggcagguucuccauggugguacaggauggcauagugaaggcccugaauguggaaccagauggcacaggccucaccugcagccuggcacccaauaucaucucacagcucugaggcccugggccagauuacuuccuccaccccucccuaucucaccugcccagcccugugcuggggcccugcaauuggaauguuggccagauuucugcaauaaacacuugugguuugcggccaucuccuugguuaug

SEQ ID NO: 18708 - RNA, 1458 nt, Homo sapiens
cggaaggcgggccugggccgccuccacugcgcaggcgcgagcggccacccgcagaacagagcuuccgggacccacgccucguuugcacugggugcuggacagccgacgcaacuacaaauggggcggagcuuucggcacuggagcagcuaauuugcauauaggaaugaggugcggcucggcuuccaugggccuaauuuacagauagggcgguauuucugccccuuaaccgaaagugggauacagaggacgacgguguuaggcgccuguguaggaguaaaauguguuuauuuugcauucaacgagagcuccugcauugcagcuauuuugcauaugauuugcaucuuacgaagaauuuguggcaaaaaaaagcugggcgugcgccguaggaaccuccugcugagacgcuuccgguagcggcgcgugacccgacaggucuuucaccuaccuaccucagcucccacaaacacgagaaguuccagcaaguucgccacuuccgguucuccuggcuauccaauagcaucgagaggagcauccccggaagugaggcagcggaggacgaccuuuuuccgguuccggccuggcgagaguuugugcggcgacaugaaacugcuuacccacaaucugcugagcucgcaugugcgggggguggggucccguggcuucccccugcgccuccagguacccgccggcggcagucuucccuuuucgggcgggauggugggccgggguccagugcuugccuaaacuccuccgcccugcaggccaccgagguccguaucugcccuguggaauucaaccccaacuucguggcgcguaugauaccuaaaguggaguggucggcguuccuggaggcggccgauaacgugaggauccuuaccccgccccagcauaucccggggaaugcggggcgggcacaccucagccgggcugaggcgggaguucgggaugcccggagauaauuuuggccucuugcccacaguugcgucugauccaggugccgaaagggccgguugagggauaugaggagaaugaggaguuucugaggaccaugcaccaccugcugcuggaggugagaagcggcccaucacuugcuucccgggccaccugccucccgcacugaggcugccagugcucagcucugucccucccugcccgcagguggaagugauagagggcacccugcagugcccggaaucuggacguauguuccccaucagccgcgggauccccaacaugcugcugagugaagaggaaacugagaguugauugugccaggcgccaguuuuucuuguuaugacuguguauuuuuguugaucuauacccuguuuccgaauucugccguguguauccccaacccuugacccaaugacaccaaacacaguguuuuugagcucgguauuauauauuuuuuucucauuaaagguuuaaaaccaaaagcgguuucucuuugcagcaaau

SEQ ID NO: 18709 - RNA, 871 nt, Homo sapiens
cccccuacccccuucccccaaagcgacaccaacugagcacucgaaccguagacccaguagccccacagagcugcggaacucggggugggugaagccgacuuaaaacaugcaauaaguccuggauugcgagucccggaagguagggccgauagggcccggacggagaaagcucaaggucacugcggugaccgaaugaaggucacugcggugaccgaaugaaggucacggggaagggcggggccacgugcguccgccucacgcgggcuguccugcacugacucacggaccaugcaucgacucuuuuauuucuuuaggacucaaauuccacucggauggggucaggcuugggucuggggaccgggcuggcacggggcugguucgggucgcugcucgagcccaagguggcguuuuuaauucacguacagccucuugcuccggcgcuucuugagcccuucgauguaucgcugcagcuccuuagucaggaaguggucccugccgaucccuaacugguagccuaggaggagggcagagcucggcucagggcagugagcaaccgaaaggucuccccaccagggggcgccgcaugugugauucgaggaaccgcagaugauucgagguagcaguagcgcagggcacucaggucuguguuagccuggggaacuuugcaucucuaagggugcugaguguuaagguggaggauggaugaggucaaggcuagggaagagguugcaggccugaacuagggcggugguagcgagcaguuugcccaccuucuggaccagccacccacucuaagccaucagcuggcccuuuaucaccgcugggcuuuccuaccacagcagcaaaaguucacccacauaauccacugucc

SEQ ID NO: 18710 - RNA, 4712 nt, Homo sapiens
cccccgccggauccaaggcuccucguccgcauccuuuuuccucccuccuucggccccggggcucacauccucgcugccucacaccuugggcgugugugggagcaggagagggauucucugggguccccauuuggaaccuggagacccacuucugccaacaaguccuucagccccucugggccuuaguuuccccccagugaaguggggauagugacagcucccccgggagccagugaaaacuuugugaagggagugauuacugcgggcgaaggcgcuuggcacagccacaacugaagcucagccgucggaugugauuauuguugcuauuguuaccgcuccgccuggacugggugcccggucggaaagucccgcuccccgcuccuccucccaggcgcggaagcuucgcgccgcccgccucgggggacaccucccgcgccaucucgggggcacuggagauaaggaaaggaaccuccucccuggcugggauggcugcccgggcgcgggaggagggccggggacccggugagggaggaccguagggcccgugggggcuucacgccuggcaggcggccggccaggugagcagggccgcgggcgcgccggggcgaggggcgggcccgcgcgggggauucggggcuccgcggguucaggcccgggggcggggcccgggggccaucuuggcuaugggcggaaguuuucuucagagaccgagggacgggaauccguugccgcccccggccgggcggcacgaccccgauuuggguauaggagagaggagcgugggaacuggcggacccccauacaaguaaaggcgggcggcacggggcacggcccacccggggacccccuggaugcggcacggcccccgcaacucggccgcccuccugccgccucccguaaccccgggcgcccgccagcggcgcagcucgcgccaauucucguacgguuucacgccgggugcggcgcuggacugcggagccagccgggccgcugcgcaauuugcguagcgaacggcgcccgcgcaggcgcggagggggaggggggcggagcagcgggagccggggagccggagccccggguccccacgaccugagccggcucucccaucagcggccugaggaccuggcguccgccuccucccuccccuugaggcuggagcguggacgcggugggggaggguggggcgggggcagcuuucgagaauuacgaggacaggaggcagaggcccuccccauccgcauuauuggaggagagagagccucccccagcuuggggagggggagagcggggcauugggcgccccucgcagcggccgcugcccugacccgacggguaucagccggcucucccccuccacccaggacgacaugaacgaccgaggccagggaguccucuccuugggccucugcauccccccauccuuggcucugggguaggcccagggaggagacacccccaaccccuauccggucuguccuggagaaaagagacugcccuuccaugccccugagugaggggccuggggcccaggcugccuguguuccccaagggcaagggucucucuguugaggaggaggggccugucagccacaacuucuuuccuccugagcgccccaucucccucucugcacccugcaauucccaccccuccguauuuauuucccuggucccgccgacagucccuccuugucugucuccgggauucaggccucccucccugacauggagaguaaccugucuggccuggugccugcugccgggcuggugccugcgcugccaccugcugugacccuggggcugacagcugccuacaccacccuguaugcccugcucuucuucuccgucuaugcccagcucuggcuggugcuucuguaugggcacaagcgucucagcuaucagacgguguuccuggcccucugucugcucugggccgccuugcguaccacccucuucuccuucuacuuccgagauacuccccgcgccaaccgccuggggcccuugcccuucuggcuucucuacugcugccccgucugccugcaguucuucaccuugacgcuuaugaaccucuacuuugcccagguaaccaacuguggucccggguggggggcgggagguggcaagccucaaggacccacaggagugaagggcaucucugcuccuaggugguguucaaggccaaggugaagcgucggccggagaugagccgaggcuuguaaguacucgggacacuggugggcucagccuccaggucaggggcaggugacagucccauguagaucccuucccaccucucagggcugagacaaaggcaacccagggaaugucuguggaagaucuuggaaaaguuaaagcaccuggcgcagauggcucagcagaggccuugcagaucugcaaggcacaggaauaggaaugcuugugguagugugagggagagggccccagugucauccaccauggagggcgagcuggaggcuccagcccauggaagcaccaaagccauaugcacuccugggugaccuggggccgcaaugcccucgucauuuguacagugucuuacgguuuauaaagagcuuucccagccaucuuuuauuuguacaauuucccugagaggcuacuauccucccuugagagaugaagaaacugaggcccagccagguaagacagcaggaucaaggucgcagagcuggggcucagacagagacuucugacuccaguuggugcaccuuccgaaguaccauggcugucagucaccuucugaccuuuuugggccucaguuucuccaucuguaagaguggaggaacagggcucagacuggaugcccugaguuuugucgacauugggguuuccugcaggagguggggcagguggugagugcugagggcuguugagggcccgcgcugacugugcuguggcugcaggcucgcuguccgaggggccuuugugggggccucgcugcucuuucugcuggugaacgugcugugugcugugcucucccaucggcgccgggcacagcccugggcccugcugcuuguccgcguccuggugagcgacucccuguucgucaucugcgcgcugucucuugcugccugccucugccucgucgccaggcgggcgcccuccacuagcaucuaccuggaggccaagguagggcugcagcacugaugcccaggugucuuuugggucucucggcagcgguucucaggguguagaggaagcugggagccuucucucccugaggguccucuguuguuaccugugccaggggaccagugugugccaggcggccgcgauggguggcgccaugguccugcucuaugccagccgggccugcuacaaccugacagcacuggccuuggccccccagagccggcuggacaccuucgauuacgacugguacaaugugucugaccaggugggcauacgcaugucugccaccuccuuaguagccguggcaccuuggccccagcuggccugggcccugucccacuaccccuuuggcgugacugcagacuggcaccagccccugccuucccacaggcggaccuggugaaugaccuggggaacaaaggcuaccugguauuuggccucauccucuucgugugggagcuacugcccaccacccugcuggugggcuucuuccgggugcaccggcccccacaggaccugguaagggucugcucccucuucuguggggccaguggagggggcggauguugcaaauccuggguuggagucugggguugggccugggaggccagugcaggacaggaguaaguaucgaugauggcuuccucccccagagcaccagccacauccucaaugggcaggucuuugccucucgguccuacuucuuugaccgggcugggcacugugaagaugagggcugcuccugggagcacagccggggugagagcaccagguaggagccguggcacugccucaguaccccugcccuacccgcccaccccgcuggcuccaucaagcuaugggggaccgagauagccgggucuugccuuccaccccugccauggccuuugcuuccccaucuguacuaggugagguccccuggguuccuauugcuaaagccuccaccucuugccuagagauguacuuuguccugggccccgaaggucuaggucacagggguucuguucuaagccugucuuccuccugcagcucuugugacuguggcccuggucacuguccugagacugacccuguuucucugcugcaguaugucgggcagucuaggcucugggagcugguauggugccaucgggcgugagccgggcugguaugggggcagccagacgaagaccacuccucugcucuucucccaggugccaggaccaggcggccaccaccacagucucuacuccaccccacagacgugaucccccucccucccccacagaauacccaggccccagucccccucacccuaggccccugugccaaguuugucugccgcuucuugcccaggauccugggggucguggcuacccccuccucuggccggcuccuugcugcuccugucauagugagcuugugccgucccccuaggauggggggcauggcccuggcugccagaugcccacagcacccuggcaugaccugccaccucugcuuccacaccggagccagcuaccucuccugugccugccacucaauaaacagugucugcgccccacaguugugcaccugucugucau

SEQ ID NO: 18711 - RNA, 2256 nt, Homo sapiens
uaugcccuuauuuugugcuaggcacagggccucacccauuauuggcacucgguaaggauucgugggauuaaugagaaguuaaccuaaaucuucaccaaaggccccugagcuuccccucgauucacauacaagggacuggggcucugagaggugggcugugaugcgccccuggaagacccacgagugggccugcagagcugauggggaggguucaggcagggccaggggcuuagaggagcugagauuaacgucgccccccuacccacugacccucugcaggcgcuggggcuguggagauccggagucgccacagcuccuaccccgcggggacggaggacgacgaagggaugggggaggagcccagccccuuucggggccgcucgcgcucggcgccccccaaccucugggcagcacagcgcuauggccgcgagcuccggaggaugagugacgaguuuguggacuccuuuaaggugagcgccaguccccagcgugccaggaccugaaguaccaggccgccccccgccggucugucccugccuugucccaaggcacgcccggaucuggagucccacgaccccuccccaaagccguccuguuccuuccuagcuccagagcauucugggauuuguagucacaagacuuccccgcccccacuccccagcucuucccccgccuggugugugugugugugugugugugugagucacagggcaugcugggaucuguagucuagaucccacuccaggcgugugugugugugugugugugugugugugugugugugugagagucacagggcaugcugggaucuguagucuagaucccacuccaggcgugugugugugugugugugugugugugugugugugugugugagucacagggcaugcugggaucuguagucuagaucccacuccaggugugugugugugugugugugugugugagagagucacagggcaugcugggaucuguagucuagaucccacuccaggugugugugugugugugugugugugugucagucacagggcaugcugggaucuguagucuagaucccacuccaggcgugugugugugugugugugugugugugugugugugugucacagggcaugcugggaucuguagucuagaucccacuccaggcgugugugugugugugugugugugugugugugucucacagggcaugcugggaucuguagucuagaucccacuccaggccaaagcuccuggguuccccgaauucuuggaagaccaggcaugcugguauuugugcuccuugcuggcaccugugcgcucugucgcccaggcuggagugcaguggugcgaucacggcucacugcagccuggaacuccuggccucaaaggauccucccgcuucaaccucccaaagugcugggauuacaggcgcucaccaucgcucccggcccuuugauucucgaauugcggucucaucuucugggugcuaggucuccagcucuggccuuuccauuuagggcccuaggcauccucucuucccgucuccggcacggaguuccugggaucuaaccaguucccauuccugggggcccaugcguccucgcgagcgucccugaccgcccggcguggagccuccugggaguuguggccuucauuaucucccccccgaucucacuuagaggaaggcucacggaaguggagagccuggcucgagcugccaugguaaucuaacucauguaacccuuuucucccuccaccagaagggacuuccucgcccgaagagcgcgggcacagcaacgcagaugcggcaaagcuccagcuggacgcgagucuuccaguccuggugggaucggaacuugggcaggggaagcuccgcccccucccagugaccuucgcuccacaucccgaaacuccacccguucccacugcccugggcagccaucuugaauaugggcggaaguacuucccucaggccuaugcaaaaagaggauccgugcugucuccuuuggagggagggcugacccagauucccuuccggugcgugugaagccacggaaggcuuggucccaucggaaguuuuggguuuuccgcccacagccgccggaaguggcuccguggccccgcccucaggcuccgggcuuucccccaggcgccugcgcuaagucgcgagccagguuuaaccguugcgucaccgggacccgagcccccgcgaugcccugggggccgugcucacuaccaaauguuaauaaagcccgcgucugugccgccgag

SEQ ID NO: 18712 - RNA, 21833 nt, Homo sapiens
aggcuucaugcggggacccggacagagcgggggcuccguuccagaaagauuuauuggcgcccccuauaacccgggccgguucuuggugccgggcacagagaugcauugcgccacggcccugcucgcggaagcucccgagggcccggaaucggcagggcagucagagagggcuucagggaggaggcagcuagagcugcgaccggaaggugaggugagggucaucccccccggcgcaaggaggaguggacccauggaaggacaggggagcagcagaggccaggcuucuaggggcuggaaugucacacccagaaguuagacauucagcugguauuugaggaccugggaacugacuuggagugugucccucaguggacaccagcuagagucaggaaggugggaguuggcugcugaggagccuagauacggaauacacuggagugagcagaacugggggauagggcagcgucccacagaagaagugaggaagucuggggccauugcauugacccugagggaggagggcccuacuccggagccuguuucccuggccuccccaccccaucuguuugccugaggcugcagcaaaaacaaagcaaagaagauacucaauuggcaggagauaagcccagauaagaggccgccuuccccuggaggagggaugcaggcgggcagccugggaagagccaggaagcugggagaggccuugaagaggugccaagccgacccugcugcgagcccagccccgcccuggagcccgcacugugggcucucugccacuuuucgcuggucuugaggcaugggacagguccaggcuggcugaagacaguccaccacggaggguccaggccugcccugccuccaggucaggacgucuugacuuagcuguggccuagcacacgacagauggcuccgggccucagucuccucaucuguaaaacaggcauaacaucucccucacagggaugaggggaugcuggguggcccagccccugcgugucugugacuguccacuucccuucccccagagucacaggcaggccuacugcccaccuauuucugaagacccaggucccccgguguugggcagguucugagcugcccugcuccacccuggccgauccaucaccugauagagucaacugccugucgggggcccagagcagccccagcggaagauacuaggcguuugggucauaucaggccacaggaagcggggcagggaaggcuuccugaagcagaggccugagccucagaaaagagagaacagggagagccucggagagacgaaagucauggggaugggggaacaggaacagcggcuugggggcagagggcacaagcagaaggccacggaagcucagcagacucggcagggcaagcucagguucaacccagcagcccuuggcuggaggcgugaccucaaccccaccaaaugcccaaaguccauuuuauagaugaggaaacuuagggcccagaguccugucaccccaaaucacacugcacacagggucccugaaauccacuuuuauucauguaaaaaaaauccccaaagaauagagaaaaaaaugugacuccuacuucccggagcuccaagucuccagccagcucucccggggaagggaggagacgcugcuagcucgagggugugggugucacagggagcaaagcccugaccaaggcccuaaccuaagacugagggcaggaaggaggggccccaggaggaugaagggaguuagcugagguacuugccccggguuuaaaaaaauaaaauuucuagauaaaaaguuaaaaaaaaaaaaaaaaagcauuagugucauugccuccugcccuccacccagcgcccgcccuggcccuguggccaccucgcucagccaguucagagcugcguguucuccuccuggcucuccgagucagcgcccgacaggugcccgcugcucccgggugcgugaccguugcuggcacaggccaccagaggcccgucccccagccccuccggcaucucgcccagcaggcuccggcggaucuccugggggagccucgcccgcugcuccugacacuccugggccagcugggccagcagcugugggagaaggaugggcaucacaggcgaggccuggcugccuugcaccccgucugcccaccuguucgcccauggccucaccuugggcuccucuucugccagcuguugcaggaccugcugcugcccagccacaagacggucaugccgcugcuucugggccuccuccagcuacaggggugggcaagggcucagcugaggggcccugagggaggggcuagagccucgaggcucuggcuggguauagaagucaggugggcgaggccgggugcaguggcucacaucuauaaucccagcacuuugggaggccaaggcgggcggaucaccugaggucaggaguucgagaacagccuggccaacauggugaaaccccaucucuacuaaaaauaaaaaaauuagccaggcaugguggcggaugccuguaaucccagcuacucgggaggcugaggcaagagaauugcuugaacccaagagguugcagugagccaagaucgcgccacugcacuccagccugggcgacagagugagacucugucucaaagaaaaagaagucaggugggcgaaggcucccagggcaauguaucaggguugugagaggacugggcccaaggacgccaaagccagggacacugguacagacaguuggcuuuggguaugauguggguacccuggggcuguugggcacuugagaaaggcccuagaagaaccuugagggcaacguggcaccaggccaggcauggagaugggugucugaugagugaaggaagggaggugggguaggguggcccgggagccugacucacccgacggauggaguugacugacucagugaugugccgacgguuaaucuccgucaguucccugcacgggagcaacgcaggauggcucggggcccagacaccugcccugccuccccaguacccagauggcccccggucccggugcccuuacgccuccuucuuaugcuugucccucaucuuggccuccgagaugcuguuauggcgcuuucuguccaggaucuucugcagcuccuucuucucccuggagaagccggcaggggaagaggaggggucagcggcagaagcacagacucugcccuccuucugguacuagaaguccccagcccuucccauagacaauccucggcuuucaccucucguucaucucuuucagccucuugaacugaguuguguuugcaucaaggacgaccucccugagccgcugcagagccuguggacacagggagcugacaggugaugccgggcugacgacgggucuauccagcaggcuuucccuggccacugcaggcccccuaccugucucagguguuccagccuccgcugggccucugcguccaccugggccucccgcagcuccagcaggcucugcaccugucuguucuggaacuccugauaccgcuuugccucguccucccccuccuucguguccuccacaucagcggccccaccucugcgaggagaaccccucugggugaugccugggcccgucacauggacugggauggggaggguguguaggggggcacauccuggcaagcgauggcagacaccaucccauggggccaggucuguuaugcaaaccaggaggccuguuagcuccacccaagugaugggagccuguuugggcaacaugcuccucauggacuucaaaagagaugucacucccugggggacacagggacgccugguguggaaagccuccuccauccuugcacugaacccuccucccugggggucaaggagcagcucuugccaucucuccaugcccaccgacccccauguucacaucagcacacccagcacacauagcacacaggcggcccagacacucacagggcaccuggccgcagccggcaccugcccucagccugugccugagccaggccauccagcaggcggcgggugagggugacugccuuccgcugaugcuucuugcgcagcucccgcaggucucgcucuugccggcuccggagcuugaccagagccuugugaccucggagcucauccagcggggugggggccaccucugggagcggcagagcaaaggugggcggggggugggggaaccugcaaggcagcccccugccuccagguaccccgcccccuaccugagaggaugcuggcgaugagaucaucacgcugcccuggggagcagaggcccugugaggagcuggaggacaggguggggggugccucccugcagcccacccccgacccaggccacuccuuaccugggcugcugagggaggugcuggcaggggaggugguggggccagggggccggcggggggaggcauccagugggcugggggugggguuugaggacggcugagaccccagcugcugagacuggguguccuggcacgucucuuggccagccugagccuauagggagaaaggagaaugcucuuuucagaaaugcuguucccuccagacccuucuguccucuaccaccuccuggguccccuagcaccccugucagccucccuuaguccaagccacugcuggacugcucuguaacaggaggcugucugcaugagaagagcuauaaaucaagccuuucuaaaccccuuuuccacaugggcuguggggaagauaacauaaugccagcccacugcaugugcucaguaacucccagauuguucuggaaaggccuggcccagccccaagccuccucuccuccccugccugugucccccagccuugccuacagucgcucauuuuccuugcugcugagcuccugauuaaaucaacagaggacucaaccgcagagugggcaccagccucuccgcuaacagcuccaggcagcccuaauugcagucaucucuccccgcccgccugccgcaggcccuggggggacuggaucuggaagcgcaggugaaccuccgugccugaccccuccccacggaagccacugcccuccucaugacucccaggacaccacgucugaacagcuucuguggcuucgcacugcccugaugaaguggcugagaccccuguacccccacuccaagccuacauggagcuggaggaauuccagcccaggugugaccugaaggccuccugaaugcaaaugggugguuuucaucuccucaaaaucccagggcugccaagccuacugcgcuagagagaccagaagcccccuccucauguggccacagcagucauguccagcggcccccugggucacagugagccugagcccugcccugccccggcucaccucacucuccccaaugagggcggccagcugccgggcccucugguccaucaggcugacgugcuuaaugggguugaucagggccuccgcauagucuggggggaggcagaaggccaaggucucagagacagagcccccaggccacccccacccgccaccucuggucucaaugaggaauuccagagcuuguccucagaucuguucccuacucaguucccuacucagucggggccauccagcucggccacucccaggcccuggggguggcccuugucccucacacucccuggccaggcaggccccgcccacccccagcucacccugguggucgucaggaauguaguccgaggcuucgguguagaugagcagggccggcaggcacagcgguugguuggccucguuccgcaggcagacguagugguauccuggguggucaggaaggcaacguuggguugcugggccaggugggggcccuacccacugcccgcugugcugcccagagcccaccaaggccucaccggagcggauggcagagacaggcaggauccggugcccuacgaauuuaccccccuccucaaaggcugcaaugcgaagugaagccagcgugggcagcaccaccugugggccagacuggagcugagccacagggcugacccugggccacuguggcuaccaggccacagcuaaccacagccaucaaagcuuaacaaagcagaccuucagacgagcugaccuacugaccaucagucaccauugccacuaagcugauggcugaccccacuuccauguccuggccuaauggaugacugcagccaucaggacccugaggcaagaugacaggcagccaggccccuccagggcccccacagacaguucuggucauugccaguuuagaaacgggagugagucaugagcaggaaaccaagaacacacaugcccaggcugggagcagaggccgcguccaugcagggccgugcggggugcugaagagcggauaugagcuugggguugugaccucagcuccugccucggagacaggguaggcuguguccacuccucgcaggggacacaagacgucuagcugacaccccccaacccccaucucaccuucucacccuggucucuuacccuaaggagggcagggagacugacgcucggacaggcagguccugggggacccauggcaccccccacuuucugauccccagucgccaacggugugccugguuccuguucucccaccugagagucggggcggucugggcuggaucugccugugccugggcgggugcaggggccaggcucaccuuggggaagucgaagggcucuucgucccacacgggguugaacgaguuccccugagagguccgggugcgguacuugcgccgcguaucaacagggaggccaaacauguccaccuccacguagaugcccaccuuccugucggacaggaacugcccugagaucaccugggggugggccaaggagggugaggcggaugcugagaguccugcccccaggacaccccuggccugagccgcccgcaagccccaccuugacccgcaaggcauuggccacgaugccauccacgaugaccucagugaaggggucgaaggacuuguccggccgccgcaugaacuccggcuugagcagguacccgcugcgcccguuguacucaaaaacgcccgcguugagcugcaucgccacaucuggggugccacgggcacgucgagcaggggcagggaucaggcaggacggugccauguggggaaugggagaucaucaggucagauggcauccaagguccagggucaggggcgggcucaaauggcaucaggguccggauccaggacagaucagacaggggaggggucugguaucagccaagggcaggaggcggggugagucgggagcuggguuccccugggaucugggaugagacagggucagagguccauucaggcaagaccagcaggaucgugggucagaagucaguaagacugagggucggggucaagauggagggggccagggcucaccgagggucuggaaguugagcgcaacaagcuggcacccuacguuccagaagagcuggggcauguaguuggaggaguccacgcgggugcccuugggguagaugcggcugagcugcugcuuguuguaucugagauugguggucaggggccacacaggugccagggcccaccccaucagccuccaccuccggccucagccaggugcuccugugacccccacacccggccucuguuucuuagccuagccaugcccccugagacugccuggaucugcccaagccccaggccagggugcaggagggccgccggagggccagcacccugugcagguggcauauguggggacagaacaccggagccggccuccgagcgccccacccuggccugcccgcccacagcaccuucaaaggauacuccacaaacuccauggggcucuuggucaguugcuccauggccuuggucuccacaaaggacgacaucucgaagcauuuguuccucucuuaggggugagccaagaaagggcgucagaccuggcagggcugagcugggcaagcucccaugccugccacccacccccacucacuucgagcagccucaaaggacuugaacuugacagguucgauguaguugacaagcguggacaucuccucaguggcauucaccucgcugcuggcugugcccugugggccccaacccagggucagcagugccauucccgccacagcuggccauucccucaccugccccccaugaaggaggugcugacccucuucccagcacuauauacacacugcugguggugccgacagucuucuccccggggucucacugaugcgcccuggacaccacccagcucaagcaauuuuccugccucagccucccaaguagcugggauuacaggcgcccgccaccuugcccggcuaauuuauguauuuuuaguagagaugggguuucaccauguuggccaggcuggucuggaaccucccaaccucaggugacucgcccaccucagccucccaaagugcugggauuacaggcaugagccaccucgccuggcccauauagguguuauaauuaucauuacuuuuacugaaucauuugggaguaaauuauagacaucaugacccuuuacccauaaauacuucagcauauauggacauucucuucuauaacuccaauacaauaauuaaauucaggaaacaaaacauuaacauauuaucuaauauguaguccaucuuuaaauuucacuaauugcuccaguaauugucuuuauagcaaugaugucuuuuuuuuuuuuuuuuuuuuuugagauagugucucccuuuuuagcccacguuggagugcaauggugcaaucucagcucacugcaaccuccaccucccagguucaagggauucucaugccucagccucccgaguagcugggaucacaggugugagccaccacgcccagcucagacugauuuuuucuguaccauuccucacagcuacucaaugcuccccaugacaaugcuccccgcuccugcacccccuggcccugccccaggaccuuuguacaugcugucccccuuccugaggucucccugccccaccucccugcccaggguagacucccuauccucugccaguucuguacccuaacucgcaccucccaggccacaucaccagcagaacuguaugcuuguuuccaugccugaugacugaagagcccuccucccaccuucacucacacccacacugagccccaggaggcaggggugaugucagucuuguugauggucagacccagcccccugggagguaaauagaugcuaccuccccgaccugcccacccugugggccugaccucaucuguaguuggcuuuuuggggucugucuguuccuccucuuccucaucuuccuccucauccucacggucagcagguccaagaacauaggggccucgguucaggcccucgucacccagagacuucugaggcuccaggcugggcuucucaagcccuaccuccuccccauugcucaggccugggcagcugucagagcugggagacccugcagaggacagggccacagggugaggggucaggaccacacagcugcuuaggaagucuggagggguuuuucccagugugugccgaggugacucaguggggaauucaagggguacucucagggcaguguggcuuggggagaggccaagaggucgaggucagaugguauuaacccaguauggguugagaggggucauaggucaaagguaaaggucugcagugauauucagcagggaggcagauagggugguucaguggggugagaagucaggaaguagcauaccacagcccuaauagcgggguaagggaugacauagagagguuacaggucagggguaagucagagccaugucuaaggagggggcauagugaggugaacagucaggggugagaggucagaggucagcugaaaugauaaccaacugggcaggugaacucaaugcgggcuuaggggucugaggucacacccagugugggaugugguuuacugaggucagaggucagccuucagagccaucaccggguugugggaaggcucugagaggugagaggcugagguugggagucaggaguuggggugcagcugggugagacgugcaccugaggucaggggucagaggccccacaccagccgacagguggugaggagacaggccgguugugggaacaggcgcacagcgaggcaggagggugggcugggggucugggaugaagugucacggcgccuggagcaugaggccagaggcuagggucaagucaggguggcgggccgggcuggggccuacccagcugcggggaggagggcucgguggccgcggagcucucgcucagggcagaauugcucugcuccaggggccgcuugcgcccggcgcugucugggccaccugcgcugggucggugccgcuucuuguucuucaccaggauacggcccaucagguccugggggcugggcaggggaacgccuggggccagcugggcaggcauggacgagucagggcccuggaccggguccgcagcacccuggcccccaugccaccccccucgcuccgagcucccguaccggguacuuguccagaggcucgaugaguagcgcgucuccaaagauggagcggcaguacucagccaucuuugccuguugcuuugcccugcggaaccgaggucagaggucagagaucccucccccagagaggaagcugaggucuacgggacaugucaguggccguucgcaggguuggaggucccugagcaguccaacagcacugaagcuggaagacugucccccgguccaugggguuucaugccaggggcucacucacgaguccacaugguucucgaaggagaggaugacgggguagggcgaggucuugaaggcagucucggcaauggccuccagcacgucgcgcagaggcaccucuguggucauggugaagccguggguaaugaaggguuccuccucaggcggccgucccuuccacacguccagcuccacgcagcggcagccccauaguagugccuggcgguacaucuccaccgacgaggucccagccagcugccccgcuggggcggcgaggcucugucaccgaggccgcccaccagcccagcuccucaccaccccggccccaccuggaaccaggacaugcuggauuugcagagggcucuccaucucucagauggauacccaccaccuguccaucccaccagcgugagcuggggggagucaucccugagacucacuauagcuccccacugccucaacaaucccucccucuccucacucccuccacccaccucagcccuggcacagcucacaccaccuccuguguggaagacuccagcccucccugccuccaauccaaucucuuuuuuuuuuuuuuuugagacggaaccucgcucugucacccaggcuggagugcaguggcacaaccucgguucacugcaaccuccgccucccugguucaagcgauucuccugccucagccucccgaguagcugggauuacaguugcccaccaccaugccuggcuaauuuuuguauuuuuaguagagaugggguuucaccauguuggccaggcuggucucgaacuccugaccucaggugauccacacgccucagccuuucaaaguucugggauuacaggugugaaccacugugccuggccucaauccaaucucuauagagcaccuggcaucauccuucuaaaaacauaucauaucaggucacaucaccucuucugcuucacccuccaaaaagccucuuccucacacccaggaugaauccaagugccucuaggccccugggcuuagcccugccuugcucucccucucuuagcaggcaccuaucuccagcacucugcacccugccgcaccagcuuccuuucugcuuuuuuauuauuuauuuaauuuuuuuuuuuagaaaagggucucucacucugucacccaggcuggagugcaguggugcaaucacagcuuacuccugccucaaccuucccagaaccaagcgauacucccaccucacccucccaagcagcuaggaccacaggcaugcgccacuaugcccagcuaauuuuuuaaaaauuauuuguagagauggggucaugcuauguugcccagacuggucucaaaacgugggcucaaguaaucugccugcuucagccucccaaaguucugggauuacaggcaugagucaccgcacccaacccccuuccagccucuuaaaagcacccugcaggcugggcgagguggcucaugccuauaaucccagcacuuugggagggcgaggcaggcggaucaccugagguugagaguuugagaccagccugaccaacauggagaaaccccaucucuacuaaaaauacaaaauuagccgggcgugguggcgaaugccuguaaucccagcuacuugggaggcugaggcaggagaaucgcuugaaccugggaggcagagguugcgcugagccuagaucgugccauugcacuccagccugggcaacaagagcgaaacucugucucaaaaaaaaaaaaaaaaaaaaaaaaggacccugaagucucuccugcugcaggcccuaacacaagcuguuccagcccuucccugggaaagccaccaugaggccccacugcucagggcuggcugccuguucccugccugcauccccagcacuggccaaugaaugagcaaaugggccaaaaggacugugccccaggaggaguggggcugugcaagggucacagggcagaggucacgggugccacccuugcuccccacucaccagugagauagguguuaugcgaggaguugaugaaguaggcacucaguggcugggucauguccgugcucagauccagggcuuccaggggcaggaugccauucuccucgccucccagguagcggcuaaagcccuccauggacaucuggucuggggugggagaggaucagcagggucagcuggggucccaccugcccccacccaccugcaccccagccagcucaccucgcuccagaaacugcugguugggcucauacuuuucgaugagcagccgggccugggagggccgcaggggcggguacagcacuucguugagucucgggucgcguugcuucugguugaugaaguccaugagcugcuccagcgucagguauggcuugcccuuggcgccucuggaggggacaggaagcugggucaggauggagccuggcagggcucccaccccgucgccaagcccuugcccugggcaagggagucagaaggccugccccuggaucuggcacccagugagugggacucugggugagucauggccaaccucugggccucaguuucccccuuuacucuccugacuacucaggauugucaaggcagcagacuagugggcaccagcaauggccagggcuuaggagcugccaaguggucagcccaccaccccucgcuuccagaccucacaacacaccugaggcuuggaccccauugcagagugggcugauuaaaccaacccuggcacaggguuagcccagagcugccuguaacugaggggcagaaacggcgggucugaguacaggaacaucaccgacagguucucccugggcaccccuccgcccccuggcgcuccaggacccggcccaccaguuuccccucuccccauugagcuagaggcacgcuaagcagaagcuaaacacagagcacagggguugugaggcaggccgggcccacucacaucuccagcaggaucuugucaauguccggccgcagacacagcuuguucaggaaccgcucaaagauuuccaaggaaaacucaucaggccggauggacucacucuggaggucgaggaguguggggugagaagccaggggcgggcagccccguaagggugggugcccaccgugacaccccaccccgccccuguccccaccccacacacccgguugaauuugaggccacaggauuccagcgcagucuccacccgcuucuugucugcugagaacaucuucaggaugcugaugcgggcaggagggguucagggucaguggaggacaaaggucaccaaggucagggcaggaggaaggugcugggggaaggggugcucacuucuugacggggauccgaccauccugguucaccugcagcuucagcuucguguaucugggaaggcagaugaagaggucacacccugaaaacggccacgugaaccccccggcucccccucggguggccuggggcucacgcuuugcgcaggaagguguuccgggaggcguucugagccaggauguucauagccagcuugaauagcuccucagaccagaccuggggggccaguauacacggggaggcggugagugggggacacaggggcugcccagccacaacccagguccacaacugccucugguacacaguaggucacagagcagccuagaacacagcagguguucgguaagugacggccgacucacagaauaagacagugacucccccuucguccccuuggugccagcccaccuuggcugugucauccugcacggccaugaaguucaagaacacuguguucacugggucuggcccagacaccaccgucaucagcuucuccuccagccgggcaucgggacccccaaagcccagaacuucccggaucuugggguccugaguaggugacagcgaagggugaagagggggcucccgcacagccucgcuguggucuucacucccaggcucaucacucaccuugggcaggcgggcguaccggccuguccgugugucccugauggaacugauguccaguguguccaccuccuggggggaaccagaugccaggcugaguaugagaggcugcagggcaauagccaggagcuuccaagcucucuacccaggccagggaauggccagccccuggcuauagccccagccucagcuccugcccugagcacuuccugucugggcagcagugggagaggucagccugcagccgggccccacccccacgggcagggcaggggucugggacagggguccuuggccugagcgagcugcaccagcgcccacccucaccauguuggggcccguccaguacaagaagaagccauugggguccacacgcagggucaccagguuccgacuggaggucuccugaggacagcacagggcagcaggggucaggaagugagggcuguggugcaggccuggccccuggggcccucccaucaugcaccccagaguuccugcccaugagcuaagacgaaaccucauccaguccacagguccuguguggcugccuguggcccucagaacaaagccaagguccuaggugugacauuuagugucacaccuaccucaaagccucuucccagccucaccucccucuggcccuaggauucuaccugaccuuucccagggcuuugucucauguucccuuugccaggacacccugcccuuccuucuccacccgugaaaucugacccacccccuggaagagguccccagcccccauccugggcucaguuuccccagaagugcugagagcucugugacaguggcagccccccaauccaccccacugcagaauguuuaaggcaugaaagugagaagucugacucccacugcccuucugcaucccuugggacaucacgauagcccuguggucugccucaaagcccauuauccaccuuaccacaucugccgggguccucacagccucaaagcucauccccaucucguagaagaacagucccccuagaaggggacuugcccuacucucaggacugggcagugagcucuuccucccucaaacagccgugcagcuggcagggggcagggaagugcaugccagccccauuuucuaagaagggcccggucccuggcacacuaccagggccacccugugugacucaggaccagcagccagaggggcuguccuccagggcuuagacucggccagggccagagugaacaaguggcuacagguagaacccuccuauuccagguucuuccagacagaaaaggaccccaccucauguugggugccacccccaaaaugcaucucagugucugguggacaauacuauuauuaucaauacaucucauauacgcacaccgccccuacugcgcaccagguacaguucuaugcaccuagcaucuucgagcacacaaaggccuccuaaccagccuaagaggcaugugcuguugucacucccauuuuacagaugaggacacugaguuacagggacacuucguagccugcccgagaucacuggagccaggaccugcuugcaggcagugugguugcagcguccugugaccugggaagcagggagcggagacuucugccaggcucccggcuccuggccucagccacaccccauuguggggccugggauaacucucugcuuuccagaccucaguuuccucuucuggagaauggggauugcaccagccccacccauggcaggcuuugcuuacaaaagaugggcguucaucugggaacagaaggcccccaaaauuuggggaugcaugggccuccccacuucagugugcugacacccagccccagcacuucuccggauucccaacccuacccugggccugaggcccccgaauggugugcagagcggggagucuauggguacugccccuaguguuucccucccaccucuccccaggggucuggaccucaaaggcagcccagguccccugcucuccugccccaagccuccgucagcaccccccaccccacccccagggcccucucccuguucccacuuccuuauuuggguuuaucacaguggaaugaaaagaagaaacuuuucccuucaggccagccuggggggaggggucucccccggccccuggggcccccaggcaccccaccucgcacaccugccgcuucaggccacgcccccaucuccuccccccagcucccacgccuaccccggggccccacccagccggaaaagagcccagagucuuccaggcccguggccugacugggaaggagcugcgaggaagcucaggccggccggguggaggcccuagggaaggaagggcccagggggcagaagaggaugcacccaggauggggaugggcagccgaagguggggacacaggcauuugggaagcaccaggggcaggacagggaaaggggggccaggauguauugggguucaaggucccaagccuaaggaguggggagcaaaguucccagggguggaggaacuuggggggcaaagucuccacuagggggugacugggugcucccaucugaacagggagcugggcugggauccagaagcagggcgaaggggugccaaccagaacagggggaaaaaugaugaauggacgaggacuguucaggcagggcaccggggagaguaggggcgcccuggcacacacccagaaugaggaugcccccagccagccuggaagucaggguccugcagccggggagucuagugcugggcaggggucugggcaccaggccaggaucggggaacgagaauuagucuggcagggagcggugggaagaacgaauggaaaacggggggacgggguuuauugggguucaaagucucugcgccaaggaguggaggcaaauuuuccagagcugagggacugggaguuggggggacaaagucuucauuacggagacgaucggggacuuaaguuuccggggcgccgccagacugggaugaggguggcgccacgggcaggcgaggcugggguggggguccccagcgucuggucgagcuugacugaaagagucccgggauuugggcggagcaggggcccgcgcgcuuaccucgucccauuugaugaacuuacucccgcgccgcagggucuccaccacggugggcggcuccaacugcagcgcguggacgccgggcugggcgcccgccauggcccggccaggggcgggucggggacccacggagcccugacggggaccgacggcgccgcugcucccaccgcgcggcccgcuccggccccgcggcgucagugcccgcccgcccgccagucugucccggaccgaccagagccucggcggggcccgggcggggcggggacggggcggggccucccgggccccgcccccucccaccgcgucggcucccccuggcggccggggcggcgacugcagccggagcggggauuggggcaggggcacgcggacgggucgggggcuuugcugcggggcucagcagaaccugauucuucaggccugugguggaaggagggcgcugggggccgaaguggcuguuggggagcagcuggagggacuggguguagagggcgcugcuuaaggcgguccgggaucagcccacugagguuuccgagcgacuagggcugcaguaccagcggagggcuagacuugggccggggggucgcugcacagcccugucgcccacccucuucugccgcacuuagcugaaugcaggaaaagcuucuuccgccccccucugcccuggcuucgccucacccacucuuaugccgcgcgguccccccucccugggagcacuuagccggcuaauggaccucccgccggcaggcaccccucccccgucccuagcccagggaggccgggcgccugccaccuccuuuaaggacccaagcauccuggucuucgagagugagcccuagaacagcccccuucuuguugcugcagacucccaugacuggaaccugacugugagccucuuggcugggaaccgcggggggaacgcuguugucugcccagaggggucagaagcuuuguggauguccccagacaggaggguugaggaggggcucugcagugccuggcccacagcaggugcccugaaaucugcguuccagagaugggagcggggaaggcgcaugggcaaugggaugggugggggcugcagccccucccgcagggcuuagcuggugggggggguuccugccugggggccccugugggagcccccccaauacagaggcaguaacagcagcagguuuaaaguagaacucauccagaggggccagccaagucaccuagaaacccagaaagagaugcagcuggcucugggggaggaggggucagcaaaggaggagcuccccugcaggccccuuugccccaggcucugagaccuccacaaggagcccugccuggcccuggccuuccuccacaccccgccaaguucuccaucaacucuaaccuggcggaucuccucgcucucagcccuggcccuguggggugugauuaugaucuccacuugaggcccagagaggggaagggacuugcccaaggucacacagcuucuuaggaggauuucaacccuccgacuuccugaggcccaggagccucuagaccucauugggaaaacagaaccaugcaagguggagcuuggccucugcccucacaggcuggaguucaaauccggcucuugcuagcagccucuugcuaguggcagaaccuagucucucuaggugccucagucaccuuguccagaaccuaaagguuguuguauacauaagcaaaugggugggagaugccaaauugacaugaguagcuggaagcuguggguauaccagggagggaggaaagggcauaggucagcucuggggcaguggaaccuccagcuugugccagggcuagcaaagccuggagccaaggccugagcuuaggggaucugagcugugggcccuaggccuugugcaagcguacuuuagagaagcauugggcagcagcuccuuguggaaaaaaacaggaugggcaccuguuuccugggcuuaagccucucuccucccccaacccugugucucuggaggccagggcagcccccauuacagggcuccuuccuucccagacacuuucuuccauccuugguaaugguaauaggguaucucagcaggcaguaauggugaaggcaggcagccuuuccggacucuacccuugauugaaggagcggucuugacccacaggacccuccccagagccucugcuucaaggaugcacucuaauggaggggggcuggggcccuggaagggguagggcuggggaggccacagacugaggcuagaaggaggaggagcagugguacacuccagucccaguagggcucaggcaggagggccagggcugggcaugggcccccaaccacaggaggucaggaccauaagcccccugaagaggcucugagcagguaagugacuugcauacagccucucagcccauggggcagagccaggauuugaacccaguauuucuacuccaaggcuaagguucuguggcccagcuuccaagaagguggcaggccagcaugcccaccugcaccaaguggucucggguggauagccaugggaacuggacaggaaucugggugugccugggcauggcgcgguggggggaagagggagagucagaaagaaugccugaccuguggacacggacauggcuggagaccuucacaccaacccugagggaggacagacagaaaggucagggcucagggucacagcaucuugggggcagagcuagggcugggggucuucauggccugcaggccccacuuccacagaagcuguugggcauuaggggcuguuugagggucuucccccuuuaaucugugugcacccucaagguacaaacaaugcuuggguucagagggagcuggccuggccugguggggugugguggggaauuuggacugggguaaagugauccuccuaucaggccaggcuuagggcaggaggccaggccacggauagggcucccgguggagaggguggauccuaccuaauccgcaagagcgagggucagcccuuccucggcacccagacuggcugaagggaggcugaggccggaggaggggcacgggaaggggaggggucagcucacucuacccuucccugaacugagcccugugagcccauugccuucacaaugcccagccucugucuucucuuggucucuucucucugacuauagggcaaaggaggagcccaacauccuggguuggaguuuggaugcagccccagcugugugaccccggggccaaucccaauccaucucugaaccccacccgcugcagagggcuuccccccacaacauccaaagagugucuuugaggggcuggagcagaaacauugccucucagauccaagacccuguuugggguggcacaaggugagccugccuuccacagaaacaucccccgggagcugcgcagccuuauuggguggugucuacaggguagugaggagguugaguagagacuucgugucaggggguuugagccacacagccuggguucaaagucucgucucccguuuuaucuagcagugcgacuuaauuaaccucugugguguaguaauugaacuuuccacgaauuuuccuauuuaaucuuuguuacagccuucugaggaaaugcaggcacagaggaagacauucauucuuucaaaaucauuuguucaaccaaugcagcggccuacuacgagugugacauaguucuaggugcuggaguucagcgggagccagguaauuugccuaauagcaguggauuugaagacuguucaagccugguagcaccagcagaccaggucggcgcaggccucagccccguggcacucacaaucuagaagugggagacagacaauacacgaaugaaugagaccauuuaaagaugcagaaaauaaaauagagggagggaaugggaugcgccgucggcuuauuggaggugggccagggcuaugugaaggaccgaggagccgcagggcgggggugcaggagccccggcacggcgcccucucugcggagccgacugggcggcggucccgacgcacgcuccuagggucagccgcaauuaccgccuuuauuauuauaagucgcggcccccgcacugcccagcucuuugcgccuuaguuucccccucugugcgcacucgggucgcgaggcgcagaggacgccccaaacaacuuugcgcuuccc

SEQ ID NO: 18713 - RNA, 1458 nt, Homo sapiens
gggguggugaggagcugggcuggugggcggccucggugacagagccucgccgccccagcggggcagcuggcugggaccucgucgguggagauguaccgccaggcacuacuauggggcugccgcugcguggagcuggacguguggaagggacggccgccugaggaggaacccuucauuacccacggcuucaccaugaccacagaggugccucugcgcgacgugcuggaggccauugccgagacugccuucaagaccucgcccuaccccgucauccucuccuucgagaaccauguggacucgugagugagccccuggcaugaaaccccauggaccgggggacagucuuccagcuucagugcuguuggacugcucagggaccuccaacccugcgaacggccacugacaugucccguagaccucagcuuccucucugggggagggaucucugaccucugaccucgguuccgcagggcaaagcaacaggcaaagauggcugaguacugccgcuccaucuuuggagacgcgcuacucaucgagccucuggacaaguacccgguacgggagcucggagcgagggggguggcaugggggccagggugcugcggacccgguccagggcccugacucguccaugccugcccagcuggccccaggcguuccccugcccagcccccaggaccugaugggccguauccuggugaagaacaagaagcggcaccgacccagcgcagguggcccagacagcgccgggcgcaagcggccccuggagcagagcaauucugcccugagcgagagcuccgcggccaccgagcccuccuccccgcagcuggguaggccccagcccggcccgccacccugacuugacccuagccucuggccucaugcuccaggcgccgugacacuucaucccagacccccagcccacccuccugccucgcugugcgccuguucccacaaccggccugucuccucaccaccugucggcugguguggggccucugaccccugaccucaggugcacgucucacccagcugcaccccaacuccugacucccaaccucagccucucaccucucagagccuucccacaacccggugauggcucugaaggcugaccucugaccucaguaaaccacaucccacacugggugugaccucagaccccuaagcccgcauugaguucaccugcccaguugguuaucauuucagcugaccucugaccucucaccccugacuguucaccucacuaugcccccuccuuagacauggcucugacuuaccccugaccuguaaccucucuaugucaucccuuaccccgcuauuagggcugugguaugcuacuuccugacuucucaccccacugaaccacccuaucugccucccugcugaauaucacugcagaccuuuaccuuugaccuaugaccccucucaacccauacuggguuaauaccaucugac

SEQ ID NO: 18714 - RNA, 3142 nt, Homo sapiens
gaagguggugggguaugcuggagcugaggucucugagucucucagggcccacaaacacacacaggcuuacuccuugggcuuuuaaguguuuuuuuguuuguuuuuguuuuuuguuuuuuuuuuggaacagucuggucccugaugggggccucucccccugccccuccccagucugguuacagcucaguucgucgcucuauuuugagcagcuccaccucgaacaccaggguugcaccaccuguaggggagaaggggagucaaaaugccaaccagggccacagggaggugggcuggcugcaggugaugggagguaucaaaagguuuacuaccuggaaucuuugggggagcuccccgcucuccauacccuguugaagaugcacaaagaaacagucagugauggccaagcucccuuccagugugggcaaagggagaguguuccgccccucucagcaagaaggccagaaauggagaaggguaauggagaugggaagggggugccaaaggccuggcaagggcagaguggggccacuacagcugagugcuucaaugaucuugcccuguacucacugcuagacacagccaaacuuggaggaggcauguauuguaaugaauggauacggugaagaccaaugaaaagcugaagcagcuuucacccuucccagucacacaccccaaacucgcucugcacccucaggaggggccucuuaccuagcucggaugggaucaccagcuugcgcuuuucccccucacacauccugcaggaagacacaugcucagcccauggcagcacccagggcccuugucuuguaucccuggggcuugccucccacagcuuaccuccugggcgguggccaugcacgcccccacucccaagcccauucccccaugacucaccccagcagccccuggucccagcccuugaugaccuggccugugccaagggagaagacaaagggcugguucuggggcaggcugcugucaaacucugucccaucuuccagcuuccccuguggaaccaugagaaggccagugaggaagaggggaccaccccugacacccccucccucagcugcuuuccccaucaagcugcccccccacgcccacccacagcccugguggucaguccuuuuuguuuuuugagauggagucucuguugccauggcuggagugcagcggcgugaucucgccucccugcagccucugccucccggguucaagcaauucuuccaccucagccucccaaguagcugggauuauaggcgcccgccaccacgccuggcuaauuuuguauuuuuagcagagaaaguuucaucaugaggccaaacuggucucaaauuccugaccucaggugauccacccgccucggccucccaaagugcugggauuacaggggugagccacugcgcccagcuggucauaguucuuuaagaggacagagccuugggcagcucacaguacacugucacugccugcuggugcccaccugggcaguaggcaagggcaaggcagaaccauggaaacuggcuuagaggcgagaggggacuugcccaaggucaccuaccuggcuuauggagaaccagacucccaagcacucucugguccucggaagccccacccacucccaaaaggcccgcccaacccacucaccguguagugcaugugcaggacauccccuuugcgcgauuugaugggacagugguccacccgcuucuugaccccgaucugcagcuuccuuuugcccucggcccccguggccguggccacggcgcucaggcagauggacaguacugucaggacccggaaccagcucagccucaugucucugugggcacagaccccgaccgaccgacugaacgugggggagggcagggagaguauggaacacggguagguaacaggaggguuccaccgccacuguaucuuccuugccccgggggauccccuuugucccgggucaccgcccucucccccgggcuccggggccacacuuaccaguccagugagaagggggcuuggccgaggaccccagcagcggggggagggggucaggggaggccacagcagccagggacccgccccuuugcucacccccauaccuucccucccucccaguccccaccuccgcucuucaguucccgccugucccuuuacgcaaaguccagacccuaucuggcugcacugcaguugccccgacugggcggccccacucacgccacacccagcugcccccgguccagcacaccaacaccucugcggccgcugcagggggccggccccgaggcacccacacauccccacuggguggcuccgaggagcccggguccucgggagauaccccccagccuggcccugugcuuccgcccggggcgccgccccaacucugagcccuugggggucuccggggcacccagacuggcccugugucugcuggccgccgagcccgcuccacccacaccaccucucccgguggaguucucggccuacggcguccccaagcccggccaccacggagaccacccccgcgaggacgcccggggccauuacucgggccaggcuccucacuuggcuccuuggcaccgcccuucggaggacgcgguaccgcccccgggccugcagccccgccuucgacagaacuagaccccuuuuccggagccguagccacgccacucaccggcugaagccccgcccccagcgccuccgcuccgucccccucugcuuccgaccccgaggcuccgccuuucaccuccuccagcuccuccuucaagagccaggcuccgucccccgacccuccuagcuccgccccccgccgccgggcuccgccuuccacuggcaccagcucggaggucccacccgucccgguuccacgucccgccccgagucccaggacuccgccccgugcggcgugagaacccucccccugcggcaucuccggacagcuccggcccccacccccaauuuccucgucaccuagcucucguugacacucggagcccgguccgcuucugcccggccugauccagccugcccucuugcaccccggcuccccccagcccgggcuguggcccccgcucaccuccucgccgcgcccccggagucaaccccgguggugcugccgccucugcgcaggcgcguccucgucgcu

SEQ ID NO: 18715 - RNA, 4209 nt, Homo sapiens
acagcuccuuccaucucuuuuaucaggguugggggucacaguucuuguaccaaagcccaaaucccauuaugcagagguuugggucuucuuagugaggggaggaagagccaguuguaagaugcuuacuugcacagagugguuagaaacugagacaguacuccauucuccccugagcugguaugugaccccucuugcugccucccagucuccucuuccaacucuguccuguuugaugauggccucagggagacaagggauggcagaagagcccucugagaggcccagguccuagagcagcuucugccugggcugaggucuugggggcuuggcuguuuuuuaccaggcuccucuuuguucccccacugggauauagccucugaggcaagucacccugcugagucugaaaagccaugugucaccuucgcagcuuccggcaccugaggagggaggaagugaucuguucaugcuggcuggagcgcagccccagcccuggacucaugugugccucgggcccacuaagaucacaaccugagcauccugccacaccacucggcccugggcacuggaggcugcagggcgaaggaugaaccuuuugcaaaggucauccccuccugacacuccucgggagcccccacuggcccugcccauaugauuucaccccauggccucacugcgggacacggauggugagaaacacaucagguaaggguggacaaggguuccacuauguccccuggccucuugaagcccguagguaagggcagaugucuaccacaggggcuucugggaaggcccgaacugcaagcuggaaaagcuguguccuacauuucuacuccgggcagaugucaccuccuccaagagaucucugaccucugaaagacgaggccagguaccccucaccacagcccuugacauccucugcuggcauugucccuccuguaucugacuccugaguuagaauguuggacuugcuuauacagcuccaggugccagcagcuguuugguaaauauuuguucaacacauucaacaguuuccccuucccuggcccuccuccuacuggcaggcucacccuggaccugcuccaggacagggccuuggugccuucccaaacaaacaccaccccacagacgccucaccugcaggugucuggguugagcucuaagccccgcccuuggcaacggaggaagcugcggcgucggcagcggcagcggcagguccgggggucagggcgcugguggugcugggugcagcgugggcagaggggccuggggcuggagugggaugggugaugucagcuggggagggugcuccgggggcagagucccagcccggaacagaacggggcuggggacggugguggggaguggcagcccuagggaggagaagcgacaugucuggggugggaaggaagagucuucccuagagcuggggucggggcagagaacacaggcuuggggagcagaggaaaagggaaagugggggacgggugggaggagaaagaggagcaacagcuucuggacucacuuguacuccccauaccccuacucagcuggaguccaaaagacucaccugucuggcuucacagcacuguccuuuuuuuuaggucugaaaaguaagauagacagacacagacaaacaagaggaagaucaggaaaucccagcauccuacucucucucucucucucucucucucucucucucucucuuugagacuguguuucccucuucuugcccaggcuggagugcaguggcguggucucggcucacugcaaccuccgccucccagguucaagcuauucucuugucucagccucccaaguagcugggauuacaggcaccugccaccaugcgcggcuaauuuuuguauuuuuuuuuaguagagaugggguuucaccauguuggccaggcuggucucaaacgccuuaccucaggugaucugccugccugggccucccaaagugcugggauuauaggugugagccacuacccccggcccaagcauccuacuuuguugccccagauccaaggccuacccuuggcucuacucuuuuuuuuuuuuuuuuuuuuuuuuuuuuguggcagagucuugcucugucgcccaggcuggaaugcaguggcacgaucuuggcucacugcaagcuacgccucccagguucaugccauucuccugccucagccuccggaguagcugggacuacaggugcccgccaccacgcccggcuaauuuuuuguauuuuuuuaguagagacagguuuuuaccauguuagccaggauggucucgaucuccugaccucaugauccgcccgccucggccucccaaagugcugggauuacaggcgugagcuaccacgcccggccccuugguucuacucuuaggaaccugguccccaguucuguggaccaccauacccagcaccccccaagccuggccucugcgagcucagaaguugggccuggcuggcaccugcauucacacuggcuguguucuuccagggacaucucccccagcugacugcucggguaccggaucaugaggaucugugcucaggagaagaacaggggggacagugagggagagagagaaaggggaugcucuaagacugaagggagaaaagcucacccaacagccgggaggcuggccaccagcccuccccccaacccugucuccugugcaucagucuccaggcugccccagccccagagccagccagcauccacccugcccgcugccccaccugcccaguaccugcauccccugcccguugccccaccugcccaguaccugcauccggacuuggugcugcccagugggcacacacuccaggccaucgucagggcagcagccaccacagcgcugcacagucacgcagcugggcaccagcuguuuggccacggugcccaugagcuccacagucaagggcaccaccaccucccggggcuggcagguagcgcgaguauacacaucuauccaugacaccacugggagcagaccgguagggguuaaguccucacugguuuuccugcagcugcucccagcaucuguccuccccaguccccaagucacagccacccuccacuagcccuccccacucugcccucacaaccugucuuccccugcccuguuuauccagaucccaguaaccccacugccucaauuuccuccucugugaaauggguagaauaauaguuugaaucuucuaggggaguuacacaagaugauggacaccuggaaucagggcccaugacaaacccucuuagugcuggcuagugccgaguuuuuguaaguauuaccuuuccucugguggccaggggcaucaggcugggagacaggggccugugggagagaaaagaccuguacccaagguacacuuuaggaggguguggcccugucaccgucccuggggcuuugcccuugcaucaguaggcuucaccaccucucugacaucuuuccagauugcucuguuccugcggccacugcucuagcuuuaccuguccucuccuggccacccgggaccugcccuggcccaaaacgcaacaggugcucugguggccgcgccaaaucuccaggccgcggagccgagcauguuugggggcugcaugcagaucaggagcgcgcacagugcccaccgaagcagguccugcaggcaccgagggagccccgcccccggcggugcccaggggacgggguggggcggaggaguggccccagacuggggcuggcgggccagcggggaggggcaccucccaggggaugcacgcgccgggcccccgagacgcccgcguccaaggccggaccccgcagauccccucggccgaggccgcgggucgccuccucacuuccgccaaccuugagagagggcacggcgggcgggcgggcgcgcugucgggccgcacguaccugggcgggggccagcugcaggagugcggcgagcagcaggcggcggagcagagggcucauggugcccgccggggccgcccgccgggggcgcccgcaucgcccuagcccggcggcgcggggggcggcgacagccagagccccauggcgcgggcccgggcgcggcgggcgggggccgggcgcggggggcgacuccuccgcggcccccucccgagcccugggugcaggcagcgcagcgcagcgcagcggaggcggccggaggagccgggcgggcgggcggccgguggcggcgggcagcggcggcggggacggc

SEQ ID NO: 18716 - RNA, 4209 nt, Homo sapiens
gccguccccgccgccgcugcccgccgccaccggccgcccgcccgcccggcuccuccggccgccuccgcugcgcugcgcugcgcugccugcacccagggcucgggagggggccgcggaggagucgccccccgcgcccggcccccgcccgccgcgcccgggcccgcgccauggggcucuggcugucgccgccccccgcgccgccgggcuagggcgaugcgggcgcccccggcgggcggccccggcgggcaccaugagcccucugcuccgccgccugcugcucgccgcacuccugcagcuggcccccgcccagguacgugcggcccgacagcgcgcccgcccgcccgccgugcccucucucaagguuggcggaagugaggaggcgacccgcggccucggccgaggggaucugcgggguccggccuuggacgcgggcgucucgggggcccggcgcgugcauccccugggaggugccccuccccgcuggcccgccagccccagucuggggccacuccuccgccccaccccguccccugggcaccgccgggggcggggcucccucggugccugcaggaccugcuucggugggcacugugcgcgcuccugaucugcaugcagcccccaaacaugcucggcuccgcggccuggagauuuggcgcggccaccagagcaccuguugcguuuugggccagggcaggucccggguggccaggagaggacagguaaagcuagagcaguggccgcaggaacagagcaaucuggaaagaugucagagagguggugaagccuacugaugcaagggcaaagccccagggacggugacagggccacacccuccuaaaguguaccuuggguacaggucuuuucucucccacaggccccugucucccagccugaugccccuggccaccagaggaaagguaauacuuacaaaaacucggcacuagccagcacuaagaggguuugucaugggcccugauuccagguguccaucaucuuguguaacuccccuagaagauucaaacuauuauucuacccauuucacagaggaggaaauugaggcagugggguuacugggaucuggauaaacagggcaggggaagacagguugugagggcagaguggggagggcuaguggaggguggcugugacuuggggacuggggaggacagaugcugggagcagcugcaggaaaaccagugaggacuuaaccccuaccggucugcucccaguggugucauggauagauguguauacucgcgcuaccugccagccccgggaggugguggugcccuugacuguggagcucaugggcaccguggccaaacagcuggugcccagcugcgugacugugcagcgcugugguggcugcugcccugacgauggccuggagugugugcccacugggcagcaccaaguccggaugcagguacugggcagguggggcaacgggcaggggaugcagguacugggcagguggggcagcgggcaggguggaugcuggcuggcucuggggcuggggcagccuggagacugaugcacaggagacaggguuggggggagggcugguggccagccucccggcuguugggugagcuuuucucccuucagucuuagagcauccccuuucucucucucccucacuguccccccuguucuucuccugagcacagauccucaugauccgguacccgagcagucagcugggggagaugucccuggaagaacacagccagugugaaugcaggugccagccaggcccaacuucugagcucgcagaggccaggcuuggggggugcuggguauggugguccacagaacuggggaccagguuccuaagaguagaaccaaggggccgggcgugguagcucacgccuguaaucccagcacuuugggaggccgaggcgggcggaucaugaggucaggagaucgagaccauccuggcuaacaugguaaaaaccugucucuacuaaaaaaauacaaaaaauuagccgggcgugguggcgggcaccuguagucccagcuacuccggaggcugaggcaggagaauggcaugaaccugggaggcguagcuugcagugagccaagaucgugccacugcauuccagccugggcgacagagcaagacucugccacaaaaaaaaaaaaaaaaaaaaaaaaaaaagaguagagccaaggguaggccuuggaucuggggcaacaaaguaggaugcuugggccggggguaguggcucacaccuauaaucccagcacuuugggaggcccaggcaggcagaucaccugagguaaggcguuugagaccagccuggccaacauggugaaaccccaucucuacuaaaaaaaaauacaaaaauuagccgcgcaugguggcaggugccuguaaucccagcuacuugggaggcugagacaagagaauagcuugaaccugggaggcggagguugcagugagccgagaccacgccacugcacuccagccugggcaagaagagggaaacacagucucaaagagagagagagagagagagagagagagagagagagaguaggaugcugggauuuccugaucuuccucuuguuugucugugucugucuaucuuacuuuucagaccuaaaaaaaaggacagugcugugaagccagacaggugagucuuuuggacuccagcugaguagggguauggggaguacaagugaguccagaagcuguugcuccucuuucuccucccacccgucccccacuuucccuuuuccucugcuccccaagccuguguucucugccccgaccccagcucuagggaagacucuuccuucccaccccagacaugucgcuucuccucccuagggcugccacuccccaccaccguccccagccccguucuguuccgggcugggacucugcccccggagcacccuccccagcugacaucacccaucccacuccagccccaggccccucugcccacgcugcacccagcaccaccagcgcccugacccccggaccugccgcugccgcugccgacgccgcagcuuccuccguugccaagggcggggcuuagagcucaacccagacaccugcaggugaggcgucuguggggugguguuuguuugggaaggcaccaaggcccuguccuggagcagguccagggugagccugccaguaggaggagggccagggaaggggaaacuguugaauguguugaacaaauauuuaccaaacagcugcuggcaccuggagcuguauaagcaaguccaacauucuaacucaggagucagauacaggagggacaaugccagcagaggaugucaagggcuguggugagggguaccuggccucgucuuucagaggucagagaucucuuggaggaggugacaucugcccggaguagaaauguaggacacagcuuuuccagcuugcaguucgggccuucccagaagccccugugguagacaucugcccuuaccuacgggcuucaagaggccaggggacauaguggaacccuuguccacccuuaccugauguguuucucaccauccgugucccgcagugaggccauggggugaaaucauaugggcagggccagugggggcucccgaggagugucaggaggggaugaccuuugcaaaagguucauccuucgcccugcagccuccagugcccagggccgagugguguggcaggaugcucagguugugaucuuagugggcccgaggcacacaugaguccagggcuggggcugcgcuccagccagcaugaacagaucacuuccucccuccucaggugccggaagcugcgaaggugacacauggcuuuucagacucagcagggugacuugccucagaggcuauaucccagugggggaacaaagaggagccugguaaaaaacagccaagcccccaagaccucagcccaggcagaagcugcucuaggaccugggccucucagagggcucuucugccaucccuugucucccugaggccaucaucaaacaggacagaguuggaagaggagacugggaggcagcaagaggggucacauaccagcucaggggagaauggaguacugucucaguuucuaaccacucugugcaaguaagcaucuuacaacuggcucuuccuccccucacuaagaagacccaaaccucugcauaaugggauuugggcuuugguacaagaacugugacccccaacccugauaaaagagauggaaggagcugu

SEQ ID NO: 18717 - RNA, 3805 nt, Homo sapiens
aauagacgcaggaaauggcgacggccgcgggucugugagcagcgggggcggggccugguuguggccccuccuucucccguccccaaguucccugggugggaacggggucuuggggucccuggcuggguggccagaccccgaagccagcgcugggaagggcugcggaugcccgggucagaggaaggggcagguccaaggacacgcgggucugguccugggcaagaaccgcccccucuccgggccugcuucagucuuccuuugcagaacaacgggccaggccccuucccucugcccccgggugcuugaagucuagccccauccugguccaaugcgcucuugguagccuccuuucccagcugcccgcccgccgccaugccgcccuuacugccccugcgccugugccggcuguggccccgcaacccucccucccggcuccucggagcggccgccgggcagcggugaguugggcgcggggggccggcccgguuguucaauggguuucuguuugcccuacgugcugaguuaguuguggucucuacuccgugucaggaggcucccagguuugucucagguaacccucgccuucccugcugaggaucagagauagagaagacccccaaggucauacaccgauuuaagcggcagaggaggaaguuugaguccaggucaaacccaacgcucuuaccacagcucuagugguuuccaagcaucgcuguaucacugugcauaacccucuguggggggugggagauggggaggugucggguacaaaauccagauuccugggcucugcucuggagauucugaacuggaggaaucaauugggugggggucaggaaucaguuucuuucucuuuuuccuuuuuuuuuuuuuuuuuugagauggaguuucgcucguugcccaggcuggagugcaauggagcaaucucggcucaccacaaccuccgccucccggguucaagcgauucuccugccucagccucccgaguagcugggauuacgggcaugcaccaccacgcccggcuaauuuuguauuuuuaggagagacaggguuucuccauguuagucaggcuggucuugaacucccgaccucaggugauccgcccuccucggccucccaaaaugcuggauuacaggcgugagccaccgcgccuguccaggaaucaguuuuuuccaacaaguuuuuggacuccacuuugagaaauccugaccugcacuaugccugaaacacuccaaagggggugcugaucuggagacagaucuguccugggaccuguuucagcccugucagcuccugguggcugaguugaaggguguggcccagaaggcagggcagagcuagcuucuggguuccuucagccccugcaagguuugggacucuguccacagguccagacccaguacuuauuaugaacuguugggggugcauccuggugccagcacugaggaaguuaaacgagcuuucuucuccaaguccaaagagguacccguaccccugagguggggagggggagcaggaacuuugagccagugggggugugcuucaaauucccaggaguagaccagcaucucuggcgggugccacauuuuuucagcccucauagggaguggcaggugcucaaugguaggggaaaggcugugggcaggagccagggguccugucugaugggcugggcuugguuuucuugaccugccugccugcucuugagaaaccuggaccagggcauauggugaaugcagggggcuggcagguggggagggcuugaacacaggaggaagcaggaguccaugcucucuggccuucugaggagugggcaggccugagugagggucacugaccaggcagggccucuggguaugacuggagcccugguggguggaugucaucagcauggguccuggggagggacaggcaaagggagauaaggggaguccugccccaccccagcugcacccagaccgggacccugggaacccaagccugcacagccgcuuuguggagcugagcgaggcauaccgugugcucagccgugagcagagccgccgcagcuaugaugaccagcuccgcucagguagucccccaaagucuccacgaaccacaguccaugacaagucugcccaccaaacacacagguacaguaauccugcccucagcuugccccacccccaggucucuuggguagucucauuuccacaaugucccuuccucugccucccagcagcuccuggacaccccccaacgcacaguacuggucccaguuucacagcgugaggccacaggggccccaguugaggcagcagcaacacaaacaaaacaaacaagugcugggguacugccuccuccucaugcuggcgggcaugggccugcacuacauugccuucaggugaugccuguucuccccggggugaugggcagagggcaggagggugggugaauuccaguguggucagccaguccuccacagcaccucguggcccguacucuugugucucucaagcuaagagcugcuugaaguuggucucuggagccucuccuuacuuauuaaaggcagcgcugcaccaagagcuaacguugucauuuacaguuuuucauauuucgaauguaaaucuuucaugcuggcugccaggaagggauugagccaaacaaaaucaagcacaagcagcaaaugcagcacagcucauucauuuggcaguaggcaucucccugccacucucacgcgugccacggagcugauucucuuuauucucuuuuuuucuuuuuuuuuucuuugagauggagucucacucuguugcccaggcugcagugcaguggcgcaaucucggcucacugcaaccccaccucugccucccagguucaagcaauucuucugucucagccucccgaguagcugggacuacaggcguccaccaccacacccggcuaguuguuuuguauuuuuaguagagaugggguuucaccauauuggccaggcuggucucaaacuccugaccucaggugauccacccgccucagccucccaaaguacugggauuacaggugagagcuaccgcgccuggccacaaagccgauuuucuauagcagauaccuaaaggccagugcccacugcuagcagccugccuaguucagugauggaguuagacgcauacccuuucuagucuucugggaggagcacccccauguccacagcugcugucacaccucaaagugaccagggacuucggaugccauuggacccuagacaagccagggccacucugagcccucccuaucuaucacaggaaggguuagacugagguuccuaacccuguguaaggguaaaaagcugugaggccccuagagugggguggaagggggcaggacuucagggacagcaggaauuggauucccaggguuaauugugacccauugcaggaaggugaagcagaugcaccuuaacuucauggaugaaaaggaucggaucaucacagccuucuacaacgaagcccgggcacgggccaggucugucccugcucuauucugcucccugcucccuguccaggaaccacacuucgggaucccuaucccaaccacccaggugcccucuccuccagggccaacagaggcauccuucagcaggagcgacaacggcuagggcagcggcagccgccaccauccgagccaacccaaggccccgagaucgugccccggggcgccggccccugaggggcucaccuggauggggccugcagugcguucccgcuuugcuuccuucccuggacggcccgcuccccgaaacgcgcgcaauaaagugauucgcagagcucgu

SEQ ID NO: 18718 - RNA, 12018 nt, Homo sapiens
aggcggcagcagcaguucacauuuauugagggccugcccccaaggagcucacagccugggggcugagaccccgaaugugcagggggcggggaagaaaagaggugaaggcaaaaaggcaggcaaugcagagacaccguggcccaagcagagggggugcaaggcaggcacaggcagggggccuggggcggauggggagguggagaaccggcagcccugccuagaccugaggacuguagaccccacacguuugaaggcugcccucccccaccaggauggcacugcccgggcacccugugggaggcccagcuccuccaccugcccugagccggguccagccucacaaaggccccuccacccaggacucccaaccaugcagacucccgguggagggcaggaagcuggggucuggggcccagccgggacguggagguggggccuaugagggagcagaugaaguguggguggcccugggacccugggcaagucccuaaggaacuuccaggaucccauagaagccccugagccagcuaagaagggaaggaagcagaacccaacgaagcaggaggggccuccaagaggccuggccccucaaaccugcuccuguuggggaagcucaggaguagauaggugaaaagcagggggacccaccuggggggagggggcagcagacagagcagccaggcgggcagcagagcagggacacgcacacacggcucaccaccagcacccccuuuaauaaaacaugggggggggucaugugacaggaagaagggggugaaauaggaccauuuacaaccacagaaaaaccucuguacaugucuagcgccuggcagaggggggcagcagggcagcagcgggcuggagccagcccuauuuguagaggauaucguaguguccaggccgguagagaagguagaccuugggcucggagcccucagggaagaugugcggauugguggugccgcccucgccgcgguccauguacuccaccuggauggacacgcugagggccugggccagcgcaaugauguggauguggucgcucuccuugcacaugggcuccaccuccuguggcacaggugccggucaggcccuggucuccgcaccccgccccaggcccugugggcccacugcacucccccggccgagaguaaaggggagggggacggcaccugcuggcagaacuccuugacaguccguccacccucgaugaagugcucgaagaacuugcucucgcgcugcagguagcccgaggugagcagccgcagguagaccacaagguagucggaggugcucuggucauugaaggaggccagcaggucggcgacagaggucugcuucuccaccugcucaaucagguccaugaacugcagccacggagggagaaagggcaagaugacggggaggagaugggugguccucaccaggugaaccccucccccauggcccagcccaagacaggcaccagggcucaccguguuguggaaauccucaauugugaauucagugaagcccugggacaccaggucuuccuugcucuuggcagacacagccuugaaccugggggugggauggaaaggcgggcccagcaugggcuccucgaccagcccagacgccagggccgagacagcacugccccgccuggcaaggccagaguccagcccaucgcccgggaaggagggagacacccuacucgagacacauccuacucgcccggggaggagguagacacccaccugccucggugcccagugcccacccuucucaccgcugcaacuccuugcugucauccagcagugccuccaagugggagaauccgaaagcccgauagaaacaguugccgucaggccuggucuugcggauguacgaguacuuuuuguggagguccugcggagacagccccaccccgacagguuaacaucaggccagaacgggggcuggccaaggaaaugucccccagcaaaggucacacuccaaagguggcaacugagcucccagcagccaccugccacccugggucccugaaacaggcugcugaauguggcaaugggagcggcccacugcccagaguccucccaaaagacggcaggaagcugggcacuuaaggacaaacuaguugcaugggucacuaaaguucugcggggccuacaggacuguacaacaacaggugagugaauguccuugagcaaugcguuuccuccagucuuucagcccaagagaacuucagggcaagcaagucagggccaggguggagugcuggccuccacgccucaaccagguggcuggggcccucugcacagcccagcucagccccgcucccgccacacugagaagaguucccccaccucuaagccuugcccgcagcccuccuggggcuagaaacagccucccuccucuacuuguuuuuuugagacagaguuuugcucuuguugcccaggcuggagugcaguggcgcgaucucggcucacugcaaccuacaccucccggguucaaacgauuccccugccucagccucccaaguagcugggauuacaggugcccacccaccacgcacacuucaccuggcaagcacacuucacuccccuggccugggcacccuccccucuccccuacccaucuugcuccuacccccagcugaugaccuugucuuuuuuccucagcccccaccagcacaucugccuuuggccuccucccacaauccucagaggaucuguuccagcugccaccuaagcugccucuccacuccacacuagcccacccccacccucaggcucaagcacaucauuccaagcugggcgccauggcucacaccuauaaucccaacauuuugggaggccaaggugggaggacgcuuaagccuaggaguucgagaccagccugggcaacacagugagacccccgucucucuaaaaaaaauaaguggcugggcgcgauggcucacgcuuguaaucgcagcacuuugggaggcugaggugguuggaucaccugaggucgggaguucgagaccagcaugaccaacauggcgaaacuccaucucuacugaaaauauaaaauuagcucggcaugguggugcaugccuguaaucccagcuacucgggaggcugaagcaggagaaucgcuugaacccgggaagcagagguugcagugagccgagauugcgccaucgcacuccagccugggcaacagagcaaaacuccaucuugaaaaauaagcaagugagcugcacaugguggugcauccuguggucccagccacucgagaggcugaggucggaggacugugugggcccaggaggucgaggcuacagugagcugugauggcaccacuacacucuagcgugggugacagagugcgugagacccuaucucaaaaaaaaaagacaucauccuaggaaguacccccaucaucaauuuuucccacccuacugguuuagacccaacagcauauacacauucagcuacuucuuuaaaaggaagggaauccuggacuuuacguuucugucuggcuacccuucaauuucucugcuuucuuuacagcaaaacuccucaugaagcuguccgugcugccuccaccucuuuucucccucgggaggcuuuugcucuagccaaggucagcugaacgcccucaaucagagggggcaaacccagcgccccacccccacuggccccuuagcagaacugaggccacuggcuguggcccugccuagaugccuccuucccugggcuggcgcccccacccucuccuugucuuccuccugccuccaaggccacuccucaucucucuaagcucugagggucagggaugccaccaaaccauacagcacccuucgagacauggugugucaccugcaagaaaacagucacugaggcugggugugguggcucacgccuauaaucccagcacuuugggaggcugaggcaggcagauaucgaggucaagagaucaagaccauccuggccaacauggugaaaccccgucucuacuaaaaauacaaaaauuaacugggcgugguggcacacaccuguaguuccagcuacucuggaggcugaggcaagagaaucacuugaacccaggagguggagauugcagugagccgagaucgcuccacugcacuccagccugggcaacaaagggagacuccguuucaaaaaaggaaaaaggaaaacagucacugcacacuuagccacugugccugccaugugaccacgggcaugagggcugucucccaugugccuaccccgcccugcucaggccugggacagcuuccacuuuucuuuuuuuuuucuuuucugagacagggcuuucuaugucaccugggcuggagugcaguggcaagaucacggcucacugcagcaucaaccuaccaggcucaagcaauucucccaccucagauuucagaguagcuggaacuacaggugcacaccgccacacccauuuaauuguuguauuuuuuguagagacgggauuucaccauauugcccaggcuggucucgaacuccugggcucaugugaucugccugccacggccucccaaagugccgcacccggccagcuuccucuuugaaacuacacucacucucauggccagguacaguggcucacaccuguaaucccaguguuuugggaggccaaggggggaggaucaaguugaaggcuagccugggcaacacaacaagaccucaucucuacaaaaauguaaauuauacuugcucucuugacgacaucagucucaagcaauuuuuuuuuuuuuuuuuugagacagucucgcucugucguccaggcuggagugcaguagcgcgaucucgguucacugcaaccuccgccuuccggguucaagcaauucuccugucucagccuccugaguagcugggacuacaggcgcgcgccacuaugcccggcuaauuuuuuuguauuuuuaguagagaugggguuucaccauguuggccaggcugguuuugaacuccugcccucaagugauccacccaccuuggccucccaaagugcuaggauuacaggcaugagccauugccccuagccaaagucucaaggauuuaaauagccccaagugugaaucucaacucucaacuccaauuacgauccuccuaucuaccagccucaccacaccuccucugaacuguccaacaggcauuuccacugagugcagcugagaucaaccuccgaacaacugcuccuccccgaggcugccccaccucagucacccacagcacccaaagccuuccagucgcugccgacuccaucaccauauccaucccuucaauaugucugguauccaacugcuucuuacuccucaccucuaccacccgcugcccgccuccagcagauuuuacugcacaagucuccuggcagugucccugccuccccuucacccucuggaguuuauucucaccccagcaagagaauggccagggucggcuuggcgugauggcccaggccuguaaucccagcacuuugggaggccaaaguggguggaucauuugaggucaggaguucaagaccagccuagccaauauggugaaaccccgccucuacuaaaaauacaaaaauuagccaggcaugguggugggcaucuguaaucccagcacuuugggaggccaaaguggguggaucauuugaggucaggaguucaagaccagccuagccaauauggugaaaccccaccucuacuaaaaauacaaaaauuagccaggcaugguggcgagcaucuguaaucccagcuacucaggaggcugaggcaggagaauugcuugaacccgggagguggagguugcagugagcugagauggugccauugcacuccagugcacuccagccugggugacagggcaacacucucucucaaaaaaaaagaaaagugaccagagucaccugccagaugcacccuaucuccaucucccucagaguccuuucucucgccacaacaccccaccccgccccgccccgcucaguuccccagccccaaccccucauucuccaccagccacacuggccuccaugcuggccucaaaccauccaggugcccucucgccucgggccugggugggcacugcucucggacgccugugacucgcuccccggucuuuuucuguucauuacucaaauaccaccucaucagcaaggccuucaccaagcccuguuuaaaauggcaaaugcucccacucccaauccccucuuuuuuuuuuuugagguggaguuuugcucuggucacucaggcuggagugcaguggcacaaucucggcucaccgcaaccuccacuucccagguucaagagauucugcugccucagccuaaguagcugggauuacagggaugcgccaccacacccggcuaauuuuguauuuuuaguagagacgagguuucaccauguuagucaugcuggucucgaacuccugaccucaggugauccaccugccucagccucccagugugcugggauuacaggcgugagccaccacgcccggccccgauccccuuuucauuuuucuccacagcacucaccgccuucugauaccccacaugucccagagcccucuuuggcuuaucaugucuuuccacccugaacuguaaguuuugugagggcaggacuuugucugcauggcucuaucuucaguaccuagaacagcgccuggaccacaguccguucucaauaaacguuaaaugaguagcacaccaggaccacaaagaacccaaaucaccacugcuacuguagcagccaccauggccauugugagcacacucucugugccagggauuuggcacagggcgaauaaacgucauccuaauugauccucacaagagcccauuuagagagagaggagcucucucugcuugggcucugcugccacagcugucucugcccagggagaaaaggugggcucaggcacagcauacagaaugcgggugcugggggcacagagaggccuuuuagacagcaugcucuggacauccaaauguuugaugacuccgugggaagaaccuggggcccagccuguccuguccacuuuaccaggguggucuagcaugagcggcaggccuuggcauggggggucccacuggaggacacugacauaagaggaaugaaugaaugaagcucacccccuguauggggagaggagcagcuuuguaacccgcugcuuacaaccgcccguaacaucuccuucaacccucacaauugcccugugaggcagacaauguccccgcccagagagaacaggggauccaagagcuucaggguguugcccgagaucacacagcucaaaguggugaggccaggacuggaacccaggcccaucaggcuccacagccagugccuucaucucuccacaggcacccugaggaaaucuagcucccugaggagggggccucaguagaucacagugcacagaucucacacagcuggaucuggccugcagguguguuuggcccacacauuuaaaauuugaauuagcugccaacuguuagaagucaggagcugugguuaccucuggcuucucuuggaaaaacagaucuggagacaaugguauggacacucccauuucccccaggggccucugcucccuauuagugucuggcugauacugagcugugcugcccuccuuguucaccaucugacuuccuggccaccuucaaucaccuggguuaccuaccuggccacagaggccuccccuaccaguagaggacucuaagcaucugucaucuuccaggggaagagaaacauuuacuaaacaccuacacugagccuaccagauacuguuuccacacacccauugucacauuuauuuauuuauuuauuuauuuauuuuuuuauuuuuuuaagagacaggucucacugucacccaggcuggagugcagugguacaaucauggcucaacuucuugggcucaagugauccuccaaccgcagccucuugaguagcugggacuauagacaugugcuaccacacccaguaauuuuuugauuuggagagacaaggucucacuauguugccuggguuggucuugaacuccugggcucaagcgauccucuggccucagccucccaaagugcuaggauuccaggcuugagccaccaugccuggccccauuucacaugucauccucccagcucacagaccuagaaaguggguggugaaguuugccuccguuugagugaugcagcagggcccuuugaggaaaucuguggccccuugaccccacugcugccugccucuccacaaagauccaggaggcaagcugugggaaacagcccucuggcaacccuccuaccccacugagcaccagccuggucagcccccguaugggcaccgagaucaucagcuccugcccagccugcaccucccucaaucucacaaucgcccuaugggaagaugcuuuuuuuuuuuuuuugagacggagucucacucugucgcccaggcuggagugcaguagcgcgaucucggcucacugcaaccuccgccucccggguucacaccauucuccugccucagccucuccgaguagcugggacuacaggugcccaccaccacgccuggcuaauuuuuuuguauuuuuaguagagacgggguuucaccguggucucgaucuccugaccucgugauccgcccgccucagccugccaaagugcugggauuacaaguguaagccaccgcgccaggccuuuuuuuuuuuuuuuuuugagacggagucuuacuccgucgcucaggcuagaguacagugcgggaucuugccucacugcaaccuccgccucccagaugcaagcaauucuccugccucagccuucccaauagcuggaacuacacgcgcgcaccaccacucccagcuaauuuuuguauuuuuaguacagaugggguuucgccauguugaccaggcuggucucgaacuccugaccucaggugaucugcccgccucaaccucccaaagugcugggauuacaggcgugagccaccgugcccggccagaagaugcuuuuauugucccuauuuauagaugagaacacccauuuuagagacacuaaaggacuugccaaggauacagcugcugaguagcagagucuagauuugaaucaaugucuuuuuuuuuuuuuugugagacagucuucuguugcccuggcuggagugcagugcugcaaucuuggcucacugcaaccuccgccucccggauucaagcaauucuccugccucagcccugcgaguagcugcgauuacaggugccugccaccacacccggcuaauuuuuguauuuuuaguagagaugggguuucaccauaucagccagacuggucucgaacuccugaccucaggggauccacccaccucggccucccaaagcgcugggauuacaggcgugagccaccgugccugccccccaccuuuuuuuuuuuuuuucugagaugaaguuuugcucuuaucacccaggcuggagugcaauggugugaucuuggcucccuacaaccuccaccucccagguucaagcauugaaucaauguguuuuugaggccucagccuacgcacuucaagaaccagcaacgaaaaguguccuccaacacccuacucccucaggugacagacccagcaggaagcaagucugaagcaggcacccuccugccccacccccagggugcuucccacccgcucuggccaggcucccaccuugaucuucuguugauagauguugucaucuucagcauacuccuuguauaggaccgagagcuccagccgcucugacaccagaggguucugcacagcaaucuggaggaggcagggaucugucauguccuagcagggagauggagugacccaugccuaacagacagaauaacuacaaaagagcugggcuggucacccgguggcacagcgacccccagaaaagcaccaguaccuagcauagccuagggaggagggagcuuccaaaguagagacagacaauaggccucaugcccagccuaugcauuuccacaauggggcugcuggccacugccucccucgcccacugcagccccucaccucuugcugaauucgguccugcugagccaugauggcuucaucauaggccagacaguuaacaccugggaaaaggaaaaaagccaaagauuacaggggguccuggccaucuccacugcaggcagcugggccagggacaagagcagcccagggucaggaagacaggcuuagaaucuggaagcagguauguuacagaugucccagaugcaagcaauucuccugccucagccuucccaauagcuggaacuacaugcgugcaccaccacucccagcuaauuuuuguauuuuuaguacagaugggguuucgccauguugaccaggcuggucucgaacuccugaccucaggugauccgcccaccucaaccucccaaagugcugggauuacaggagugcuccaccucaagugugucaucuuggcaaagucccuuccccuucugggcuuucauuuccucaucuuuaaaaugaaggggcagaggugcaccgugguaucccuaaggugcgcucuuucagcucugacacccccuuccucccguuaacaucacuucccagcagccugggaauguucuggggccaggcguggucucuugcagaaaguaggacgaggaagcagaguccuggccuggaggagagcuuccuaugagccugcacuuuacuccaucaccgccuucauccucuugcggucguggauauuguuaauggugcccauuuuacaauuaacaaaacaacugcagacaggugaagcaaucugcucaaggucacaacuagcaaaagaccugcggucaaacccagguuugucuaauuccaggcugagcucuucagcacaauaccucuccuuggcuaccacauggcagagaccuuuccucaacuguaaaauggggcgaguacccucgccuuucuuagaggcauaccaguacgugcucuaggauuaucagccagcugggcagguccacccuauggaccccacugugagcagcuaucggugaggagcuaggacaccugaauuuuaguccuggcucucucuuaaugucaucuugaacaagucccuuccggggccguuuucccacuucucguucccucaaguguucggugagaaugaggugcgugggcugaaugacuuuaaaggucaacccuuuuggggcucgccaucccaaauucuuggcugggcgucgaccuaccuacccuuuucgcacuacucugcaaaagaacugucccugccacccaaugaccuacgcgguccccagggcccaacucauaggcgggaaaagacagagugggaccauuuuugaaaggcccaucuccuaaggagacuaacaaugucuaggcaggcggaaaggggcugcaaggccagaagaggcggcucuaccagaaaaagucgcaggccucagggacagaucccgcaggccccucacaucccagggccgccuacgacaucccgaauggcccgcccggaccuuugugcuccguagcccagcgaaacucgaggcccucacggcgcgggccgccgcuggagcaggccggggggcucggcccuggcguaggccucucugccugacugcaaggacaggggcgagagggcucggggccccuggagccaggagccgagggguugggcagagggcggagcgacccaggccccgccccgggcgcacacgauggagaagggccgcgggccuuggcccgccucgcccgugcucccucccggccgggggucgcggcgguggcuccuuccauugugagggggaggggaggcagcggagguggaggaagggaccccucgcgcaccucgaccccagagccagcggcccugccuccccucccuccucgggagcagcuggcccggcaucgcccccacuagcccgggccggacaucccuccuuggaucuguaccuucggagucgcugcccagcggcuccugcuucugcugcugagguuccuccgccgccaucuuuaaacagcgccgcacuaccgaccgcuuccggguugccaauugccguccucccgga

SEQ ID NO: 18719 - RNA, 8291 nt, Homo sapiens
uaaaccagaggagcauucaguguaggagagcuuguaaaacuggcaggcacucaccaguggaaagccuggaugcucccacccccaaaauuaacugugacuguuccacuugagaaacagccauauuccuuuacugucccauuguagaugggaggcaggggcugcucccucuuuccagccaggguaagagccuccuucacaaaggauaaccagaagagccugcaacuuaagcacaaagccaaaaccaaggugguuuacugcccuuuagcucucugagcugcaauccucaccacaaggcagggagaucagcacugcagccugggccaugaggcggggcucccccaggacucaagccugccugggaaaaaccugacauggcauaagaggugagaacagagagcaaccuccagcucacucuccuucaggccuggaagccacaaugcaaagagcacucuccaaaucuccucugucuucagagccacuugaaaugcugggcuccucuugaaacuagauucuacugagcaaccagggcuuuagaggcuuccaggacuacuuucaucccugagaaucugcuugcuggggucuggucgcuaaauccccagcuacuguugcccuagcaaaccuuuguugagcaguacucuggagcccuggcuccaguugcaaagcucagugcgaucuggcuccugccuuccagaaacuuaaaagagguaaacuauacagaaaacuuacuauagucgcucugcccaccucuguugcuuaccagcugacugaacaugagcaaagugacauaacuucuccaaaucuguuuccucauuugggacauaaagauacuagcuguacccauuucacagaauuagagugaagauuaaaugagaaaaucuggccgggcgugguggcuuacaccucugauuccagcacuuugggaggccaagacaggcagaucccuugagccuaggaacucgaggccagccugggcaacauggcaaaacacaggcucuacaaaaaaacacaaaaauuagccgggguguggugacaagugccugcaaucccagcuacuugggaggcugagguggaaggaucaccugagcccagggagguaggcugaggcugcagugagccgugaucacacugcugcacuccagccugggugacagaguaagacccugucucaaaggaaaaaaaaaaggaaaauccaugucaguguuuaccauagaacgugguguucaguaaugucuugaugauguauucuauuauuaucuagcuucauuuuuggguaggaaccauuguuuccccucuccaaggguucucugggcucugggaagagcuacaauaccuagaaauuugacuguaaguaccaguauagcuaaguugauuccugucauccugguauucccucuauaacaaggaaaagucaaauucugccauggcugggcaaucaggcaaagaggacccucuuuccuaacauaaaaccauccugcaggaggaguagcugaaugacauggugcccaugccuucgcccucuguguggcccagaggaugacgacagugguccugccaggguucuucccuucuucaucaguuccuuaacucccuccucccagaaaagguccaugaaacagccgacauaccaguaccacauggugccaagggcugagggaagcucacacugccagccucgcacuuuaugcgguuccucccauaccaguggguuaccguaaccauggagaccaacaaguuccuccauaucacaggagagccagccugccaguagcccagggcucugggggaugggggugguggggguaggcagaaggaagccugcagcauagaggucuggcucacuuuacagaggacuguggggaggcagcagauccuaaccagugcagcugagguggcugggcuuccuccuaaccucguuuucuuugccuaguauauauguucuuggcauauuuucugggcucucuagacacugggcuuuucuuccuagcuccacugcuguauacuggggcaccauauaugguauaguagugaagggugucauucuggaguuagacuguagugauaacccagcuccacuacucuguacaugcacauauacaaaaaaauggaacaauaaagagaagauuagcauggccccugugcaaggaugacacacaaauuugugaagcauuccuuuuuuuuuugagacagaguuucgcuccuguugcccaggcuggaaugcaauggcgugaucucggcucacugcaaccuccgccucccggguuucaagugauucuccugccucagccucccaaguaacugggauuacagguaugcgccaccaugcccggcuaauuuuguauuuuuaguagagacaggguuucuccacguuggucaggcuagucucgaacuccugaucucaggugauccgcccagcucggccucccaaagugcugggauuacaggugugagccacuaagccuggcccauauuuuuuaaaagauuaaaacuuuuauuauuucaggcugggcaugguggcucagagcaagacugucucaaaaaaaaaauuauuauuuugaauaaauaaauaaaaauaauaagaaaaaagaaugggucagaauugugguacaaagagcuacccagaucuacacauacuaaaaggaaaguggucaucuauccuaugcgccuuccugugauccagguaaguccucuuauccguuguuuaucucaaauccagacaccgucuuagcggggaguggucacucacuucucuagacucacuucucuagacucucagcgcucuaucuguacucuucauuucuucuucuuuugugagaugaagucuugcucucuugcccaggcuggacugcaauggcacaaucacagcucacugcauccucaaacuccuggguucaagggauucuccugcuucagccucucgaauaguugggacuacaggugugugccacuaugccuggcuaguuuuuuauuuauuucauuuuuuuuguagagauggcaucuugccaucuugcccaggcuggccucaaacuccuaggcucaagcaaucuuccugccucagccucccaaagugcugggauuacaggcgugagccaccacacccagccccauugauuucuuguuuguguccccauaccuuaacccccucaugcucugacagaugagagccaguaucucccucaccuucauauacccucagugcccaacagugcccacaccuagcugacccauguuacaauacuuagggaacaagagaggcacaacuuuuugaucuuuaaaguugcccacucucgaccccacucucgaccccaagagauaaggguagaggaaggaagaucacaauuucuugcuaccagccccauuuccccucuuucgaggcauucguugcccuugaaguugguugguuacuaucuguccuuccugcuagacuacacuacaaaaggagggaccuugguauuuuuuuuugagacagaguuucucucuggccauccaggcuggagugcaguggcgugaucucggcugacugcaaccucugccucccgaguucaagcgauucuccugccucagccucccaaguagcugggauuacaggugcccaccaccaugccuggcuaauuuguuuuuuuuuuuuaguagacgggauuucaccauguuggccaggcuggucucgaacuccugaccucaggugaucugccugccuuggccucccaaagugcugggauuacaggcgugagccacugcaccaggccaggucugucuuauucauggcccagaacaaugcccagcacaguauucaguaaaguacugaauuaauaaaugugcacaaaugaauacauaagaaaacauuuugcgaugucuucaugacggucucugggaccaacugauaacugauagcccacuucaguguacucugcaaaaaauacccaugaggguaaugagccacgagauccccuaucccagugauggaugaaaagugagugaucaccaaggugagcuggagacagacucagaauauaggcacagccagggaccagcagggcccaucccacuugcuccccugaaucaagcccuagccuuccuuucaucggagggaaaacccucuccuucacacuuccugcugcccaugacaaccaccagguccucagacuuaauacaguucucucugccucucuacauuuaguuucucuacugcuuugcuaucaaaaccauugugucuugcugugacaaugaaugcaacucgagccauucuaagagcuaccaauuggggacggacagugacuuguauaagaaucuaggagacaauuauuuauuguuugccacacuaagaguucugcuuugauauuuguuacuugaaccaauguacugacucuaaggcccgguuaacucuagggugucaaaauaauuucacccauacacaccugccuccuguccugcugcaaaaaucagcauucccacccugcccccaaccccuccccaaacugccuccuguuacagaaaagcaaaagaacuaaaaacggcagcuggggagcucaguugacucacccagcauaaucaucuccucccagaaucucccaucuucuccugggguuuuugccaacacaaaguaaaaaagaagcaugagaucuuaaaaaaaaaaacaaaaaaaaaacucagcauuuaugcaacagucuuucuaccuggguacagauuuaacccuuuguuucugcccuuuccaauguuguuuccuuaaaacuugcuuguaugcugaggauaagauccagccuggagcugggaaacaggccuucuagacccccuagucccagcauugcugcuggaaagugcagaacaagacauaugccucuuccugcugcaucuuucucuggaagugaacaaauacugccucccuacuccuccaguuucaaagagggaguugaauaaggaggaggaaaugucagaaaaaaauacugggacaaaguuuguugcuccagaagucaccauggccagaggucagagcacaucagaaaccaccccaaggcugucacugccacccucaccucagaacugucucccuguugggccaggcugcaaaguggcuacuccacuuaagugaccacuaaaaauccaacuggccaaucuuucuagaagcaagcccuuacugggcugcuccugcugaagggagaggugcuaucuuucuccuguagcagaucauuaaaaaaccaagcaggagagggcaccuaaguuguggaaugagggcauccuguuucaggugcuacuggacuauggaucaaaucagcugacauggagaacccagacaaaccugccccucaaggcaaucacagaagacaaggguagcucucuagcaaccuuucugggugggaagaggagggugcuucuuuucugucauuuggcauauaggaggacaacuuacuugugugauagauagugccaugaccacaaaaugugauuuuuuaaauguuuuuuuuuugagacagagucucacucuaucgcccaggcuggagugcaguggugucaucucagcucacugcaaccucuaccuccuggguucaagugauucuccugccucagccuccagaguagcugggaguacaggcgcucaccaccaggcccagauuauuuuuuuguauuuuuaguagagaugggguuuuaccauguuggccaggcuggucucaaacuccuguccucaagugaucugccugccucggccucccaaagugcugggauuacaggcgugagucaccgugcccagcugaauacaaaauaaagagacacuuccacaggcaaaugcaaaucuguugcagcauauuagucaagaaauccccaaguuaccaaaaguucuguucuaagaaggaacucuuuuuccauagaaacauguuacaaaugguagcuguguucucaggccagcccaugaggucccagcauaguauuucaagggguacgugaauuguacuuaagacuuaaaccauagcccagaacaggaaaugaauucagaguuccaacucaggacccgggaacagaucuuugcucuccaagcaccaugggcagcagacacgggggcucccuagucuucaagcucugggugagggcuugaaucaagaagacuugagccaggugcgguggcucacuccuguaaucccagcacuuugggagaccgaggcagguggaucacgaggucaggagaucgagaccauccuggcuaacacggugaaauccugucucuacuaaaaaaacaaaaaauuagccgggcgugguggugggcaccuguagucucagcuacucgggaggcugaggcaggagaauggcgugaacccaggaggcggagcuugcagugagccgagaucgugccacugacuccagccuaggcgacagagcgagagagacucugucucaaaaaaaaaaaaaaaaaaaaaaaaagacuugaacaagagagcuucaaagcauuugggguagagcuuaaggcuggguaggagagagguucugaggagauauaaacccaaauggagaugaggaaugaggcuggaggaaaagaauuuuaaaugggugcugccuuacacaaaagaagagcuaauuaaggaagacuggguagaacaacuuccagcuagaggagaaaagacaaccugcaacaguacccugacauaacaggggcaaaugcucuuuacaacugucuucccuacuaggcaaccgaugcgggggcugugcuucauaccugccuuacugggcuugccacugcugcugcagucucaacccugcacugagaaccggauccuguuacuaaguggccauggccugggcagguauccuggccagcuugccagaucaauggaggauucauuugucagcaguuaggugaacaguggaaagcccgagcuucucagugagacugaguauaugucagcuuauggcuuuaggcugaaggugccccucaaagccaaccacugcuguuuauucacuggcggcaaugacaauuuugcuccaaggggcccuugcuguuuguacuuucuaccuaggagcagaguauggcaaaccagaugacagccauuuuccauuacguguaccuuauuaaaaagcacuuuuuuuuugagacagggucucugucaccaugcuggagugcaguggcgcgaucuuggcucacuacagccucgaccuccccaggcucaggugauccucccaccucagccuucugaguagcugggacuacaggugcccaccaccaugcccaacuaauuuuuguauuuuuuguagagaugggguuucaccauguugcccaagcuccucucaagugauaggcaugagccacugcaucuggccaaaaggcacuuuuuauacuuaauucauccuuucagcauccuaugaaaagagucugggcugggugcaguggcucacgccuguaaucccagcacucugggaggcugaggcgggcggaucacuugaagucaggcguucgagaccagacuggccaacaugaugaaaccccaucucuacuaaaaauacaaaaaucagccaggcgugguggugggcaccuguagucccagguacucaggaggcccaggugggaggaucaccugugccuggggaggucgaggcugcagugagccgaaaucaugccacugcacuccagccucguugacagagcaagacuccgucucaaaaaaaaaaaaaaaaaaaaaaaaaaagagucugauugaacugguuucuaagagaagggaauggcccaaggcagcagaagaccugggcuuugagcuuucuaaccucugugguaugaaccugggaauggcacucuucggugcagaagaccugggcuuugagcuuucuaacuucugugguaugaaccugggaauggcacucuucagugagauuagcucgugcacuggucgaagcccucaggaaccagaaccacccauuaacaaguggcugggaggaagggggccgcuuuugggcauuguuagaugugcugcuacacagacuguggacaagggaaugcuggguguuuugaaggaggcaagcagccaagucuguagcucuccaccucugaauucacucagagauggcagggaagaaaagauggcuccaagaggaauacagcuccuacccaacaaauccuaaaaggcagcucuaacuggcaauaggaauggcggcauaaacgaagacccaaagaagaaacccacccaggauaccucucaucaguagaauuuagcuggguggccagaggccacggcuacccauucuguugcucuacauaguucaugcuaacuaccaaggacaaagaaccccacagccauaacggggucccuaccaagucu

SEQ ID NO: 18720 - RNA, 1122 nt, Homo sapiens
cagauccgagagggaaaccugggccccaaggcugaagggggugagaaggugcccgggucccggaccccgacuggggagggacggccccagccccggccccgcaccgugacgcggaaguggaauccccuccauccucaccucugagcaucggcucgggccgcggaauuacggccaccaccauggccuccuccucguccuccccuuccucgcauuucagcgucaccucgaagcagucgagugcggcgcccucggccuuuagggccauggugcggccgugggcgauagcaguggccggaggacuggcgcgcaggcuucggcgcgcagccggcaaccgccucccgccuccuggccggaauagcgccgggcccgccgcccgccccgcgcagcccccuccccgccgcccgcccgccgcucgccggccgggccugcgaccggcgcguccgggccuccccgagaccucggcgcgucgggagcccgggcggggagggcucaauccggggccccugccccccgccgcucccuuuuauggaggcucauugucggcgcccgcccggccggccagccgcggacccgcccccgaugccgcgcggccaaucgcgcguggccccgccccgggcacgcggccccguuagaaacccuggacccgggaggcggcgggaagggccgaggggacccggggccacccggugcgcagaggcagaggggcccccaaaacccgcaacgcgggccccucagucugcgggccaagcccgggguuucccuccauuaagaagucaguugggcguuucugcuggcguggagagcgcuaccaggugcccccggauuuugaucgggagucgcuuuugccuuuccguggacaagccuuccuccgccagcagaugccccgggcaggaagagaagcggugggugaguggaaagggccuugguauggaaacgcagagaccgaauuccuucucaucugccagcuccguggccgugggcacauuaucuguuuucuuaguccggcucaucguuucuuucaaaaaccauuuuggacccuucugggaaggcaaagaagagaagcagaguggacugugagcggacauaaaccacccugauggguaugauuuccauuuuuggcac

SEQ ID NO: 18721 - RNA, 4466 nt, Homo sapiens
ggcguaaaucuuacaaaguguauaaagaaucuguguuucucuacauuaacaaaaaccaaaggcuacaagagcgguuguauauacaaaacacggagauauugcuucacuugcaaacagguuccagaccagauggggagacgagacagaggagggggacagggagggccgagagggcgcguugcgugcaggagaggggaggggagaggggagagggggggacgggcuucucccugcaucaaucaacaggcagaggugggaggccugugcgagcugcugugugcggaggagcgggugggcgcugagagcccgggggguccgccugccccggcccccgcugccugguucuucgggcuuuggcccagagcacgguucuggguggggacgacgggcuggcugggccacccggucacggagggagggaggcaaucgcucccuagagucggccaaggaaaaggggagaaggcggcgccguccgcccguccuccucgccucuggccagccccguccauccugccgcccuccccaccccgccaagacgcuguggggacccgaguuucaugggugcagcaaaccggggcuucuagcuuuuccccgggcaggacgggguagcacuggcuccuguccuuccugggccccggcccggccgugcagagcucacugggagggcuggaacgagccggccacagagggacagcagggaggggccagaggauaccguggcgggggcgggcggaggacgugcacgcacgcuggguggaggcgcaggggucacagguucuggcagcacugcagcuuguugggcuucuguccguccguggugggcggcacgcugauguccaccacguuguuccccggggacucgucgugggcagcgcggucugcgaucuguuucugugacacgaugcgguagaucucugcaaaggggguacagggggacguggggugagccagcacgugcccugccugccgaggggaaccccucccugcaggacuccagaggcccucuccagacccccacagcgcccccaucacaucagggguaacaaggacaggggcugcgcacccagccaggacccacaucuggucacagccagccccggccucucgcucccuaagaucagaagcgcccuccucccucagagguaaacucccagaagccaaaaggcuccaggucccugaggcuacccgccuccccgcagcgccaagaguuaaggcagggcccauccccaggaacuggggccagggggucucuguguccccagugccagcaagggcuagaccuggucugacccugugaaguguccagguggaccggcagguuuaaaaagcaaagguuagggguggugguggaaaaaaaucaaacaggccaggugcaguggcucacgccuguaaucccagcacuuugggaggcugaggcaggaggaucacuugagcccaggaguucgagaucaaccuggacaacauugugaaauccugucucuacuaaaaauuacaaaaauuagcgggugugguggcaggcaccuguaaucccagcuacucgggaggcugaggcaggagaauugccugaaccuggaaggcggagguugcaguaagcugagaucgagccaccacacuccagccugggcaaagagcaaaaauccauccugccccgacaaaaaaaagaaaaaaacaagcaaacgaacaaaacaagcgaagguucagaggccguguuccacccugccuggcuggugcccuacccacacccaucugguccccggccaccugugaggauguucuugaaugcuuccucuacguuaguggaauccaaggcugaggucucgaugaaggacaaguuguucuuuucuggaacaaagaauacugccuaggugaguggggaggcagggugacaggcucccacaugcucucagggaccccgcccacccaccuggcccaucccaaggccacuccucagggaagggaagccagggcuguggccagggccccaacacugugaggggccuccugccuuccagacaccucucugaugccugcgucuccgucugcucaccugcgaaggcgcgggccucgucagugggcacagcccgcagguggcgcaggucacucuuguugcccaccagcaugaugacgauguugcugucugcguggucccgcagcuccuucagccagcgcuccacguucucauaggucaggugcuuggcgaugucguacaccagcagggcgcccacugcaccacgguaguaccugcagggucaggggcccaugagccucucuggaggacaaccaugggcagcggcagccucacgggauaacagcacacaucacgcccagggugggucguccagggccgagccaaggggcagucauuguggccucaagggaagggugugugucuggaggccccagcgcugcucccuggauccagcucugaaaugugggggucugaggagggaguuugggagcuggaaauagaagauaccgugaggucaucaaaaaaagggaagaaggggcugggcaugguggcucaugccuguaaucccagcacuuugggaggcugaggcggguggaucacuugaggcugggaguuucagaccagccugggcaacauggcgauaccccaucucuacuagaaaaacacaaaaauuggccgggggucguggcucaugccuguaaucccagcacuuugggaagccgaggcagguggaucacgaggucaggaauucaagaucagccuggccaagauggugaaaccccaucucuacuaaaaauacaaaaauuagccaggcgugguggcaggcgccuguaaucccagcuacucgggaggcuaaggcaggagaauugcuugaacccuggggggcggggggcggagguugcagugagccgagauugugacacugcacuucagucuggaugacagagugagacucuaucucaaaaaaauaaauaaauaggccaggcagggucgcucacgccuguaaucccagcacuuugggaggccgaggcgggcagaucaugaggucaggagaucgagaccauccuggcuaaugcggugaaaccccaucucuacuaaaaauacaaaaaauuagccaggcgugguggugggcgccuguagucccagcugcucaggaggcugaggcaggagaauggcgugaaccugggaggcagagcuugcagugagcugagacugcgccacugcacuccagccugggcgacagagugagacucugucucaaaaacuaaaacuaaaaaauaaauaaauuaauuaauuaaauuagccaggcaugguggcacaggccuguagccccagcuacucaggaggcugaggcaggagaaucgcuugagccugggaggucaagggggcagugagcugcaauuguggcacugcacuccagccugggcgacagagcaagacccugucugucuccaaaaaagaggaggcgacagccaggcacgguggcucacgccaccuguaaucucagcacuuugggaagccgagaggguggaucaccugagggcgggaguuugagaccagccugaccaauguggagaaaccccaucucuacuaaaaauacaaaauuagccugguauggcggcaugugccuauaaucccagcuacuugggaggcugaggcaggagaaucgcuugaacccaggaggcggagguugcagugagccgagaucgugccaucgcacuccagccugggcgacaagagugaaacuccaucucaaaaaaaaaaaaacaagaggaggugacagagagacagauguaccugagggaugaaggagaugggagggagcccagaggaucucaagacgguggugggaauggcuggggggcuugggagggguccagaaaaaggcagcugaguggguccugauggcugggaagccuuugcagggaauggaggccaggcccaggugggaggacaggaggcgugugggaccaggugugggcaccagugaggagggaagcugagggaggaggaaggcugggaugcuggcugggcaggggcagcggcaaggcggaguggccugagcuagguccucacugcacuugguacccagagauacccugguguggcgaaggcugggcgcuggucagccugagggucccacggcgcauggcuaaagcguucuuccagccucacucccuggucuugggagcacacucuccccuucuccugcccaacuccuacacauccuuccaagcccacgcgcugcaagcccacgcccccgaaucucagcgucccugcccaggcugccgacacgcacgcggaggugauggcgcgguagcgcuccuggccagcggugucccagaucugcgccuugauggucuugccguccaccuggaugcugcggguggcgaacuccacgccgauggugcucuugcucuccagguugaacucguugcgggugaagcgcgacagcagguugcucuugcccacgccugaguccccgaugagcaccacu

SEQ ID NO: 18722 - RNA, 4466 nt, Homo sapiens
aguggugcucaucggggacucaggcgugggcaagagcaaccugcugucgcgcuucacccgcaacgaguucaaccuggagagcaagagcaccaucggcguggaguucgccacccgcagcauccagguggacggcaagaccaucaaggcgcagaucugggacaccgcuggccaggagcgcuaccgcgccaucaccuccgcgugcgugucggcagccugggcagggacgcugagauucgggggcgugggcuugcagcgcgugggcuuggaaggauguguaggaguugggcaggagaaggggagagugugcucccaagaccagggagugaggcuggaagaacgcuuuagccaugcgccgugggacccucaggcugaccagcgcccagccuucgccacaccaggguaucucuggguaccaagugcagugaggaccuagcucaggccacuccgccuugccgcugccccugcccagccagcaucccagccuuccuccucccucagcuucccuccucacuggugcccacaccuggucccacacgccuccuguccucccaccugggccuggccuccauucccugcaaaggcuucccagccaucaggacccacucagcugccuuuuucuggaccccucccaagccccccagccauucccaccaccgucuugagauccucugggcucccucccaucuccuucaucccucagguacaucugucucucugucaccuccucuuguuuuuuuuuuuuugagauggaguuucacucuugucgcccaggcuggagugcgauggcacgaucucggcucacugcaaccuccgccuccuggguucaagcgauucuccugccucagccucccaaguagcugggauuauaggcacaugccgccauaccaggcuaauuuuguauuuuuaguagagaugggguuucuccacauuggucaggcuggucucaaacucccgcccucaggugauccacccucucggcuucccaaagugcugagauuacagguggcgugagccaccgugccuggcugucgccuccucuuuuuuggagacagacagggucuugcucugucgcccaggcuggagugcagugccacaauugcagcucacugcccccuugaccucccaggcucaagcgauucuccugccucagccuccugaguagcuggggcuacaggccugugccaccaugccuggcuaauuuaauuaauuaauuuauuuauuuuuuaguuuuaguuuuugagacagagucucacucugucgcccaggcuggagugcaguggcgcagucucagcucacugcaagcucugccucccagguucacgccauucuccugccucagccuccugagcagcugggacuacaggcgcccaccaccacgccuggcuaauuuuuuguauuuuuaguagagaugggguuucaccgcauuagccaggauggucucgaucuccugaccucaugaucugcccgccucggccucccaaagugcugggauuacaggcgugagcgacccugccuggccuauuuauuuauuuuuuugagauagagucucacucugucauccagacugaagugcagugucacaaucucggcucacugcaaccuccgccccccgccccccaggguucaagcaauucuccugccuuagccucccgaguagcugggauuacaggcgccugccaccacgccuggcuaauuuuuguauuuuuaguagagaugggguuucaccaucuuggccaggcugaucuugaauuccugaccucgugauccaccugccucggcuucccaaagugcugggauuacaggcaugagccacgacccccggccaauuuuuguguuuuucuaguagagaugggguaucgccauguugcccaggcuggucugaaacucccagccucaagugauccacccgccucagccucccaaagugcugggauuacaggcaugagccaccaugcccagccccuucuucccuuuuuuugaugaccucacgguaucuucuauuuccagcucccaaacucccuccucagacccccacauuucagagcuggauccagggagcagcgcuggggccuccagacacacacccuucccuugaggccacaaugacugccccuuggcucggcccuggacgacccacccugggcgugaugugugcuguuaucccgugaggcugccgcugcccaugguuguccuccagagaggcucaugggccccugacccugcagguacuaccguggugcagugggcgcccugcugguguacgacaucgccaagcaccugaccuaugagaacguggagcgcuggcugaaggagcugcgggaccacgcagacagcaacaucgucaucaugcuggugggcaacaagagugaccugcgccaccugcgggcugugcccacugacgaggcccgcgccuucgcaggugagcagacggagacgcaggcaucagagaggugucuggaaggcaggaggccccucacaguguuggggcccuggccacagcccuggcuucccuucccugaggaguggccuugggaugggccaggugggugggcggggucccugagagcaugugggagccugucacccugccuccccacucaccuaggcaguauucuuuguuccagaaaagaacaacuuguccuucaucgagaccucagccuuggauuccacuaacguagaggaagcauucaagaacauccucacagguggccggggaccagauggguguggguagggcaccagccaggcaggguggaacacggccucugaaccuucgcuuguuuuguucguuugcuuguuuuuuucuuuuuuuugucggggcaggauggauuuuugcucuuugcccaggcuggagugugguggcucgaucucagcuuacugcaaccuccgccuuccagguucaggcaauucuccugccucagccucccgaguagcugggauuacaggugccugccaccacacccgcuaauuuuuguaauuuuuaguagagacaggauuucacaauguuguccagguugaucucgaacuccugggcucaagugauccuccugccucagccucccaaagugcugggauuacaggcgugagccacugcaccuggccuguuugauuuuuuuccaccaccaccccuaaccuuugcuuuuuaaaccugccgguccaccuggacacuucacagggucagaccaggucuagcccuugcuggcacuggggacacagagacccccuggccccaguuccuggggaugggcccugccuuaacucuuggcgcugcggggaggcggguagccucagggaccuggagccuuuuggcuucugggaguuuaccucugagggaggagggcgcuucugaucuuagggagcgagaggccggggcuggcugugaccagauguggguccuggcugggugcgcagccccuguccuuguuaccccugaugugaugggggcgcugugggggucuggagagggccucuggaguccugcagggagggguuccccucggcaggcagggcacgugcuggcucaccccacgucccccuguacccccuuugcagagaucuaccgcaucgugucacagaaacagaucgcagaccgcgcugcccacgacgaguccccggggaacaacgugguggacaucagcgugccgcccaccacggacggacagaagcccaacaagcugcagugcugccagaaccugugaccccugcgccuccacccagcgugcgugcacguccuccgcccgcccccgccacgguauccucuggccccucccugcugucccucuguggccggcucguuccagcccucccagugagcucugcacggccgggccggggcccaggaaggacaggagccagugcuaccccguccugcccggggaaaagcuagaagccccgguuugcugcacccaugaaacucggguccccacagcgucuuggcgggguggggagggcggcaggauggacggggcuggccagaggcgaggaggacgggcggacggcgccgccuucuccccuuuuccuuggccgacucuagggagcgauugccucccucccuccgugaccggguggcccagccagcccgucguccccacccagaaccgugcucugggccaaagcccgaagaaccaggcagcgggggccggggcaggcggaccccccgggcucucagcgcccacccgcuccuccgcacacagcagcucgcacaggccucccaccucugccuguugauugaugcagggagaagcccgucccccccucuccccucuccccuccccucuccugcacgcaacgcgcccucucggcccucccugucccccuccucugucucgucuccccaucuggucuggaaccuguuugcaagugaagcaauaucuccguguuuuguauauacaaccgcucuuguagccuuugguuuuuguuaauguagagaaacacagauucuuuauacacuuuguaagauuuacgcc

SEQ ID NO: 18723 - RNA, 4121 nt, Homo sapiens
uucgggcuuuggcccagagcacgguucuggguggggacgacgggcuggcugggccacccggucacggagggagggaggcaaucgcucccuagagucggccaaggaaaaggggagaaggcggcgccguccgcccguccuccucgccucuggccagccccguccauccugccgcccuccccaccccgccaagacgcuguggggacccgaguuucaugggugcagcaaaccggggcuucuagcuuuuccccgggcaggacgggguagcacuggcuccuguccuuccugggccccggcccggccgugcagagcucacugggagggcuggaacgagccggccacagagggacagcagggaggggccagaggauaccguggcgggggcgggcggaggacgugcacgcacgcuggguggaggcgcaggggucacagguucuggcagcacugcagcuuguugggcuucuguccguccguggugggcggcacgcugauguccaccacguuguuccccggggacucgucgugggcagcgcggucugcgaucuguuucugugacacgaugcgguagaucucugcaaaggggguacagggggacguggggugagccagcacgugcccugccugccgaggggaaccccucccugcaggacuccagaggcccucuccagacccccacagcgcccccaucacaucagggguaacaaggacaggggcugcgcacccagccaggacccacaucuggucacagccagccccggccucucgcucccuaagaucagaagcgcccuccucccucagagguaaacucccagaagccaaaaggcuccaggucccugaggcuacccgccuccccgcagcgccaagaguuaaggcagggcccauccccaggaacuggggccagggggucucuguguccccagugccagcaagggcuagaccuggucugacccugugaaguguccagguggaccggcagguuuaaaaagcaaagguuagggguggugguggaaaaaaaucaaacaggccaggugcaguggcucacgccuguaaucccagcacuuugggaggcugaggcaggaggaucacuugagcccaggaguucgagaucaaccuggacaacauugugaaauccugucucuacuaaaaauuacaaaaauuagcgggugugguggcaggcaccuguaaucccagcuacucgggaggcugaggcaggagaauugccugaaccuggaaggcggagguugcaguaagcugagaucgagccaccacacuccagccugggcaaagagcaaaaauccauccugccccgacaaaaaaaagaaaaaaacaagcaaacgaacaaaacaagcgaagguucagaggccguguuccacccugccuggcuggugcccuacccacacccaucugguccccggccaccugugaggauguucuugaaugcuuccucuacguuaguggaauccaaggcugaggucucgaugaaggacaaguuguucuuuucuggaacaaagaauacugccuaggugaguggggaggcagggugacaggcucccacaugcucucagggaccccgcccacccaccuggcccaucccaaggccacuccucagggaagggaagccagggcuguggccagggccccaacacugugaggggccuccugccuuccagacaccucucugaugccugcgucuccgucugcucaccugcgaaggcgcgggccucgucagugggcacagcccgcagguggcgcaggucacucuuguugcccaccagcaugaugacgauguugcugucugcguggucccgcagcuccuucagccagcgcuccacguucucauaggucaggugcuuggcgaugucguacaccagcagggcgcccacugcaccacgguaguaccugcagggucaggggcccaugagccucucuggaggacaaccaugggcagcggcagccucacgggauaacagcacacaucacgcccagggugggucguccagggccgagccaaggggcagucauuguggccucaagggaagggugugugucuggaggccccagcgcugcucccuggauccagcucugaaaugugggggucugaggagggaguuugggagcuggaaauagaagauaccgugaggucaucaaaaaaagggaagaaggggcugggcaugguggcucaugccuguaaucccagcacuuugggaggcugaggcggguggaucacuugaggcugggaguuucagaccagccugggcaacauggcgauaccccaucucuacuagaaaaacacaaaaauuggccgggggucguggcucaugccuguaaucccagcacuuugggaagccgaggcagguggaucacgaggucaggaauucaagaucagccuggccaagauggugaaaccccaucucuacuaaaaauacaaaaauuagccaggcgugguggcaggcgccuguaaucccagcuacucgggaggcuaaggcaggagaauugcuugaacccuggggggcggggggcggagguugcagugagccgagauugugacacugcacuucagucuggaugacagagugagacucuaucucaaaaaaauaaauaaauaggccaggcagggucgcucacgccuguaaucccagcacuuugggaggccgaggcgggcagaucaugaggucaggagaucgagaccauccuggcuaaugcggugaaaccccaucucuacuaaaaauacaaaaaauuagccaggcgugguggugggcgccuguagucccagcugcucaggaggcugaggcaggagaauggcgugaaccugggaggcagagcuugcagugagcugagacugcgccacugcacuccagccugggcgacagagugagacucugucucaaaaacuaaaacuaaaaaauaaauaaauuaauuaauuaaauuagccaggcaugguggcacaggccuguagccccagcuacucaggaggcugaggcaggagaaucgcuugagccugggaggucaagggggcagugagcugcaauuguggcacugcacuccagccugggcgacagagcaagacccugucugucuccaaaaaagaggaggcgacagccaggcacgguggcucacgccaccuguaaucucagcacuuugggaagccgagaggguggaucaccugagggcgggaguuugagaccagccugaccaauguggagaaaccccaucucuacuaaaaauacaaaauuagccugguauggcggcaugugccuauaaucccagcuacuugggaggcugaggcaggagaaucgcuugaacccaggaggcggagguugcagugagccgagaucgugccaucgcacuccagccugggcgacaagagugaaacuccaucucaaaaaaaaaaaaacaagaggaggugacagagagacagauguaccugagggaugaaggagaugggagggagcccagaggaucucaagacgguggugggaauggcuggggggcuugggagggguccagaaaaaggcagcugaguggguccugauggcugggaagccuuugcagggaauggaggccaggcccaggugggaggacaggaggcgugugggaccaggugugggcaccagugaggagggaagcugagggaggaggaaggcugggaugcuggcugggcaggggcagcggcaaggcggaguggccugagcuagguccucacugcacuugguacccagagauacccugguguggcgaaggcugggcgcuggucagccugagggucccacggcgcauggcuaaagcguucuuccagccucacucccuggucuugggagcacacucuccccuucuccugcccaacuccuacacauccuuccaagcccacgcgcugcaagcccacgcccccgaaucucagcgucccugcccaggcugccgacacgcacgcggaggugauggcgcgguagcgcuccuggccagcggugucccagaucugcgccuugauggucuugccguccaccuggaugcugcggguggcgaacuccacgccgauggugcucuugcucuccagguugaacucguugcgggugaagcgcgacagcagguugcucuugcccacgccugaguccccgaugagcaccacu

SEQ ID NO: 18724 - RNA, 4121 nt, Homo sapiens
aguggugcucaucggggacucaggcgugggcaagagcaaccugcugucgcgcuucacccgcaacgaguucaaccuggagagcaagagcaccaucggcguggaguucgccacccgcagcauccagguggacggcaagaccaucaaggcgcagaucugggacaccgcuggccaggagcgcuaccgcgccaucaccuccgcgugcgugucggcagccugggcagggacgcugagauucgggggcgugggcuugcagcgcgugggcuuggaaggauguguaggaguugggcaggagaaggggagagugugcucccaagaccagggagugaggcuggaagaacgcuuuagccaugcgccgugggacccucaggcugaccagcgcccagccuucgccacaccaggguaucucuggguaccaagugcagugaggaccuagcucaggccacuccgccuugccgcugccccugcccagccagcaucccagccuuccuccucccucagcuucccuccucacuggugcccacaccuggucccacacgccuccuguccucccaccugggccuggccuccauucccugcaaaggcuucccagccaucaggacccacucagcugccuuuuucuggaccccucccaagccccccagccauucccaccaccgucuugagauccucugggcucccucccaucuccuucaucccucagguacaucugucucucugucaccuccucuuguuuuuuuuuuuuugagauggaguuucacucuugucgcccaggcuggagugcgauggcacgaucucggcucacugcaaccuccgccuccuggguucaagcgauucuccugccucagccucccaaguagcugggauuauaggcacaugccgccauaccaggcuaauuuuguauuuuuaguagagaugggguuucuccacauuggucaggcuggucucaaacucccgcccucaggugauccacccucucggcuucccaaagugcugagauuacagguggcgugagccaccgugccuggcugucgccuccucuuuuuuggagacagacagggucuugcucugucgcccaggcuggagugcagugccacaauugcagcucacugcccccuugaccucccaggcucaagcgauucuccugccucagccuccugaguagcuggggcuacaggccugugccaccaugccuggcuaauuuaauuaauuaauuuauuuauuuuuuaguuuuaguuuuugagacagagucucacucugucgcccaggcuggagugcaguggcgcagucucagcucacugcaagcucugccucccagguucacgccauucuccugccucagccuccugagcagcugggacuacaggcgcccaccaccacgccuggcuaauuuuuuguauuuuuaguagagaugggguuucaccgcauuagccaggauggucucgaucuccugaccucaugaucugcccgccucggccucccaaagugcugggauuacaggcgugagcgacccugccuggccuauuuauuuauuuuuuugagauagagucucacucugucauccagacugaagugcagugucacaaucucggcucacugcaaccuccgccccccgccccccaggguucaagcaauucuccugccuuagccucccgaguagcugggauuacaggcgccugccaccacgccuggcuaauuuuuguauuuuuaguagagaugggguuucaccaucuuggccaggcugaucuugaauuccugaccucgugauccaccugccucggcuucccaaagugcugggauuacaggcaugagccacgacccccggccaauuuuuguguuuuucuaguagagaugggguaucgccauguugcccaggcuggucugaaacucccagccucaagugauccacccgccucagccucccaaagugcugggauuacaggcaugagccaccaugcccagccccuucuucccuuuuuuugaugaccucacgguaucuucuauuuccagcucccaaacucccuccucagacccccacauuucagagcuggauccagggagcagcgcuggggccuccagacacacacccuucccuugaggccacaaugacugccccuuggcucggcccuggacgacccacccugggcgugaugugugcuguuaucccgugaggcugccgcugcccaugguuguccuccagagaggcucaugggccccugacccugcagguacuaccguggugcagugggcgcccugcugguguacgacaucgccaagcaccugaccuaugagaacguggagcgcuggcugaaggagcugcgggaccacgcagacagcaacaucgucaucaugcuggugggcaacaagagugaccugcgccaccugcgggcugugcccacugacgaggcccgcgccuucgcaggugagcagacggagacgcaggcaucagagaggugucuggaaggcaggaggccccucacaguguuggggcccuggccacagcccuggcuucccuucccugaggaguggccuugggaugggccaggugggugggcggggucccugagagcaugugggagccugucacccugccuccccacucaccuaggcaguauucuuuguuccagaaaagaacaacuuguccuucaucgagaccucagccuuggauuccacuaacguagaggaagcauucaagaacauccucacagguggccggggaccagauggguguggguagggcaccagccaggcaggguggaacacggccucugaaccuucgcuuguuuuguucguuugcuuguuuuuuucuuuuuuuugucggggcaggauggauuuuugcucuuugcccaggcuggagugugguggcucgaucucagcuuacugcaaccuccgccuuccagguucaggcaauucuccugccucagccucccgaguagcugggauuacaggugccugccaccacacccgcuaauuuuuguaauuuuuaguagagacaggauuucacaauguuguccagguugaucucgaacuccugggcucaagugauccuccugccucagccucccaaagugcugggauuacaggcgugagccacugcaccuggccuguuugauuuuuuuccaccaccaccccuaaccuuugcuuuuuaaaccugccgguccaccuggacacuucacagggucagaccaggucuagcccuugcuggcacuggggacacagagacccccuggccccaguuccuggggaugggcccugccuuaacucuuggcgcugcggggaggcggguagccucagggaccuggagccuuuuggcuucugggaguuuaccucugagggaggagggcgcuucugaucuuagggagcgagaggccggggcuggcugugaccagauguggguccuggcugggugcgcagccccuguccuuguuaccccugaugugaugggggcgcugugggggucuggagagggccucuggaguccugcagggagggguuccccucggcaggcagggcacgugcuggcucaccccacgucccccuguacccccuuugcagagaucuaccgcaucgugucacagaaacagaucgcagaccgcgcugcccacgacgaguccccggggaacaacgugguggacaucagcgugccgcccaccacggacggacagaagcccaacaagcugcagugcugccagaaccugugaccccugcgccuccacccagcgugcgugcacguccuccgcccgcccccgccacgguauccucuggccccucccugcugucccucuguggccggcucguuccagcccucccagugagcucugcacggccgggccggggcccaggaaggacaggagccagugcuaccccguccugcccggggaaaagcuagaagccccgguuugcugcacccaugaaacucggguccccacagcgucuuggcgggguggggagggcggcaggauggacggggcuggccagaggcgaggaggacgggcggacggcgccgccuucuccccuuuuccuuggccgacucuagggagcgauugccucccucccuccgugaccggguggcccagccagcccgucguccccacccagaaccgugcucugggccaaagcccgaa

SEQ ID NO: 18725 - RNA, 9538 nt, Homo sapiens
gggggcaaguuuuuuucuucaccuucaauaugagaauucagcgaacuugaaagaaaaaucaucugugaguuccuucagguucucacucauagucaugauccuucagagggaauaugcacuggcgaguuuaaaguaagggcuaugauauuugauggucccaaaguacggcagcugcaaaaaguaguggaaggaaauugucuacgugucuuggaaaaauuaguuaggaauuuggauggguaaaagguacccuugccuuacuccaucuuauuuucuuagcccccuuugaguguuuuaacugguuucauguccuaguaggaagugcauucuccauccucauccucugcccucccaggaagucagugauugucuuuuugggcuuccccuccaaaggaccuucugcaguggaagugccacauccaguucuuuucuuuuguugcugcuguguuuagauaauugaagagaucuuugugccacacaggauuuuuuuuuuuuuuuaagaaaaaccuauagaugaaaaauuacuaaugaaacuguguguacgugucugugcgugcaacauaaaaauacaguagcaccuaaggagcuugaaucuugguuccuguaaaauuucaaauugaugugguauuaauaaaaaaaaaaaaaacacaaacaaugacuguggcaucauucugcuaacuuuauucuuuauacacaguuuggguaaaguaagaaccaaacacugcuuccacucccccuauccucacuccacuuuggggacuuuaaaaagugacuaauaguugguacucguaaggauucccaagacugcagaauuuaguuguacagcauaacugugcauuugaucucugaaagaaaauaagagacccucuaagagguggugaccuuagaagaaugaggaggggucagggggucuuuuaccccaguucagccucacaccagccugggagauuuucccaccugcaacgcaaagcagccuguaaauuacauauagccacaauacacuuaaauugagucaaucaccguggaaaaugggaacuaaauacaucaucaggucuucauugaaagaacuugaguggucaccugugauuagcucuucuccuaaacuaaggcugcugugacccuuaagcuggcuuuuaaaaauguauucaacauaccucuuagaaaacuuaggcugaaauauuuuuuaaaugacugaugcaaacaauuucacaaauacgcauacaaauguuugaauaaugucacuaaguaacaugguauauaaauauguauucagaguaacauuuacauauuggccauaauagcaagcauaccauuaacaacaacaacaaaaaaaaucaugaagagacuucaccuguucaugucagaaucccaaggcaaggaggcacaccuaggcaagagggccaacucaacuugcaacgucuaaccugugaggccauaacuuccaucaaagcaggaaucaauggaaucacuaccgcagcccuucccuuucacuggugcccggcacuucagcugcaucaagaucaauggagggcucaugaaaacacugcuaggccccaaccaaguuucugauucaguaacccugggguauggcccaagaauuuuuauuucuagcagauuccuaaggugaugcugcuggucucagggacacacuuugagagccacugguguguuuggggcugucucaguaaagauguccacucuccugaggccucucucugccuacggaggggggggaaucuaaccccucugcccuggcuuauccgaacuuuggcagugggcuugagugauuauaaauugguucccccaauuugccuacuguuuuugaaugggcagaguaaaaaaagugguguuaauacucuggauccgaaaaaaugcaugaaggaaaguaaaagaauggcagugcccagccuggugccauccauaaucuccguucucaagcuuuuaauacugucucaaaaaccguggagguucaaacucacugggaauuuacuuuucagucaauugacaacccauucaggaucuuccugaaucccugguggccuccacaacaaaaagcacaaagcccccugccgaggcagccuugggcccugcggcagccgccccaccucuggaguucugcuggggaggggaaggacgauuggauggcgccuuccagcugaggcccugcagagcucagugugcucaucccaaggcagugugcagggcuuugccaccuucaggagucacagauccaccgugguggccugcauugcccagcaugucaauccuucggcaggccugacaaauuuuaauaacugaccagcgaauugggaagcaguguggcaucgugcaaagaacacugagucaggagcuaggauuuucauucuaguucuuguacugucccuaccuggcugugugaucaucucgguuccugggcuccaauuuaccuaucugugaaggugaggaggguaguacuagugaucuccagggcccuuuccaauucugacaauccucaauuauauaaaaaugcuauaaaauccgugguauaaaauccaacucccaaacaggaagcgucaaggggacugggccugaggcacuugaaccuuaggcucuggccugggggucagggaugagaggaggggccuccucuuugcccucugcuuucccacuccugggcucuggccuggggguccggaauaagaggggccuccucuuugcucucugccuuuccaccccgaggcaggggcuggaccacgcugcccaggcaucucuuccuccagacccaacccucaaguuccacccacuagccuccccgccccggcuuuaggaccgcgggaacuguuccugcagcagccuggcuuugugaagagcagacaguagggcccggagucucccagcgggauuaacaucagcacagcuaguugggguccucccguccccgccucugcccucgcuccuccuuccuucagguccucccuccaccaccucacagcuuaucucugauacacgcauaauaaauaagacauuugcacauaagggugacugggucagcucuguccccgccccucccccuuucauauaaaagcauuaaauacaguuucaaaauaaaauacaaagagcaaaaaagggccugaucucggggccaccuguucuccacaggagaaugaaucuacacaucccucucggaccugccugggagaucgcggggccccaucccugccacacagggccugcggcugccacggggaaaagaggccgaggcccggccccaggcccugcggguugagaacggacgccgcauccaccgcggacaaagggggauggggauggggcgggaaucgaaggcugacugccgggaccgccugugccccgggcucccacggacuugguuuagggguaagcagagacccucggggcaagaggagcaaaggaaaaaagugcuaaucccuuuacaagagcuuuccuggagggcguggcagcggccugggaggagaguggggccgccgggcgcacgguucucacugagccugccggggagguaagcgcagcugguccagcccgggccccgggcgcguagccccgcccucgguccaacgcgccuucccaccccgggaaggcucccgagcccugcggcccagccucccgcuggaagccccaguccgcagccggggccuccgagaggccgagaaucccaauuagggaagggcagccagcagcccccaagccgggagccgugccugccagcgugcaaggcugcagggaacugggcccccagccagggccagagccagagcccgcacggccccccuucggcccuaauacugacugacggcgcccccagucccggccugcggagaacccccucgcggggugcggccgggagcgcucggcgcuaacacguggaggccacugaggauucucggaaaacgugggcccugcgcggggagggcagggcuccgggccgaugggagagugcgcuucccgcagcgcaccgacuggcucagggacccaaguggcaccgcgcagacgccgguggccccacccgaucccccgucuccgcccggcccggccagcggggggcgcggccgcgggaagcgcuaacaccggacgcgagggucucccagccgaagggccgggcgagcacagggcggggcggggccgauccgacccgacccgaccugacccgggggcccgcuaggccgcuacgcccgacacacagcgccagacuugagguccgcgccgccgucacgcggcgccggggcgggcggcccgaagcccucguggccguagcagcgcagcgccgccuccucguaggccuccaggauagucuggcgcuccucaggcgugaaguccauggagaaggggugcaccugcaggauguggcgcuugauggugcucaccuugagcguggccagcgcgcccccgcacaccauacacaccaggccgcgccggcugccgucguaguccaucagguacucgccccgccaccgcggcugguaguuccgccgcugcucccggcugcggggcgggggcggaggcgggggaggaggcggcggcggcaaggcgagucccccaggcuccuggccguccucuucguccuccucuucuucggcgggccgcuccaagggagcuccaggggacagcggaacgucgccuaaggagggacaaaggaccgcauuggcgacggcggggggcagcgggcugggccccgcgucucaucuccagucaccccaucuuugcccuucuaucccauccuccagucccuucugccccagcaacugcccggcucucccucuccgccugcucuggccccaccgcucaccccacuccuccuccuccuccucuggcuccuccuccucguccccuccccccucgucggaggcugcggcagugccgggggggauggggcccuggggggacucggggcggggcggccccagggccagcaggugggcggccuucucgcuccacucccgggcgaugagggccuggacaggcccgccgaggcgcguggagcccggguggcgccggcggauguggcgcucgauggugcucaucuugagcgaggccagcgcgcccccgcacaccccgcacaccaggccgcgccggccgccguccaacuccaugagguacuccagccgccagcgcuccuggggguggcggcggugggcgcggccccgcggcgaccggcccgggacccccgcccucucgcccucgcccuccuccagcuccuccuccuccucugcgggcccgggccucucagggacccagccagccucuuccuuuacgucuggggggcugagauccugagaggagggggcuccagcagcggaggccgagucccggcucuuuccggucagguccuggggggcgaggucaucgccuguuggggaaggggugagggagaggggcucagccugcuggcuggguugcccuugcccacucagagggguccauccuggcuccucaccccagccccaagcuagaggccccagucugucucugucugggggcagggggaaaguauguguguggagcaccagcuccuggccuucagcccucagcccuaagucccugccucccaguuuuggccacagaccccacuucagagccccaguaugagggggucucagccugggaugggccucgcaccugguggggacugggugagcucagacagcgccucgggcuggcccccccaggccugcagcagggcacugcgcugggggccgcugagccccagggagccagggugcaccuccagcacgugggcacggaugucguccaggugcaggcugggcagugcccggccacaggccaugcacaccagccgguucccccgcgggucauaguccaugagacacucggcccggaaccaguucugcagggacuccuucagccuccucuccaggcgccgggcccccagcccccugcugcccccggcccuccgggaggcugagaggcgcagacgccgagcccggggugccacugggcccccucgccgcuggcgccggcagcccccaccagcuggggcuuugccugaaaggguuggagggaaggaacugagacgcuggccccacgggagcauacccacuacagccaggucucccacaagccucucacucacuugggccccaggccuaaccuuugcccuucucuuccucucuccugaaauccuaacucccuaaacccuccucugcuagcauuucaagcaccacccacaccucccccagacuggaaucuagcccugucccuggccuucaccgucagccacaccucuccagcacccuccccuucccucacccaccccagccaggccucccugcuccaagccuuuccacugccugucacccaacuucucuccuugauacuucaaaaaccacagaauguacaagcugucauggacaucggagacccucucaccccacuguccuucccccaccuuuguauaauaagggcaauaaacagaccccacccagaggaggagcagugccuugcucaagaacaccagcuccuuggcagagcagcuggcccacugugccccacuggccacccaggccccugccuguacagaaucugcauuugcauuaccugggcccuugggcgggcaagcugggacaccggcccccuccuccuccuccucuucuuccuccuccuccuccuccucagcccccuggacccccaggcccucggccucuccgcaggcccccagccccaggugugcaucccagcuguugcugaugacuuccuucucccggggacuccaaugcaaggaguaggggugcuuuuggcggauguggcgcuugauggugcugagcuugaggguggccagggagcugccgcacaccaugcacaccaugccgugccgggcaggguugaaguccaucagguacuccagccgccaguggucgugguaguagcgccgguggucacggccagggaugcggcucuuuccaggccucgaggcccgggccucacaguggucugaauauuuccugccugaagaugcugguccccuggcccuggaggagggcaggggggcacucccccaggaccccaaggcacccccuuccagcugaagaucuugcccugaagaaggggaaagggagacaguuuuucaaucucugauuuccagggaaagaggcgagggcuuugauggugagcccugagaaagggagcugggggaggggguguuccggggcaggaaagggacggcaacagcaauaaaagggaugguagaagugggagccaaaacauuagcccuuuacaaagggcaaggacccuuuaagaggagaucaagaacaaaaggacgcagggcacuguggaaauagcucugacuuuuuaaaaaauaaggugagggccaaggagccaaccagcucuguaaggugcccuuucuggacaagagccguagggagaaagccaggagagcagcaggccagggcgguuccagcuggagcagagcaggcaguggggccagacaaacaaagggggcaucugucuacagccagggcugcacacgggacccacccaccuggggcccccgccaggagggccccacccacaggucuucucccuuuuuccaguaaugcuucaaauauagcuuccugagacucccauuuuggggaugggcuaggcauugucaguuccccaaaucuaggcccccacaugggagggauccccaagacaaagcugccaacaucuccagggaaaggaguuucugagacugaaacuucuccagauucuggaggagccaaugacccuguaaagggauggcaggagggccaccagagugacaacuaaugacacugcggcagggaguggccaccauccacugaagcccauuaagucuuucuggggcuuuauuugcugcucuggcagggagccggccacugcccagcagucagaagggcgggcacuggagaggccccacuaacccaaugguguucccugugccagacacccacccagagcaguccccuacccucccuacaguucccaccccucuugauuuagaaaaauggucuccugggcacacaggcagguucuggucauucucccaguggagaaucacaggguugggaaaacaaaagacaggaucagaaagggcuccugucacccuuguggaaguuuuuuuguuuuaguuuuuauuuaaguagauccauagaauccacuggcuucggagucauaggccuggguucaaguccuggcuucacugguaacuugcucugugaccuuugauaggucauguccgcacucugggccugagcuucuuugucugcaacgacacuggcuagcuggcuggucucuaagcauccuuccagcgcuggauccaggcuagucuaagguggauuggcccuuuaagagccgaaaaagggggaggagccgagguucuuuaaaaacaaaaggggauggggcguuucugggaggggagagaccgggaggggagccuggagauucgggcagagucucccuggccuggaggaaacccucaagggucuuaaggcgugacccugcagccgggaaaugagucaacagucuccuuugagagcgaacgaggaggacugguugguuccgcuagagcugacaaauuagggcaaaaaaaaauucugaaaagaagggaagggagaaugcaccggccggaggggugccugccuuugugggcgaacccaucgcuuuaaaaacugcccgcggugggaaaagauggugugggcccccggggcgcaagcgaugcacuuuccuagggagaaugugggagaaaagaaaaagggugcaugucucucacaaggccacgagacgagaggagcagcccgauuuaaaacagcagaguucggagcugagcucagcuccgcuggggaaaagcccccgaaggggacccagggucugggcggacuuuugagagaaagcccgauuagggagaccaccugggagucugaaagagaaaggggcgggggccaaaguccagccucgcuccguggcgcccugccccguggggccccucgggccuggcccccaaggcggggcgcugcgggcggcagcggggcccuuuaagggggaggcgagccgcccgagccccgcgagccgaccccgggagcugggcggggggcucccccgccagcccugcagccgcgcuccgcgcccaccagguggcgcccccggccgcccugcccgcgucccccgcuuuguucggcggcggagaggggccccgagccgcagcccucccuucccccacgccggggcccccgcccgggccgccggccccagcucuuaccgccuucgucuuccucuggcuccgcgcugccgcucgauccggcgggcggcagccgucggccccgugccgaggccacugcuggcccggggccgccccugccgccgcugcuccggcuccggugguccccgccgggcuccaugcgcugcgcugcggagcggggccccggggcggcggggcgcggggccgcggggccggcggcagcccgcgcggagcgcucgcugcgcggggccccggggcgcggggcgcaugcacggggcggccggccgcacggacggcaggcugcucgcucggcgg

SEQ ID NO: 18726 - RNA, 2422 nt, Homo sapiens
gccagcagucaagcgugccuguguacaugaugucagcugcaaagaauaaagacauggaguuagugacugaaggccgaugaaaaauccuaagauucacuaggcuaaauaaagcagagccccaccucuaagaacgucagcuuuaaauccaacauucacacauuagcaugggcaacacugaaauauuaaugcuaugaccacaggaauacagacuacccauuggucuuaaccucuaacaccauuuaagcacccucauucauaggcaucugaagggccagcucaaaggcaguuguggaacagacacagaugcuaucaaccccaucccuugacuuggacagacagccauuuuaaagguauguaucaccaguuuguggcagcagauugccccacgacuacaacuuuaucuucugcucaaguggaacuuacuuccuuugcgcccugacugcaucaucaugcggcggcgaacagugucaaauggauaggaagucaacccggcaacagcagugacagucugugcgaucauccagcugaugacgaugugaguguucuugggauccggaagcauuccugggaauaggaaagagaugcuuuuaccaaaaagcagaguuuuacugacuuccuuuccccacauccccuaaacacgucaucuguacacaaggguugcauuggaugaucuuggcuuccuuuagcaauuaaaaaaacaacucuuuagcucuuggacuguuagguugguacaaugcucuuuuaaacugucuccuaagaacacaacguuaaagcccacagcaaacuuacccuuugcagugucauagauaccgaaguaggcggcucgguagaugauaauacccugcacagacacguuaaagccuugguacaggcccuuaaucccaucagauuuguagaucuuaaccaggcagucaccgaggccucggaauucccuuucagcuccagcuuuacccacaucagcugcuagacggguacgggcaaaaucaagaggguacacaaaacacagggauguggccccugcggcaccacccgaugccagauucccugcaaaguagagccaaaacuggguucucuuguccacaccacccaggaagaucugcuuguauuuaucuuugaaggcgaaguuaagagccuggguggggaaguaucugaugacauuggccagguuaccgcgccagaaggacagaacucccugcuccuugggaauacggaccacgcagucuauaaugccuuuguauugcuuaucugcagugaucugcuugcuggcaugcugcaccuaacagacaggaaggaagccaacagggacaguuauaaccauggggaagggaaagagaagagcuuaugccaucucgaucaaugcccuuuaagguaggcuccccucucucaaaucuagucuucguauaucauacuggcuggacccucccaacccucugaggcugucacaggggaagaggugaucugcaccaguagcauuaagccuccaccccucugaguggagagggggcauccuccagcggacccgugaccuucagaccuaggagaaaggucauuaccucaaacccagguucagaggcauuagggcgagucccacauagggcgcggucaccuuggggaccgcagccuacgccucaagucuccugagcugcuuccgucucgcuccgcccccacuccgcucccagaggugacccgagcgccgccgccgccagcccuacacgcuagcccaggagcgcccucuagagccggcacuggagagcgcgcggcgcagggaggcaggcggagacgcggcggcagcggccgcggcugcgcgggggcggacguaaaaggcacacgcgcuucccggcgccggcuuccggcccggcgagguuugagcgcguccgcgggcugggaggccgcuggacccgggcgcauggccucccccgggcaguuaucuccuugccgcgaccuugaggucuucgguaagaacuggcguuccucuuucuaacgccggcuuucggccuucgcccuugacgcccaggcccggggaggccgucacucagaaacugcuccauccgaguccgccgccucggagaugccgagagccugguccugcccucugcccccggccccuuccuagacucacuacuucaggucacuaaaggcgccucccaccaguuugacuucuguucugccucugcgccccgcucuggccucuccuaagccgcuucccuggccaugucuuuagaguucgcuccccgccaccccucgggcgcccgccuucugugcgacccuuccccccacuuccugguugggcuccuggaucccaggacguaccugcagcagcagcuugacccgcucgaugggcgcuaccgccgucuuggagauggcugcggccacuccaccugccaggaaguccuuggcgaaggacacagcggcaucugucaug

SEQ ID NO: 18727 - RNA, 2422 nt, Homo sapiens
caugacagaugccgcuguguccuucgccaaggacuuccuggcagguggaguggccgcagccaucuccaagacggcgguagcgcccaucgagcgggucaagcugcugcugcagguacguccugggauccaggagcccaaccaggaaguggggggaagggucgcacagaaggcgggcgcccgagggguggcggggagcgaacucuaaagacauggccagggaagcggcuuaggagaggccagagcggggcgcagaggcagaacagaagucaaacuggugggaggcgccuuuagugaccugaaguagugagucuaggaaggggccgggggcagagggcaggaccaggcucucggcaucuccgaggcggcggacucggauggagcaguuucugagugacggccuccccgggccugggcgucaagggcgaaggccgaaagccggcguuagaaagaggaacgccaguucuuaccgaagaccucaaggucgcggcaaggagauaacugcccgggggaggccaugcgcccggguccagcggccucccagcccgcggacgcgcucaaaccucgccgggccggaagccggcgccgggaagcgcgugugccuuuuacguccgcccccgcgcagccgcggccgcugccgccgcgucuccgccugccucccugcgccgcgcgcucuccagugccggcucuagagggcgcuccugggcuagcguguagggcuggcggcggcggcgcucgggucaccucugggagcggagugggggcggagcgagacggaagcagcucaggagacuugaggcguaggcugcgguccccaaggugaccgcgcccuaugugggacucgcccuaaugccucugaaccuggguuugagguaaugaccuuucuccuaggucugaaggucacggguccgcuggaggaugcccccucuccacucagagggguggaggcuuaaugcuacuggugcagaucaccucuuccccugugacagccucagaggguugggaggguccagccaguaugauauacgaagacuagauuugagagaggggagccuaccuuaaagggcauugaucgagauggcauaagcucuucucuuucccuuccccaugguuauaacugucccuguuggcuuccuuccugucuguuaggugcagcaugccagcaagcagaucacugcagauaagcaauacaaaggcauuauagacugcgugguccguauucccaaggagcagggaguucuguccuucuggcgcgguaaccuggccaaugucaucagauacuuccccacccaggcucuuaacuucgccuucaaagauaaauacaagcagaucuuccugggugguguggacaagagaacccaguuuuggcucuacuuugcagggaaucuggcaucggguggugccgcaggggccacaucccuguguuuuguguacccucuugauuuugcccguacccgucuagcagcugauguggguaaagcuggagcugaaagggaauuccgaggccucggugacugccugguuaagaucuacaaaucugaugggauuaagggccuguaccaaggcuuuaacgugucugugcaggguauuaucaucuaccgagccgccuacuucgguaucuaugacacugcaaaggguaaguuugcugugggcuuuaacguuguguucuuaggagacaguuuaaaagagcauuguaccaaccuaacaguccaagagcuaaagaguuguuuuuuuaauugcuaaaggaagccaagaucauccaaugcaacccuuguguacagaugacguguuuaggggauguggggaaaggaagucaguaaaacucugcuuuuugguaaaagcaucucuuuccuauucccaggaaugcuuccggaucccaagaacacucacaucgucaucagcuggaugaucgcacagacugucacugcuguugccggguugacuuccuauccauuugacacuguucgccgccgcaugaugaugcagucagggcgcaaaggaaguaaguuccacuugagcagaagauaaaguuguagucguggggcaaucugcugccacaaacuggugauacauaccuuuaaaauggcugucuguccaagucaagggaugggguugauagcaucugugucuguuccacaacugccuuugagcuggcccuucagaugccuaugaaugagggugcuuaaaugguguuagagguuaagaccaauggguagucuguauuccuguggucauagcauuaauauuucaguguugcccaugcuaaugugugaauguuggauuuaaagcugacguucuuagagguggggcucugcuuuauuuagccuagugaaucuuaggauuuuucaucggccuucagucacuaacuccaugucuuuauucuuugcagcugacaucauguacacaggcacgcuugacugcuggc

SEQ ID NO: 18728 - RNA, 6907 nt, Homo sapiens
accaugcaggggugacuuuuauuugaaggcagaaaacacccuauuuggggguucacucauaaucugcaacaguuuguuuguuuguuuuuaaaaaagagaaaaaucagaagccaaagggccugggaaggaaaggagaaggguaguggguccaugucaggcugaagucaggccgcguaggggaagcggagcagcagcccuucgugaggcuccaguuucaggcguuccagcucaagaggggagcccuccucacggccuggcugggugcugagcaggaggucagccuuggcuggcaggcuggcgcuggcaggcaggucggaggccugcaguccagccgagaggcccacauccccaaaguuaagcacuaccagaaaacgcucauucuggucccaguggcggauauaggagaagaguccaggcccagcggagaacgcguggaaguccccaugcaguagggagcgcuccuuacuccgcuggucacucagccgccggaacaaggaaaggagggagccagggucuucacucuggcccuaagaaugauaaaaacauagcagaagcgugugaggggcuccccuggguacagacuucuacaagcccagcccacccuccaccggucaguuucuacccaucuagaacucuuaccuucacagucauguuggcacuuacagccccugggaugucagggaagcuggacucaucccacagcaugacuggagccuccauaggcugaaaagcagagaaaauaggacuuuaaaaaggccuggggucaggcaugguggcucacaucuguaauuccagcagucugggaggucaaggccaagaggauugcuugagcccaggcauuugaaaccagccucagcaacauaaugagcccucaucucuacuacaaaauuuuuaaaaauuagcuggguguaguguuacaucccuauagucccagauacuggggaggcugaggagggaggaucacuugaacccaggaguuugagcuugcagugagccaugacuccaccacuguacuccagccugggcaacagagugagacccugucucaaaaaaaaagcccugggcccacugucccguaucccucuucccauucacauccucaucaauauauaaccuccccaacucaugucuggcuaacuuuuuuuuuuuuuuuuuuuugagacggagucucgcucuguucaggcuggagugcaauggcacgaucuuggcuuacugcaaucucugccuccuggguucaagcgauucuccugccucagccuccccaguagcugaccauaggugugcaccaccacacccagcuaauuuuuuuguauuuuuaguaaagacgggguuucaccauguuggcuaggcuggucucgaacucuugaccucaggugauccacccaccuuggccucccaaagugcugggauuacaggcauaagccacgacacccggccuggcuaacuucuacuggaugagugaggcaggcucccaccucaggguccucacacauacacuguugccccucagccaagagcucccagauggcugccagccagcucucucacuucccucagguaucugcuugguuaucuuaccaggucuccuauggcuacucucuauaaaacaagccccaucauccccuagucucuaggcuccuuaccccgccuucuuuugcauagcacugaucagcagcuggcguuuuauuuaugcauaucuaauuaucuaaccaccuccagcucucuugugcaaugcuguauccucaguguaacagacagaaauuauucuauaaacaucuguggaauaaaugaauaacugguucuauaaacaucaugcugauggccgggugcaguggcucgcaccuguaaucauagcaguuugggaggccaaggugggaggaucauuugcacccaggaguuugagaacagccugggcaacauagugagaccacaccucuacaaauuuuaaaaauuagcuguggccaggcacaguggcucacaccuguagucccagcaauuugggagaucagggcaggcagagcgauugagcccaggaguuggagaccagccugggcaacaacagugaaagccugucucuacaaaaauuagccgggcaugguggugugugccuguauucccagaccaccuguauucccagcuacuugggaagcugaggcaggaguaucacuugaacccaagaggcagagguugcagugagacauaaucgcaccacugcaauccagccagaucaacagagcaagaaccugucuccaaaaaaaaaaaagaucagcugggcaugauggcacgcaccuaucuaugguacauaucccagcuacucaggaggcugaggugggaugaucacuucggccugggaggcggaggcugcaaugaaccaagaucaugccacugcacuccagccugggcgacauagggaaaugcugucuuaaaaacaaaaacaaaaaacaaacaaacaaacaaaaaaaaaaagucggggaucaacaguaacccuguaucuaaagcuagugaaugccuuuguaguaguaucccuaccauguauuucuuucuuucuuuucuuuucuuuuuuuuuuuggagaaggagucucccucugccgcccaggcuaaagugcaguggcacaaucucaguucacugcaaccucugccuccagguucaagcgauucucuugccucagccuccccaguagcugggacuacaggcgugcaccaccacaccuggcuaauuuuuguauuuuuaguagagacuggguuucacccuguuggcuaggcugguuucgaacuccuuaccuccagugauccacccaccuuggacucccaaagugcuaggauuacaggcaugagccaccgugcccagccacugccauguacuucuccacuuauuuaucuggcucccucacuaaacuaugagcuccugagggcacagagccuagcacaguacccacuguccaaagaauaaaggaaugaauaaaugaaugguggcuaccauagcaaacaucugccagguaccaggcauuaccauuaaaaacaugcccucauuuaauacuaaccacccuucaagaaaugcaguaacacaagggaugaccaaaauucagaaagguaaaauaauuugcccaaagccacauagccacucagcuacugacuaagaaucaaacgcguuuucaccccaaggcucacgucuaugugccgccauccccagaaucaucauuguaagauggauaaacaaccucccugugacagaaagacagcaagcaguaccuguccaggaagggcagcugcauccaggccaaucucauccccguagcugaaaacaggggucccuggcagggugaagagcaucagcugguagagucggagaaguugagccggcaagaaggaagucaggagccuugccugagacaacuacagggagagacacuccagugagccccauaacccaccucugccucugucucccaacaacccuuucuucucccaucugcccccuuucccaccagcaugguacucacacuccagcugcaccagcgauugccaguggcauucaaauacugugugacuagggauuuuguaugcuccccaguagaaccagaaucagacagguaugagcuagucaacagcaagucuuuguuggauucgaguaggcucaggaucugcugaaggucggaggaguuaguccccgcaaucaagagccugcagaggggagggaggaguucaagguuagcacaagaaagaauggggccaggcgcaguggcucacgccuguaaucccaacacuuugggaggcugaggcggguggaucacuugaggucaggaguucgagacuggcuugaccaacauggagaaaccccgucucuacuaaaaauacaaaauuagccaggugugguggcccgcgucuguaaucccagcuacuugggaugcugaggcaggagaaucgcuugaacccaggaggcagagguugcagugagccaagaucacgccaucgcaccccagccugggcaaaaagagcggaacuccaucucaaaaaaaaaaaaaaaaaaaaaaaaaaaaaaaaaaagcuaaagaaagaauaaagguaaagaaaaugcucuagacuaggaauccccccuucuuaggccuagcacuccacugagggguucccacauuggagcugagucagcagaauggcuccugcacccaccugucuucacugaagcccuuggugauauuuugccacucagccaagaaugaggaugcauccuagaaagaaaaaagcagaaucaaggaccagagaauauuaugaggcucuagcugagucccucuguucucgcccaagcuuugucccuaauguggaaagggaacucaccuucagauucucuaugucccgaaccuggaacccauccacgccagcuugcagccaaaacuccagagcauccuauagggggcagaagaauaaaggacagacaucaguucucaggaaaaggcucagaaaauuccagcccacacuaaaccucacccaccacacacuuccccgggagcuggggagaguccugugccuugccugggucuuccccaccugcacuacaaaggcuuagccuuuggaccccuccagcucuacccuuccacucauuuucuuagugcuacagcauuuuacuucucauucuugccucuggcaaaucacacagcuucaacuuugaaagccacagaaaaggccccagagaaaagguauguccauaaacauaacuucguuuaacacuuagcauuggaauguuagcauaccuauuuuagagaugaagaaacagacccagagaagcagggagacgcguccacagucauaaucagugagcagcagacaggaucuaaaaugucagucaagauccccccucucccaguuuccugaggccuggggaaggugugaguacaauaacugcucagagcaaggccaaggaugaaagauugaaauucaaagcauagccccagggcaguuuagauuugaaaagaggccagugcugcugaauggaauccuggcaguccugcacacacuguggaacuucacccccauucuccuuuucuucccuuucucugggccauguacucucuccucuggucuccauuuccaucugaggguaccgccccucaugccaaaccauccaaaaacauucccucaucagcaacuuuuaaaggguccccuaguaacuggcaaggccuaaacuggaugaucccgggguccuacccaaaugcugggaguccagaauucuaucuuagaaucacagcuaccagcagugucaguaucugcuuccauuuuuguucuacccauucugaacaggucaguguccuaggacccagacaucaggagcuaggugacauucaaagcccuacuccuagccugcuggguacacauuugaaccuauggcaaauuauauaccuuguaugguuauacagagaauuagaaaacaucuauaaaauacuuggcauagagucccagacacauaggaguaccccagugcuuauaauuucagacugggcucuauuccaaacacaucaaacaagaacugggaaaccagucaggacaggauucucacagagaaagggcuuccucucccaaaagaaagaaaaaucaaacuuccagacugacuucugagaaggucccuuccuggcacugucucauccucagagucaaggaaauaagaaaaauaagaggucagaaaaggaacaagaaaaacaggugugcuauuggccuauccuuuggcuauaggaggaggcauuccuccuugguccuaaggagcaaagggacccucagcuggagucaggcugggucuacagggcuugcugugaaaggacugucccagccccagcaucugacuuccaccagccaucagcuccaacacucaccuucaccuugguggccacagugucaaccugaguggagaaccacgaguucucaccccgguaguugggaguaagguccagaaugacacggaugccuaaaacaacggaggaagacgcaaucaugagacagucuaugaguuaagggaaaauaaggaaaucacaaaugcaagucacugaguguuuccuauguauuacuugguacaaaagcuugaauuugaacccgggcaaaauucauuccauugaaacagaugugagcaaggaagggccuuaagauaugggaaggcaggccaggcgaguucaaaaccagaccggucaacauguugaaaauugucucuacuaaaaauaaaaaaauuaucugggugugguggcacacggcuguaguaccagcuacucaggaggcugaggcacgagaaucgcuugaacccugggggaggaggcugcaguaagcugagaucguuccacugcacugcagccugggugacaagagugagacuccaucucaaaaaaaaaaaaagauauuggaaggcagaaaguuuauagugcagagaaguggccccuguguuccccacucccaaagugaaccuuuuuaaacaugugucuauaucgagucguaaaacaauauuugggauuccccccccccaaaaaaaccuacuguuuuacaaguuuaaaaccacugguuuaguaaauaucuauauuuugcaaauaagggcacugaagcccagaaguuaaaugaccugcucaagauuccacagccaaguagaaagcccccagacgacuggacaaauccauuuuaggcugaagacuaacaaaucuccccucuaccugcccuaggaaaacucagagccaguuagcaggaaaccagacaaaaguucuagccuacuuuuccucuggccaaguccuuucuagcuguuuccuugggaaccccaggauacccacucuuuuuuuuagccgauugcaagagacugucaaaaucuuccuuggagccaaaauuggggucgaucugcagcaagucagucugagcgacaucauccuucugguucuugugaauugga

SEQ ID NO: 18729 - RNA, 7311 nt, Homo sapiens
cacgcugcgccggaagugugaacugucugccuccaggcuuugucauggcggcugcugcugcacgcuggaaccaugugugggucggcaccgagacugggaucuugaaagguggguggcaggcucgggcgucgggaagugcaggggugcacucgcgccccuggcgugacugacgccuucgucucucagggguaaaucuucagcgaaaacaggcggcgaacuucacggccggaggacagccgcggcgcgaggaggcagugagcgcccuguguuggggcaccggcggcgagacccaggugaguggccccuggucgggccggagcugggggccuggggcgcagcagccucgcucuccucgccaucuugcccuucuuugccgcagaugcuggugggcugcgcggacaggacggugaagcacuucagcaccgaggauggcauauuccagggucagagacacugcccgggcggggagggcauguuccguggccucgcccaggccgacggguaagaccaauccccucgcuaaacucagggccgaagggagagcguugaugcucccugaggauacuggaaugauggcgacaggcaaacucuuagugacacggcuuugaaugggugacagggaccuggguuucugccuuauguaguucauaccuguaacacacauuuauugaacaccuacugaauuccaggcacugggagaaguacaggggcugccgguaaaauuucugccuucaaaaaguucucauccucuaagguuuuucaccugacuccauuauaauccucuaaguaaccaugggcaagucauuuaauaguuuuguguguguguguguuuguuuuuuguuuuuuuuuuuuuuggagacggaguuuucgcucuuguugcccaggcuggagugcaguggcgcgaucucggcucacugcaaccuccgccucccggguucaagcgauacuccugccucagccucccaaguaccugggauuacaggcgucugccaccacgcgcggcuauuuuuguaucuuuaguagagacgggguuucaccguauuggcuaggcuggucucgaacuccugaccucaggugauccaccugccucggacucccaaagugcugggauuacaggcgugagccacugugccugcuugucauuuaauaguuuuaagcaaggcugggugugguggcucaugccugucaucccagcacuuuggaaggccgagauagguggaucacuugaggucaggaguucaagaccagccuggccagcacgguaaaaccccuucucuacuaaaaaaauacaaaaauuauccgggugugguggcucaugccuguaaucccagcuacuugggaggccgaggcuggagaaucgcuugaauccgucccgcagagguugcagugagcagagaucgcaccagugcacuccagucugugaaacagagcaagacuccaucucaaaaaaaacaacaaaaaaaguuuuaagcaugcauucauuaauucauuauuaauucauuuauauuuuuugagacagagccucacugugucaccuaggcuugagugcaguggugcauucauggcucacuacagccucaaccucccggggucaaacgauccucccgccucaaccuccugaguaccugggaccacaggcaggugucacccugcccagcuaaauuuuuaaguuuuuuauagagauggggucucacugugugcccaggccagucucaaacuccugggcucaacuugagcucaaccaccaacaaggugauguagcucugaaagcaaagauuaggaaggugcuaagugguuggaugacuggccuugcuuucuuccaaagaugaugaaagagggcugugaagcaggcugcauagguuugguggugguaauucugacaggugaggucuggaaagccugugggggggacuggaugucugaacugguucuugagggauggguagaauuuugacugguggagaaggggauaaggguauucuagaaagaggguacugccugggagaggccaaggacuggaggcaugcuacaggguacauaaauaggauaaauagcauuugauuuggaaguugauaacaaggaagcguuuuuuuuuuuuuguuuuuuguuuuuuuuuuauauacggagucucacucuguugcccaggcuggagugcaguggcacagucucggcucacugcaacuucugccucccaggcucaagcgauucucuugccucagccuccugaguagcugggauuacaggcauccgccaccacgcccagcuaaguuuuuuuuguauuuuuauuagagacaggguuucacuauguuggccaggcuagucuggaacuccugaccucaggcaauccgcccaccucagccucccaaaaugcugggauuacaggcgugaaccacugcacccggccaaggaagcauuuuaauacaagaugaacacuauauuagguugggauuaaauguaaagggcuuuaagugcuagguugagagaugugcacuuuuauugguguuggugaguuauucauuuauuguuuuuguuuuucugagagacggagucuugcucugucacugaggcugaagugcaguggcaugaucucggcucacugcaaccuccaccucccugguucaggcgauucuccugccucaacuucccaaguagcuaggacuacaggcauguaccaccacacccagcuaauuuuuguauuuuuuaguagagacaagauuucacuauauguuggccaggcuggucuggaacuccugaccucaggugaucugccugccuuggccucccaaagugcugggauuauaggcgugagccacugugccuggccaaguuaucaguuuuugaauaggaaguaccauagucagcacugggagccuguaggaguauggaggauggauuggagacagcaacugggagacuuuugccacaggucaggcaagucgauacagagcccgaacccagcuagggaggguuggcaggugugagaaagaacauaggcgcaggcugugcagauccuggggagagacuugcuuggacuucucgggagggauauuuuaagcaagagacugacauuuagugccugaaacucagagcaaggaacccaagaaguugguguuugacuuugaccaagcccuaaauucagaccagcccuaguaagcaacucaagauucagacagaccaguacagccagaugcuagacauagcugugaacagcaaaagcacucuggaauaucacagaguugauuucuagcugugguuguaacauagcugaguggcaaauuaguuucucagcgcuucuauuuccucacuugguaaacccucacccuguugagaaaguugaauuaacagauuaggaagcuggaagcugucaagcccugccuagagcccagugaccuagaggcuuccuucuaaacuggacuguuaguagggaaucugguugauaugaguuuggggccuagagaauacuuuuauacuuuuuuuuuucuuuaaacauuagucaacuguaguaguaaggaggagagaaagauuagaacaaggaguuuaagcacuuaaaaaaucccaacucuauccuuucucugcagcacccucaucacauguguggauucugggauucucagagucuggcaugacaaggacaaggacacauccucugacccagugaggcuccccugcccugaugguugggggaggugggcugggguaggugccuaaugaucacgcuggggaagggaggauuaaggacucuggaacggacucuuaucuccuauucuuuacagcuccuggaacugagagugggcccugggguguguaggaugcgccaagacccagcacacccccaugugguugccacaggugggaaagagaaugcuuugaagauaugggaccugcagggcucugaggaaccuguguucagggccaagaacgugagugacaagagugugaaggagcuguuccugaagucgagggaggcugaggccacugacgaugcauuagagacuagauggacuuagggggcgaaggagggcugaaaacaggggcacaucgagccccccauagcccuguccuccaucugcccaccccaccaggugcggaaugacuggcuggacuugcggguucccaucugggaccaggacauacaguuucucccaggaucacagaagcuugucaccugcacaggguaccaccagguaaggugucaccucacaccugccuucuccugggauaaagcagccuccuggagaaauggcccccacgguuugacacaacugcucuucucaccauucugaguucagaggagcaagcgcuuccccgucuguuccaacccugucccugagcccaugaccuuccucuacuguauucuaggguggaguuuccugaacuaugccuguuuuccucccaccuggaagagaggaaaggagaguggauccccuucacugugggaauuauagggugcaggugucagaggacauugggcuggguguuaagagaacuggguucugguccugaugcagccucucugauuugcuuugggacccaggccugagccucccaucucuggccucagcuccucagcuuuacaggaagggcccgaauggggaaucuuuaugguuugucucauuugaggucuugagacacgggcggggcugggucacuguauuuguccuauuuucuuugcuucugcacauugaagucugaucuuggucauaugccucugcucaaaacacauaugagggcauccucuuuccuccuucauucaggcuaaccccugcuugaaauuuagcaccuacugacuacuagaccaacuugcuuuucugucccuccauuuccccuagaugggaguauggggggauggaaugcucacacacuuccaaccuaggggaccucuccccucagcucuguccauuuaugcugcuaagcagcucuccugacacccugaugcucagagaagaggcauacaucuaagaugagaaaguuucugggaguggaucauaaauaagaaagcagugugcagggagggggugaggaugcagagacgccagaggguaggugcagggugaggauacuuuugugaugcuucagccuuccucuagguccguguuuaugauccagcauccccccagcgccggccaguccuagagaccaccuauggagaguacccacuaacagccaugacccucacuccgggaggcaagugaguguuuagaggggaaggggugggaggguggggcuugagaagggcuccaggagguuacugcugaucccacuugccucuggucucauccucagcucagugauugugggaaacacucaugggcagcuggcagaaauugaccuucggcaaggugaguggacuaggguacauugggggaaaggaaggagcagggagaagggucaggauucccucuaagguggugcaguggggccagugaggccucauucaggugccagauugccuggguuuaaauccugguuucccuaaaagcuguaugaccuuaaacuaauuauuucaacucccugugccuuaguuuccucaccugcgaaauggaaauauuaguagaagcuccagucucaggguuuuguugcagauuaaauguugaaauggaaagugauuggaacaggaaacaaugaaugguugguuauuggccagccaguuaucacggaugcuuccccccuucucuagggcgucuacugggcugucugaaggggcuggcaggcagugugcguggguugcagugccacccuucaaagccucuacuagccuccuguggcuuggacagagucuugaggauacacaggauccagaauccacggggucuggagcauaagguaaguugucucucccaccuccaacucauggucuuguggaggccccgccuccugugcccuccguucauguuucugucucagcaugccuggcuccuuaaggucccucaucuuuugcagguuuaucucaagucucaauugaacugccuccucuugucaggcagggacaacugggaggugagcaguugggcccgggaaugugggagccaagggcauagaugugaggaccucccuauggagaggaaaaggaggcagcuggaaugcagacuugggacuaucuguuuaccugccuggucacuuaauuucucugagaggcauuaacaguuaaaauccugagaggguuauugccaacagcauggaugggguugcuuucuaggagcagggaauaaagguggugguacccagagggauucuuucucagccagggucuccuucccuguggguuugucccugugccccugacuacuuuucuuuuuuuuuuuuuuuuuuuuuuuuuuuaaacuucuuuuuguggagauggggucuccuuauguugcccagucuggucgcuaaguccugggcucaagcaauccuccugccuuggucucccaaagugcugagauuacaggugggagccaccgugcccggccccccugacuccuaagcuuucuucccacucaccaggaugagccccaagagccucaagaacccaacaaggugccccuagaagacacagagacagaugaacuuugggcauccuuggaggcagcugccaagcggaagcucucggguuuggagcagccccaaggagcucuccaaacgagacggagaaagaagaagcggccuggguccaccagccccugacgccccugugcccacuuuguaaauaaacugcugaacacccaccaugacccugagccuuuugugaugggagaaaggaaugagggguagcuuggggugggggcugccugagcuggggcgacgggauaucugaugucacaaaagccgggccuggaggcaggcaggcuggcguggguggcacggaguccagggccacgcggggccaugggcugcugccaagacaaggacuuugagaugucugaugagcaguccaaggaggaagagucugaggacggcagggaagaugagaccacagacacacaaagagggcccagggagugugagagggggcuucccgaggguaggggugagcucagaggccucgucguccccucaggcgccgaagauaucgacuugaacuccccggaccauccgaaucacaagucgaacgaaagccuucugauuaccgugcuguggcggcgacuauccacguucggucgucggggcuccucgcggccaagcaagaggcaaccagaccagauucggaagcaggagaguccgauccgagaaggcaaccaggaggagccggagaagggaugaccccagaccugcucucaguccgccccaaccuccagagaauaaaauuucuaacguauaccugcacgaccacuc

SEQ ID NO: 18730 - RNA, 7311 nt, Homo sapiens
gaguggucgugcagguauacguuagaaauuuuauucucuggagguuggggcggacugagagcaggucuggggucaucccuucuccggcuccuccugguugccuucucggaucggacucuccugcuuccgaaucuggucugguugccucuugcuuggccgcgaggagccccgacgaccgaacguggauagucgccgccacagcacgguaaucagaaggcuuucguucgacuugugauucggaugguccggggaguucaagucgauaucuucggcgccugaggggacgacgaggccucugagcucaccccuacccucgggaagcccccucucacacucccugggcccucuuugugugucuguggucucaucuucccugccguccucagacucuuccuccuuggacugcucaucagacaucucaaaguccuugucuuggcagcagcccauggccccgcguggcccuggacuccgugccacccacgccagccugccugccuccaggcccggcuuuugugacaucagauaucccgucgccccagcucaggcagcccccaccccaagcuaccccucauuccuuucucccaucacaaaaggcucagggucaugguggguguucagcaguuuauuuacaaagugggcacaggggcgucaggggcugguggacccaggccgcuucuucuuucuccgucucguuuggagagcuccuuggggcugcuccaaacccgagagcuuccgcuuggcagcugccuccaaggaugcccaaaguucaucugucucugugucuucuaggggcaccuuguuggguucuugaggcucuuggggcucauccuggugagugggaagaaagcuuaggagucaggggggccgggcacgguggcucccaccuguaaucucagcacuuugggagaccaaggcaggaggauugcuugagcccaggacuuagcgaccagacugggcaacauaaggagaccccaucuccacaaaaagaaguuuaaaaaaaaaaaaaaaaaaaaaaaaaaagaaaaguagucaggggcacagggacaaacccacagggaaggagacccuggcugagaaagaaucccucuggguaccaccaccuuuauucccugcuccuagaaagcaaccccauccaugcuguuggcaauaacccucucaggauuuuaacuguuaaugccucucagagaaauuaagugaccaggcagguaaacagauagucccaagucugcauuccagcugccuccuuuuccucuccauagggagguccucacaucuaugcccuuggcucccacauucccgggcccaacugcucaccucccaguugucccugccugacaagaggaggcaguucaauugagacuugagauaaaccugcaaaagaugagggaccuuaaggagccaggcaugcugagacagaaacaugaacggagggcacaggaggcggggccuccacaagaccaugaguuggaggugggagagacaacuuaccuuaugcuccagaccccguggauucuggauccuguguauccucaagacucuguccaagccacaggaggcuaguagaggcuuugaaggguggcacugcaacccacgcacacugccugccagccccuucagacagcccaguagacgcccuagagaaggggggaagcauccgugauaacuggcuggccaauaaccaaccauucauuguuuccuguuccaaucacuuuccauuucaacauuuaaucugcaacaaaacccugagacuggagcuucuacuaauauuuccauuucgcaggugaggaaacuaaggcacagggaguugaaauaauuaguuuaaggucauacagcuuuuagggaaaccaggauuuaaacccaggcaaucuggcaccugaaugaggccucacuggccccacugcaccaccuuagagggaauccugacccuucucccugcuccuuccuuucccccaauguacccuaguccacucaccuugccgaaggucaauuucugccagcugcccaugaguguuucccacaaucacugagcugaggaugagaccagaggcaagugggaucagcaguaaccuccuggagcccuucucaagccccacccucccaccccuuccccucuaaacacucacuugccucccggagugagggucauggcuguuaguggguacucuccauagguggucucuaggacuggccggcgcuggggggaugcuggaucauaaacacggaccuagaggaaggcugaagcaucacaaaaguauccucacccugcaccuacccucuggcgucucugcauccucacccccucccugcacacugcuuucuuauuuaugauccacucccagaaacuuucucaucuuagauguaugccucuucucugagcaucagggugucaggagagcugcuuagcagcauaaauggacagagcugaggggagagguccccuagguuggaagugugugagcauuccauccccccauacucccaucuaggggaaauggagggacagaaaagcaaguuggucuaguagucaguaggugcuaaauuucaagcagggguuagccugaaugaaggaggaaagaggaugcccucauauguguuuugagcagaggcauaugaccaagaucagacuucaaugugcagaagcaaagaaaauaggacaaauacagugacccagccccgcccgugucucaagaccucaaaugagacaaaccauaaagauuccccauucgggcccuuccuguaaagcugaggagcugaggccagagaugggaggcucaggccugggucccaaagcaaaucagagaggcugcaucaggaccagaacccaguucucuuaacacccagcccaauguccucugacaccugcacccuauaauucccacagugaaggggauccacucuccuuuccucucuuccaggugggaggaaaacaggcauaguucaggaaacuccacccuagaauacaguagaggaaggucaugggcucagggacaggguuggaacagacggggaagcgcuugcuccucugaacucagaauggugagaagagcaguugugucaaaccgugggggccauuucuccaggaggcugcuuuaucccaggagaaggcaggugugaggugacaccuuaccuggugguacccugugcaggugacaagcuucugugauccugggagaaacuguauguccuggucccagaugggaacccgcaaguccagccagucauuccgcaccugguggggugggcagauggaggacagggcuauggggggcucgaugugccccuguuuucagcccuccuucgcccccuaaguccaucuagucucuaaugcaucgucaguggccucagccucccucgacuucaggaacagcuccuucacacucuugucacucacguucuuggcccugaacacagguuccucagagcccugcaggucccauaucuucaaagcauucucuuucccaccuguggcaaccacaugggggugugcugggucuuggcgcauccuacacaccccagggcccacucucaguuccaggagcuguaaagaauaggagauaagaguccguuccagaguccuuaauccucccuuccccagcgugaucauuaggcaccuaccccagcccaccucccccaaccaucagggcaggggagccucacugggucagaggauguguccuuguccuugucaugccagacucugagaaucccagaauccacacaugugaugagggugcugcagagaaaggauagaguugggauuuuuuaagugcuuaaacuccuuguucuaaucuuucucuccuccuuacuacuacaguugacuaauguuuaaagaaaaaaaaaaguauaaaaguauucucuaggccccaaacucauaucaaccagauucccuacuaacaguccaguuuagaaggaagccucuaggucacugggcucuaggcagggcuugacagcuuccagcuuccuaaucuguuaauucaacuuucucaacagggugaggguuuaccaagugaggaaauagaagcgcugagaaacuaauuugccacucagcuauguuacaaccacagcuagaaaucaacucugugauauuccagagugcuuuugcuguucacagcuaugucuagcaucuggcuguacuggucugucugaaucuugaguugcuuacuagggcuggucugaauuuagggcuuggucaaagucaaacaccaacuucuuggguuccuugcucugaguuucaggcacuaaaugucagucucuugcuuaaaauaucccucccgagaaguccaagcaagucucuccccaggaucugcacagccugcgccuauguucuuucucacaccugccaacccucccuagcuggguucgggcucuguaucgacuugccugaccuguggcaaaagucucccaguugcugucuccaauccauccuccauacuccuacaggcucccagugcugacuaugguacuuccuauucaaaaacugauaacuuggccaggcacaguggcucacgccuauaaucccagcacuuugggaggccaaggcaggcagaucaccugaggucaggaguuccagaccagccuggccaacauauagugaaaucuugucucuacuaaaaaauacaaaaauuagcuggguguggugguacaugccuguaguccuagcuacuugggaaguugaggcaggagaaucgccugaaccagggagguggagguugcagugagccgagaucaugccacugcacuucagccucagugacagagcaagacuccgucucucagaaaaacaaaaacaauaaaugaauaacucaccaacaccaauaaaagugcacaucucucaaccuagcacuuaaagcccuuuacauuuaaucccaaccuaauauaguguucaucuuguauuaaaaugcuuccuuggccgggugcagugguucacgccuguaaucccagcauuuugggaggcugaggugggcggauugccugaggucaggaguuccagacuagccuggccaacauagugaaacccugucucuaauaaaaauacaaaaaaaacuuagcugggcgugguggcggaugccuguaaucccagcuacucaggaggcugaggcaagagaaucgcuugagccugggaggcagaaguugcagugagccgagacugugccacugcacuccagccugggcaacagagugagacuccguauauaaaaaaaaaacaaaaaacaaaaaaaaaaaaacgcuuccuuguuaucaacuuccaaaucaaaugcuauuuauccuauuuauguacccuguagcaugccuccaguccuuggccucucccaggcaguacccucuuucuagaauacccuuauccccuucuccaccagucaaaauucuacccaucccucaagaaccaguucagacauccagucccccccacaggcuuuccagaccucaccugucagaauuaccaccaccaaaccuaugcagccugcuucacagcccucuuucaucaucuuuggaagaaagcaaggccagucauccaaccacuuagcaccuuccuaaucuuugcuuucagagcuacaucaccuuguuggugguugagcucaaguugagcccaggaguuugagacuggccugggcacacagugagaccccaucucuauaaaaaacuuaaaaauuuagcugggcagggugacaccugccuguggucccagguacucaggagguugaggcgggaggaucguuugaccccgggagguugaggcuguagugagccaugaaugcaccacugcacucaagccuaggugacacagugaggcucugucucaaaaaauauaaaugaauuaauaaugaauuaaugaaugcaugcuuaaaacuuuuuuuguuguuuuuuuugagauggagucuugcucuguuucacagacuggagugcacuggugcgaucucugcucacugcaaccucugcgggacggauucaagcgauucuccagccucggccucccaaguagcugggauuacaggcaugagccaccacacccggauaauuuuuguauuuuuuuaguagagaagggguuuuaccgugcuggccaggcuggucuugaacuccugaccucaagugauccaccuaucucggccuuccaaagugcugggaugacaggcaugagccaccacacccagccuugcuuaaaacuauuaaaugacaagcaggcacaguggcucacgccuguaaucccagcacuuugggaguccgaggcagguggaucaccugaggucaggaguucgagaccagccuagccaauacggugaaaccccgucucuacuaaagauacaaaaauagccgcgcgugguggcagacgccuguaaucccagguacuugggaggcugaggcaggaguaucgcuugaacccgggaggcggagguugcagugagccgagaucgcgccacugcacuccagccugggcaacaagagcgaaaacuccgucuccaaaaaaaaaaaaaacaaaaaacaaacacacacacacacaaaacuauuaaaugacuugcccaugguuacuuagaggauuauaauggagucaggugaaaaaccuuagaggaugagaacuuuuugaaggcagaaauuuuaccggcagccccuguacuucucccagugccuggaauucaguagguguucaauaaauguguguuacagguaugaacuacauaaggcagaaacccaggucccugucacccauucaaagccgugucacuaagaguuugccugucgccaucauuccaguauccucagggagcaucaacgcucucccuucggcccugaguuuagcgaggggauuggucuuacccgucggccugggcgaggccacggaacaugcccuccccgcccgggcagugucucugacccuggaauaugccauccucggugcugaagugcuucaccguccuguccgcgcagcccaccagcaucugcggcaaagaagggcaagauggcgaggagagcgaggcugcugcgccccaggcccccagcuccggcccgaccaggggccacucaccugggucucgccgccggugccccaacacagggcgcucacugccuccucgcgccgcggcuguccuccggccgugaaguucgccgccuguuuucgcugaagauuuaccccugagagacgaaggcgucagucacgccaggggcgcgagugcaccccugcacuucccgacgcccgagccugccacccaccuuucaagaucccagucucggugccgacccacacaugguuccagcgugcagcagcagccgccaugacaaagccuggaggcagacaguucacacuuccggcgcagcgug

SEQ ID NO: 18731 - RNA, 37795 nt, Homo sapiens
agcugacacaaaauaguuuauugaaggaaaaacgaggggagaggagucaggugggaaagugcuggaaugugaggagucugccccuuuucuucaggaacuagagcagguggggcgcugucggagagcacccccagcagguucagagcugcccagagucucuaggacaggggcagaagcagaagcaggagcaggagcaggcagguuggccuccgucagcaaagcugcaucuucccaggagccugaaccugggccaggaaagggaaaaacaaaaucucaaaugggauauuagauuaaccgggggccccacccaggucacgcugcaggaugccccucaccaucacuggccucaggcucuagcuccucuucuccgcucaggggcugcugaucugguuucuccuccucggacagcugacccucugcagccaaaaggggaaugcaggggucagacccagacacugaaggagaaagccaaggagucaggaaggagagagugugguggcugcgccauaccugucccugagggaucuucagggcucucaccauccucuguaacaucugauugcggaguugacuccuccuggccuucaggcccugcaccuccaaagagggagaggacagguuaggguuaggguggcugugccuggacggcagugccaaccucaccuuccucgccuuuccuuugacccuugucucagucggugauacccuaagccucauacuggaugaagcagggacuccuucuggcccagcccagcucaaccuagcccaccucaacagcuccccagccaacaccuuuaccuggcugaugagcagagauccuucguuggacuuccuuccgggaauugucucuuuuucggauguuaaccuguggaggaaaaacuacugagcagccaggacugacuucccucacuaacaaucaggacccucaugccuuaauccccaacauaccccugaccacccacaaagaucaaagggacaaaaggggguccuugccccuuucgaccugcaaagagaagcggugucggggccagaugcccccccacacccacugcauguagcugaagagcacgaugacgcugaggaaggugaaguugcuggcaacaccuaugaaggcgcaggucaucgggaaguuguauagcagguaucugaggcaggaaguagggacaagaagguaguagcaguuaccagagagcaccagccuucucaugucccagaaauaauuucuagggcaauucaagugaguuugguuacagcuggcucugucaccccugccucccacccacacaguuuccagaaccugcuauaccagguucuaacaaaggccaaggaccuugggaagucuccugugggagggccauaugccacagccucaauguugucugucucucaagagucaccccaacucuugcuaagccaacgguucaaaagaguagcucuuaauucugucagcccaucagccuuccucggggugcuuuaaaacauucugcucacaggccggacgcgguggcucacgccuguaauccuagcacuuugggaggccaagguggacggaucacaaggucaggagauugagaccauccuggcuaacacggugaaaccccaucucuaccaaaaauacaaaaaaaauuagccagguguggucgcaggcgccuguagucccagcuacucaggaagcugaggcaggagaauggugugaacccgggaggcagagcuugcagugagccgaggucgcgccacugcacuccagccuaggcaacagagcaagacccccucuuaaaaaaaaaaaaaaaaaaaauucugcucacuuggguggagcccuuagcccuggauuucuggguggauggcagggcggagggaagaugaacagggaugauggaggguuggggggacaaaaaacaaaaauuaaaaauucugaugccuagauaaaaguuccccagggagcugauaggccaauauguggcagcuuugagacccucuggccuaugugaaacccaagucagcucugcucuguaaacccauuaccucugcuugggacccucuugguggaagguuagcccccgugaagaguugcccaagguucacuccaguuggccccucaccugagcccagugaagugcgcguggaugcggagguaggcuccauacagcuggaugcgcuugcuguggaucucaaugaucgcuccaguggucggcacguacugugaggggguggggugaggguggcgucaggccaggguccugccgcuagcacucuuacccgccucaucugagccccacuuccagucucucaguugugaugucuccugagccuggaggcuucucagguagaauccugggcuaaugggaggggcuaucuccuagucauaaagcucguucaccucacucaccgaguucucucuauagucugcguagaguuccaccuccagcagcugcuucugcucugcaaagccaaauagcaggaggcuagagaagaccaguguguccagcaucuggagcaggucugagcgguaaugcagcaucaccugccgggggugggaagcagaggcuggggacaggugcaugccagauccccaugacccuaccuaccccucaaccaccccugaguagucuaugaaggcggcuucuuccucaggucccuggcugccucaccuucacuuccuaccccucagucucauccaaccauuccaauugcuugaguaccucucucccuacucaaccacacucuauuauagagcaaaggccccuccuuccaagaaaccuuccuagauuaagcccagcacugucucugaucugccuuucccaccaaguaguucuguaauccaguaugggaucuaagucccagcgcaccaucugaagcuuuccccccaucauguagacaucaggaauuugcuucaugaugagguuguguuguuaauuaauggaagaauggagucuuaacauuuauuaggccaggugcgguggcucacaccuguacuugcagcacuuugggaggcugaggugguugaaucauuugagaucaggaguucgagaccagccuggucaacauggugaaaccccaccuccacuaaaaauacaaaaauuagccagguguaguggugagcaccuguagucccagcuacuugagaggcugaggcaggagaaucgcuugaacccaggaggugaagguugccgugagccgagaucacgccacugcacuccagccugggcgacagagcaagaucucugucucaaaaacaaaaaaacauuaaacagccacuaugugcuaaugggaauuuuacauuuccccauugaauccaaacuagucuugcuaugaggcaguuacuauuauacccauuuuauaauacuuuauacccaagaaguuaagucaggugacccacagcuagcuuguuucugaaugaggacacaagcccaugucugucuggcucuaaagccuguuuucugagagcagcuccacucuucacacuuaaucccaaagcugggcaugcuccugagauaccugggguguuuggcaaagguuucugguuuuguaagcugauuccuuucucuuuuuuuuuuuaagacaaaguuuugcucuuguugcccaggcuggaaugcaguggcgcgaucuuggcucaccacaaccucugccucccggguucaagcaauucuccugccucagcuuccugaguagcugggauuacaagcaugcaccaccaugcccagcuaauuuuguauuuuuaguagagacgggauuucuccauguuggucaggcuggucucgaacucuggaccucaggugaucuacccgccucggccucccagaguguugggauuacaggcaugagccacugcgcccggccuugauucccuucuuuauccugaugugucugugaccucaaagccaaggguguuuucuccugaggaaucccuacccagacauucuuuuuuuuuuuuuuuuuuuuuuuuuuuugagacggucuugcucuguugcccaggagggagaauaguggugcaaucuuggcucacugcagacucaaccucccagguuuaagcgauccucccaccucagccucuagaguagcugggacuacagccgugagccaccaugcccagcuaauuuuuaaacuuuuuuuguagagauggguuucgccauguugcccaggccagucuugaacuccugggcucaagcgaucugccugccucggccucccaaacugcugggauuauaggccugagccaccacacccagcccccuacccauucugauccugccaucuuccuccacaccuucucagacaggccaccaacacuuaccgaacgcgaagaaguggagaugauucggccaccucugguguagcaggaaauggugaccaagaacaugcccaaaucuugauucacaggggacucuggcagcucaagcucuaagguaacacgauacggcuguccauacaucagcaccugccaaagguagcccccauuucuuuaaaaaaauuuuuuuguugaaaauguacugucucuauuccaccucccucuuagcccccgcaacgcccccaaauacucagccacaacccucuuggguagccuaacgggccuuucaaucugucaucccaagaaggugcugcccccuucugguggcuagagccucucacguccaguucuuggguauccuguuggcucuccugaaucagacuggcuacccuguucccagaaaggcugugucacguuucuuuuccaaaagugaaccaucauguugccaacugggccaucugugacucuggccuaugggccggugaggcuguccccagggcccagccuguccucucuuacauuauuaaucaagcacugacagugcucagucuccccagccagcucuggcacagucauccucgcuccagaucaucuuucugccauucuagcucccuuaucuugguucuguugguagcgccccaagacucagaguaggaaggcuucuucacagggaucacccucaagagguuaaagauuugccaccaaacaugcccuaguuuuuccuauuucuauauucuucuagccccuuuauugauucauaucuggcaacaaggcccucacacaguaguauauaaaaauuacaggagugaggguaaagcuucuguuuuuaauuagagguaauggguuaaaaaaaaaaaaaaagguuagccaggugcagugagucaugccuguaaucccagcacuuugggaggccaaggcagguggaucaccugaggucaggaguucgagaccagccuggccaacauggugaaaccccccgucucuauuaaaaauacaaaaauuagauggacgugguggcaggcgccuguaaucucagccacucaggaggcugaggcaggagaaucgcuugaacccuggaggcggagauugcagugagccgagagcgcgccauugcacugcagccugggcgacaagagcaaaacucugucucaaaaaaaaaaaaaaaaaaaaaaaaaauuuggaaaauacuucccuagcccauagugaacuaccuccaaaacauggguucagccuugggggugcuuucaguguuuaucacuaaggcaaugguugacaccacugauaggggccuuuuuuuguaccuucuuauugccagucagaacuaucuguuggccgggcgcgguuggcucaugccuguaaucccagcacuuugggaggcugagacgaguguaucacaaggucaggaguucaagaccagccuggccaagauggugaaacucugucucuacuaaaaauacaaaaauuagccgggcgugguagcaggcaccuguaaucccagcuacucggaggcugaggcagagagcugcuugaacccgagaggcggagguugcagugagcugagaucgugccacuguacuccagccugggugacagagcaagauucugucucaaaacaaacaaacaaacaaaaaacuaucuguugaagaaaauggauuccaugagauuccuaccccccuguagagaccagaugauuaagccaguugcuucauaaacuuuuugugugugugugugugugugugugugugugugugugaagacaaggucuugcucugucacaggcuggaaggcaguggcaugaucauggcucacugugccuggaacuucugggcucaaucuauccuccugccucugccuccuaaguaccugggaccauacggacuauaggcacaugcaaccacaugcaacuaaaaauuuuuuuuuuuuuuuggagagacaggggucuugcuuuguugcucagccuaugaauucuuccccucaaccacucccccagucuauuaauucuuuucuuuuuugagacaggaucucgcucuugucacaaaggcuggagugcaguggugugaucacagcucacuggcagccucaaccuccugggcucaguugaucuuccugucucagccuccugaguagcuggaacuacaggcaugugccaccacacccagcuaauuuuuuauuuuuuuguagagacggggucucauuaugcugcccaagcuggucuugaacugcuggacucaagcaauccugccuuggccucccaaagugcugggauuauaggugugagccacugcccuuggcccaaauucuuugaaacauuaaaauagguaguucucuuagccaggugugguggugcaugccugcagucccagcugcugaggagacugaggcaggaggaucccuugagcccaggaguuugaggcuacaaugagcuaugauugggccacugcacuccaaccggggugacagaaugagaccccaauucaaaaaaaaaaaaauuaaucuccuccaaagggauccacagaauuuaauacuaaaaccuugugaauaaauccaugccggccgggcgcgguggcucaugccuguaaucccagcacuuugggaggccaaggcgggcagaagacgaggucaggagaucgagaccauccuggcuaacacggugaaacccugucucuacugaaaauacaaaaaaauuagccgggcaugguggugggcgccuguagucccagcuacuugggaggcugaggcaggagaauggcgugaacccgggaggcggagcuugcagugagccgagaucaugucacugcacuccagccugggcaacuccgucucaaaaaaaaaaaaaaaaaaaaauuccaugccuuuguccacaauugccugcuugaugggcagauucucccccuucucuaacauucccauguaauauucacccuuccuuaaaagauccgcuuugggcccggcacaguggcucaugccuguaaucccagcacuuugggaggccaaggcagguagaucaccaggacaggaguuccagaccagccuggucaacguggugaaaccccgucucuacuaaaaaaaaaaaaauacaaaaauuagcuggacaugguggcaugcgccuguaaucucagcuacucaggaggcugaggcaagagaaucacuugaagccaggaggcagagguugcagugaagcaagaucacaccagugcacuccagccugggcaacagagagagacucuguaucaaaaaaaaaaaaaaaaggauccgcuuugaacaucaccaucuccauggucuuagacuaucccagacaacacugaucuaauucuucacgaaugcuucuggaaugcagaauccacauccuuuuuuuuuuuuuuuugagacggagucucgcucugucgcccaggcuggagugcaguggcgcaaucucggcucacuguaagcucugccucccggguucacgccauucuccugccucagucucccgaguagcuaggacuacaggcgcccgccaccacgcccaccuaauuuuuuguauuuuuaguagagacaggguuucaccguuuuagccaggauggucuccaucuccugaccccgugauccacccgccucggccucccaaagugcugggauuacaggcgugagccaccgugcccggccucuucuuuuugagauggagucuuacucugucgcccaggcuggaguacaguggcaugaugucggcucacugugaccucugccuccuggguucaagcgauucuccugucucagccucccaaguagcugggacuacaggcacacaccaccacgccuggcuaauuuuugcauuuugaguagagacaggguuucaccauauuggucaggcuggucuugaacccugaccucaggugauccacccgccucggccucccaaagugcugggauuacaggcaugagccacuaugccuggccagaauccgcauuuuacaguuuacuacuuaaauguaugcaaacauaugcaauguauaguuuuccaucaacgcugugagcucauugagagcagcgaccacaucuacuuauagcaagccguuacacauaguggacagauuauuucauucauuaauucauuuaaaaauguucauugucaacaaacaaaauguucaaccucuucuaauuaucagggacaugggcugaauuugcucucaucuuccuuuuauuccucccucccucaugugacagccucacaccugaucguuugaggcucccucccuuggcucucugccuucccauuaugaucucugcaaugggccacaaaacuguaugcaccaucccagguucuguggcuuucucauuucuucucaauaaagucauuuauuauuauuauuuauuuauuuauuuugagauggagucuugcucugucgccaggcuggagugcaguggcacgaucucagcucacugcaaccuccgccuccuggguucaagugauucuccugccucagccuccagaguagcugggauuacaggugcacaccaccacgcccagcuaauuuuuguauuuuuaguagagacgggguuucaccaguuggccaggauggucucgaucucuugaccucaugauccgcccgccucggccucccaaaguauugggauuacaggcgugagccaccacgcuuggccccuaauuuuuucugagauggagucuugcucuguagcccaggcuggagugcaguggcgcgaucucggcucacugcaagcuccgccucccagguucacaccuuucuccugccucagccucccaaguagcugggacuacaggccugcgccaccacaccuggcuaauuuuuguauuuuuaguagagacgggguuucaccauguuggucaggaugaucucaaacuccugaccaugugauccgccugccucggccucccaaauugcugggauuacaggcgugagccacugugcccagucaagucauuuauuauuuuuuaaccauagaagcaaacugaauaaaugucuuuauagaagauucuaggccaggcaugguggcucauaccuguaaucccagcaguuuggaaggaccaggugggaggacugccugagcccaggaguuugagaccagccugggcaacauagcaaaauccuaucugguuuuuuuuuuuuuuuuuuuuugagacugagucucgcucugucacucaggcuggagugcaauggagcagucucggcucauugcaaccuccaccucccggguucaagcaauucuugugccucagccuccaaaguagcugggacuauagguuugugccaccacaccuggcuaauuuuuguauuuuuaguagagacgggguucgacuguguuggccaggcuggucacgaacuccugaccucaggugacccaccugccuccucagccucccaaagugcugagauuacaggcgugagccaccacacccgguuauaauccuaacacugugggaggcugagucgggaggaccacuugagccuaguaguuugagacaagccuaggcaacauaguaagaucuugucucuacuaaaaauuaaaaaaaaaaaaaaaaaaaaaaaagcugggcaugguggcacacaccuguagucccagcuacuugggagaucacuugaaccugggaggucaaggcugcagcgagccgugaucguaucacugcacuccaggcuagguggcagggcaaaaccuugucuugaaaaauaaaauaaaauagaaccccagacucuauagguuauacuccucccuucaaaagugugacauucuaucauuacaucaguuuccuccaaaguaccacuuuugaaaaauaacuucaggcuggacaugguggcucaugucuguaaucccagcacuucaagaggcugaggugggcagaucaccugagaucaugaguuuaagaccagccuggccaacaugaucaaaccccgucucuauuaaaaauacaaaaaucagcuagguaugguggcauacgccuguaaccccagcuacuugggaggcugaggcaggagaaucgauugaacccagggggcagagguugcagcgagccaagaucgugccauugcacuguagccugggcgacaggaaagaaacuccgucucaaauaaauaaauaaauaaauaaaacuucaggcugggugugguugcucacgcauguaaucccagcacuuuuggaggccgagguggguggaucaccugaggucaggaguuuuagaccagcaugaccaacauggugaaacccugucucugcuaaaaauacaaaaguuagccgggugugguggugggcaccuguaaucccagguacucaggaggcugaggugggagaaucgcuugaucccaggaguuggagguugcagugaagugagaucgcgccacugcacuccagucuuggcgacagagcaagacucugucucaaaaaaaaaaaaagaacguauccuuuaugagagccuccucuagcuugccuacuauagagggcccaguccccauaugcauuucucaggguucccagguuuguugacaucacacuggcaucuggccaguccucuggcacaguacccuuuguaaugacacgaugcauauauuugacaacaguuucauaauguuauauaaaugcuuucaaaacucuuggguagaugcccaucuuauuccaauguaauagcucauuuguucauuuaggucuaaaacauugcuuacuucaccuagcagauauugcucacuuuaccuagcagauaaauagaucauacuucaccugauacagaugguccucaguuuaugaugggguuacauuccgauaaacccaucuaaguugaaacuaucacaagcugaaaacgcauuuaguacaccuaaccuaaagaacaucauagcuuacuuagccuagccuaccuuaaacaugcucagaacacuuauguuagccuaccuauaguugauuacaaucaucuaacacaaagccuauacuuauaauaaaguagugaauaucccaugugauuuauugaaugcuguacugaacgugaaaaacaggcugggcgugguggcugacgccuauaaucccagcacuuugggaggcgggcagaucacaaggucaagagauccagaccauccuggccaacauggugaaaucccaucccuacuaaaaauacaaaaaaauuagcugggugugguggcgcgcuccuguagugccagcuacucgggaggcugaggcaggagaaucgcuugaacccaggagguggagguugcagugagcugagaucgcgccacugcaauccagccuggcgacagagugagacugucuggaaaaaaaaaaaaaaaaagaaagagagugaaaaacagaaugguuguauagguaccugaaguacagugucuaaggaauguaugucgcuuuugcaccacaguaaguugaaaaauucuuaaguugaauuaccguaagucagggacuauguugagaaagaacauuucuaacaccugcugcagaaagauccaucaauacacacaauuaauuuuaauuucuuuuccuucaaagccuuccucuuagucuccuuuuuuuuuuuaagacagagcuucauucuuguugcccaggcuggagugcaauggcgugaucucggcucaccgaaaccuccuccucccggauucaagugauucuccugccucagccucccaaguagcugggauuacaggcaugcaccaccacgcccagcuaauuuuguauuuuuaguagagacgggguuucuccgcguuggucaggcuggucucgaacucccaaccucaggugaucugcccaccucagccucccaaaguacugggauuacaggcgugagccaccgugcccggccagucucuuauuacucaauuccuucucucuaggccuuucucaagucuuccuauuuugagucaucaaagcucuaaugaaaccucucucuaguucccauacucacccgaucacguccacccuuagucagcgagacauuggcaacagggaaggagcagagugaggugguggaggaaucacagucgguccuaaaugagauuggaggaggauacucugcuaaguuagucuuacuaguccauccauacaccuucuuugcccccuagggcucccuccugcccuccucccuucucucagaacaggcacccuucucucuguuacaaagauggagaacaaauguggccaggagauucaagauaccaggauuauuucauucucuuccuaugacuucaauguauguccucucauuacaacagauguucuuagaugggaaucuagagauacuuaaauaguugcauacuucaguguuucuaaagacuuaaggagcuugauaaaaauguaaauuccagggccaagcagcagcggcucacgccuguaaucccagcacuuuuggaggccgaggagggcggaucaccugaggucaggaguuuaagaccagccugaccaacauggagacaccccaucucuacuaaaaauacaaaauuagcggggcgugguggcgcaugccuguaaucccaccuacucgggacgcugaggcagaagaaucgccugaaccugggaggcagagguuguggugagccaagaucacgccacugcacuccagccugggcaacaagggugaaacuccaucucaaaaaaaaaaaaaaggaaauuccagggucccaccccaagagauucugauuugguagcucuggucuggguccuaguuugagaaaacgccuccaaaaggaucuacagaugguuauuaagaagcucaugaaccccuccaauuguaggcaaauuugcaugugggggugugggugcagcauaugccugggcaugcauauacguuuuuuuuuuuuuuuuuuuuuugagacggagucuugcucugucgcccaggcuggagugcaguggcacgaucucggcucacugcaagcuccgcuucccagguucacgccauuucuccugccucagccucucaaguagcugggacaacaggcgccugccaccacgcccggcuaauuuuuuuauuuuuaguagagacaggguuucacgguguuagccaggauagucucaaucuccugaccuugugauccgccugccucggccucccaaagugcugggauuacaggugugagccaccgcgcccggccguauauauguuuuuauggcaggaagggccauaagauccauuuccuaaaaguuuaagaagcucugcuuuagaaacuauagcucuggaccagggacuuaagggaaaaaaugacuuuaaaccauugauuauaacgcccuucucugcaucuguugauagguccuacaaccacuguuaagaaaagagaacuaggccgggcgcaguggcucaugcuuguaaucccagcacuuugggaggccaaggggguggaucacgaggucaggaguucgagaucagccuggccaacauagugaaaccccaucucuacuaaaaauacaaaaaaaaauuagccaggugugguggcaggcaccuguaaucccaguuacuugggaggcugaggcaaggcaggagaauggcuugaaucuggaggcagagguugcagugagcugagauugcgccacugcacuccagcccaggcaacagcacgagacucugucucaaaaagaaaaaaaaaaaaaagaagaagaagaagagaccuugguggggcacaguggcucacgucuguaaucccagcacuuugggaggccaaggcggauggaucaccugcauucaggaguucaagaccagccuagccaacauggugaaaccccaucuccccagcacuuugggaggccaaggcagguggaucacaaggucaggagauugagaccauccuggcuaacaaggugaaaccccaucucuacuaaaaaaaaaaaaaaaaaaaaaaaaaaauuagcuggguaugguggcaggugccuguaguaccagcuacucaggaggcugaggcaggagaauggcgugagcccaggaggcggagcuugcagugagccgacauggcaccacugcacuccagccugggcgacagagcaagacuccaucucaaaaacaaaaacaauaacaaaacaaaaaaaaacccaucucuacuaaaaauacaaaaauuagccagaugugguggcacacaccuguaaucccagcuacuugggaggcugaggcacgagaauugcuugaaccugggagguugcagugagcagacacugcaccacugcacuccagccugggcaacagagagagacuccaccucaaaaaagagagaauuuggcacuuggcaggguuuguaaaaugagaaggaaccuaaggggccagucaagacgcaagacucucugggaagcaaguuuaugcgccuacucaucuuauguuuccauaaucucuauuguguagccgacuuucagggacugagaggcaguaauguaaaaagcaaacugcugcuuuccuaauagcuccucuacugaaagccagguugguucugcacuaaaggguugaguuggcucaaaauucuacauuggcccugagagaggggugauccaaccaaaauagaauugauccucauaaugauagaaguggauauuuuuccuuuuuuuuuuuuuuuuuuuaaccagaauucaguaaucagagguagaacuagaacccuagcccuggcaacccaaaucuagccuugggcugugaaaguugagaggcccuggaagcacaccuggcuccaguuuuccuuaucuguaaaugaggggauugaacugaaugaacuccaagggccuuacaauucccauaggaguccucuauuuugauagaaggccccucucaccuguaguagaaaugcacagggcugagguggcugacugucggcauauaggaauaguagaaggagccauagaggaagacagacacccagagcaaaaggaggauggugcagaagagcaccccaaacugcagcagcagccugcgggcacggccugccaagacuuggcccaccuccugggcccacaguaaggcagguacuggagggucguugaccauggccgggagagcagggugucuggccccagguucaggccuugcguuccuagcugcucugccaccuggacgccaccccuggccaugggaugcagcagcuggugguuccuggaaagagagggugagggaaaagagugacuccuuuccccagggagguggggacaaaacagcuuacuggacuggcuuugaggaacgagagauagcaggauagcaaagucauuguuucauauauauggccuuucuccaaaugauugugccacucugccaauuaccccuucccuuuccuccacuguguucccucccgcccagugcuaaaucuccucaguggaauuccuucuccagucauuugaugcugggacaaaccaccuugauucucauucacagcuauauaacaaagaauaagcaccuuacgauucuuagaaagagcuuuacacacacggugauacugaauccacacugcuaggcagcugcacggagagaaugugcgacuugccuaaggucgcacggccugacucgaaaccaguagccuuagaguagccacaauugcuucccgaguuucuccucuccgccucgagcagagcucgcucaccgacacggcuacaccccacgcccggcggagcgcccugcagccaaccgccgcuucccgccaguccccuccagcucgggggugggcaaagcgcccggagccccuaccuaaucgugcaaccauggaaaccagcccgccggcugccacagggcugccgacucaccagccucgcgcgcugccagggcaaccgugagacgggacuuccggcucccggggaagucccgccccucuccgccggccgcuuuuguagccgugggaggcggggcuucagcccagggcgggguccagcacggcggggcggggcgggacggggcggagccuucccgagcugcgaggucgcugucuccuugcgcucgccacuggcucucucugcggcagguuucccuccgguuaccgugaccaaaggggaaagacgccugccucccugcaggccccaagaugugccccaggggaugcgcugacugcagccuccgcucggcucucccuugagacugcaaucacagcccuccgugcacaccuucaccacaggccauuucacccgcgaagcggccgagugaggcggucauccagcuggcgcugauuuuuaucgcccacagcuccuaggaccuguaggcaucuaaggcgggggcauucgccuagagcauguugcaguuugcggcaaccugggccucuugcguuguugcgcaggcagauuagugcccuguucccagcgugguagcauuguggaccuccucugacccuaacuggauacacucucccucagaguccccacagcacauuaucuagacuagcuuuuggcagucuucuauuuuguagacgucuaaucaccccagauaaaguccuucagaggcaaggccaguguuguguacaucuuugcacacugcugcgggcgugggaaguaaucuauucaaaaugaaugaaauucuuaaaaccaauccauccccccgcccccuucacgccagcccaccuauuuccaguauauuucugcugacuguccccacaagggccccuaccuccucuuuguccgguccuuugaucuggucuccgcacaccucuuuuuccccagcuuccuccuuuuggucuaccuuuucuguagacaucuuccugacgagccucuguugacucuggaucuuccacugagucacuuguggcuaaaacgugaaguggcgauccagacgcugauaccuguggcgcaucacauuuuccuggauauggaaaauggagggucccugggagagaaacgaagauucaggugcuaagugcugugucagaguagagggaggaaaggaggaggggggcgacugcccagcugaugucagauuuucaaaugagcagggucccccgcagccaguacagacuccacugcaggggccgucauaggcccagaccacgccauuugagagggggagucggccuuggccucagcucuguuggggaggucucuagcccagagucaggaugccugcaaugggggaggggcaggcagugaacuagcgacagugggggugugcgcagggaugcaggcagcuaggcucccccacuggccaggcaguugguaugcuccaggaucugagcagcuccuucuagcauccuucauccuucagguaccagccauccagacagugcuugagcugcagaaacugagaccagaccucuggccuggcccuccccaggggccuccuuucguauagucacugcuucugcaucagauacuuucagcugcaacucccuacuggguggggcacccauuucaggcagaagguuuugguacccuccacugacccuacacccagggcugcuacugccgcuuguggcuucagguaaguaauggccuguuuuucuccuguuggggcucacuggagcagacaggggugaugugcccuccucaucaggguugguugaggucuucagagcugggaacacacaugguuugaagggcugaaaagccuuaaaucauuuguguaagguuuaaugaucuguggcccaggccaugagggaguuuggggagcaccucaucccacccuauuuuuuuccaugaggaauacagggaugagacaguccacuggaggaggaggaggaggauaggaggggaacaaaauauugggguaugaccacagccuuguaaagguugguguggagugagcauggaggggggccuccagcugagacugugcucugagaggucccucuuuuuuccaggaugaaaggugagaccccggugaacagcacuaugaguauugggcaagcacgcaagaugguggaacagcuuaagauugaagccagcuugugucggauaaagguaggugggacccuggcuggcucccauuaguuggccaggcugugcugugcugcagguucccaaagcucaagauaagagaugcguucuuuccuucacucccugaggucaggggaggagucuggggcucuguagagagagcuguccccaggccucugggggggaugagggagaagacaagucguaaggagcccuggagauggcaaaagagaacccauuuggggagggaggcugcaguccccuucagagguccuggcuaacaauacccuuccuggcugugucccagguguccaaggcagcagcagaccugaugacuuacugugaugcccacgccugugaggauccccucaucaccccugugcccacuucggagaaccccuuccgggagaagaaguucuucugugcucuccucugagcuccccugucccuucucacaacuccucccuuuucccucuccugggcccuuccuuaggucaguaauuguugugagccccuuaggcuccuugcaucccaucccuaacccuugccugaccaugugagguuaucugaagcacaaggcccacccucaccuaucugucgaccccauuuccuaccaccuuuguggccgaccccaagcaccccagagauaugaggcacccuuugcuccacccacagcagggccccgucagacucugccagcgcguccugcccgcuucccucggugaccugcucagacaauggagagggaugggccagguucuugcucucagucucaccuggagcuacugggaggguaaagccauuugaagaauaaagucauccagagccucaggacagcuccuguguuagaauucuuggggggagaggaucaucaagcaauagaucugccauacccagggaaaagggccaaucaaugcaggcuagacaucgucaaggaucggagaucagaggggucgggggauggcgggcgcgagagagcguccacaguguaagaauuaaguacaaaagacgcucaagaggcugcgaagagcaaacacacacacacaaacgugcaacgaagccaaguuaaaagguaaacaggccgaagaggggggauuuaggggagggugcgggagugcagucguacagcagaggaacucuuaggaggguaggggcggagcuuggcuucaguuaccgcgacuggagccgauuuuauaccuaagauggcugcgcccacagccacucccauuccaagauggccguaccaacauggcagcccccacgucacggaguuuaccguacagggcuucucuuaaaauggcggcccccaggcaaccggcguucucaauauggucccuuccgcccucuucuggucucaaaauggcugccccugcccuaaccaagccggggcccgcgcccugcaaccccgaaaucuggauuucgguguccucccgauugagucgaaggcacacgggcggccauaacgaagaaucacuaaacaaggggaccccaggaaguacagcguggccgacgcuggucgcguggaucuugcgagggaaucuagguuucuacauuuugccaagaaaggagaggcucccuuuggagcggaaauauuagcggcaggggguuaacccccgacccuguccgucucggugcaccgcuccucaguugcuuccuggucuucccaggagcuggauaagccugaaguugcucaguuuggguuuccuaguagaacuggggcuuguuuuugcuuucauuuuccccucaggccgauucagccacagcagccagaaagcaguggccgcaccccuaaugugccuugcaaaaguccagcaugcugucugggcagggaccaaacuuaaggcuuaacaugucauggucaucuccaggacucaaacauggcggagguuuacgaacaccagaaugccuccuagaaucuuuuccuuccaagggugcacagaggcgagaugggaccagggacaagacaaagaacguaacaaucccaguacgugugcuccugcuagagguccccuaaacucagggacgcauccuccccaggaaaagccuaggcuggcuccuguuuugugccuggauauacuucgggaagggaggcugcuuugaaauaguagggacagcucauuaccuccagcuuccagguaucuuugcacagaagacagcaaaguggauaaaggaaaccaaaggaagaaagguuguuaucaccagcaacugaacuuagccuccuaaggauaucuucaugaauuccagggacacccagugaacuugggucaccuuaaggugucccaagcaacuuuuuacuguugauggaacuucugagcucuaagaaguccuggagaucuucuaauuaauucccucauccuagagaugaagaaacgggagaaguuugcccuccuggagugggacccuacccccauucuguugcggaggagccucaguuccuucuuggcacggugaaaauuccaggaaggaucaaucaggucagguccguuuuaaucccuguauccugauaauggcacauaucaggcacccaaauacccaaugaauagauuguacuguacaugcuuaaauggcaaauguggcauggcagggaccaagcaccuugccucccucacccccacuguaucacgguguugggcaaguuccaggggaguaagugaaauuuuccacaacagcucagacaugguuaaauaaaaaaaaaaaaaauuagaguguuuaauaaauguaaccuugauuuuuaagaaagccucuuuuuggccggccgggcgugguggcucaugccuguaaucccagcacuuugggaggccgaggcgggcggaucaucugaggucaggaguucgagaccagccuggccaacccggugaaaacugucucuacuaaaaauacaaaaauuagccggugugguggcggguaccuguaaucccagcuacuugggaggcugagguaggagaaucacuugaacccgggaggcagagguugcggugagccgagauugugccacugcacuccagccugggcaacaagagcgaaacuccgucucaaaacaaaacgaaacaaaacaaagcgccucucuucaauuuuucugcacacucaauguuccuacccaucagauuauaacugcguggcuacagcgcuaggugggaaaaugggguuuaagcaguaacuagagaccaggcaugagcuaugauuaaccacuuuaaaaaaugauuaauuagcucuaacagcaacuuaaauguccuaaagaauagauggcuaccaaaauuaaggguggccuucaggguacaaaacuguaaacccggguaucugaauccgugucacauacagaggguaggaauuagagcaguaucuacaucaauacuacuacuccuucagaacacuggaugucaugagccugugguaucucagcuuuaagacccugaccauuuauuagaaacugccguuaggaucauuucagugcuaauaaugcaaugguggcugggagcggaggcucacaccuguaaucccagcacuuugggaggcugaggcaggcagaucacgaggucaggaguucaagaccagccuggccaauauggugaaacccugucucuacuaggaaaaaaaaaaaaaaaaaauuagcugggccugguggcacacauguguagucccagcuacucgggaggcugaagcagaaaaaucgcucgaacccaggaggcggaaguugcagugagccgagagcgugccacugcacuccagccuggguaacagagcgaggcucugucaaaaaaaaaaaauaaaaauaaaaauaaaaaauaaaaaagcaauggcgcuguuguaaauuuaauuuaccgucucguucuccagauucacuggaaaauaacccccaucaaacuucuguugaaugagugggcuuucccccuagcaguaauuauucaugaauauacuuauuuggcuccacaauguacauuuaacuucaagcauccaacuaguuuuugcauaggccaaauacagaggucgugaguuauaauuuauuuuccuauacuucaauggcucgacucuuggccuaagcaagcacuaaauagacuaauaacuacccacccaugucaacugacugcauggcuggcucccaagugaaggcaugguagaauagggagggaacggcagccaccaugcaagaggagaguccuccuugguuggagcccaugcgaccugagaaagaggcauuaaaaaaugaauaaauaacccagugacacccuccgccccagucagugcagccacaggagauagggugaauucaauccaaaugguuauuuauucuaaaacuggaagcuacuuugccuacauuuucgccagaaugguguaaugagaacaggggaggaaaaaguuacagauguaaacaaugacacaguuacauuuuuuuuuuaaaugguaaaaccccuuuuuacuggccacuuccaagaaugcuuuacagguugugcaaaaacauuuacaggcuccaugugguguuuuucucacaagcuuuccugucuacaacuacaacagacgucugauaaaacacuaaacaagucuucuaaggaaaacaaggcuagggauuccucugguuaccauaauccacauuuucccccuuaacauaguuuuucauaauaaaaagacagaaacaaaacccggacaucuacuguuguugcaaaugaucucuuggacuaaaccaacaaggauguggcaguuucacuuuccacccaccuagaaaaacaguuuuguaaaaaagauuacuuucuagugucaaauaucaacagcgaguaccuccccuaaccccugcuggaaaaaaacucaacuugauuuaguuuaguccccuugccccuaagggcccuagcauccccauccaugucacagacuacaagaaagaugcuauuugcaggacuaaacaucugaaaagggguggcagccacugccucaggaaauucaauuuucuauuauaacauaaucuugcccuaagggaauuucuuugggcuccaguuuuuaccuccuugccuugacauuauaagcaaagcuuucucaaacucccuuaauaauaauacaaaguuaauguguuacagaaaaauucaugcaaucacuccacugccacacagaaauccauuugaggacaccgcagggaagcaggugccaagagaaaggacaugacuaugaguaagcaaacuuaucuccuaccagccccauuccagccuuggggucagagguauuugggcggaagggugugucaugacagacaaggacacuagaggccagaauaagggucuguacaccugaacaagggcugcagggcaguaacagugggaggaggagaggaagaccaaaucagcccacaauuuuaaacagagaacugcccaggugaggaaauggaagugaagcauuuucuaguggcacagauuuucucacuaggaacugcugcaguauguggugucugcugaguaagcucuuggcugacagugcugagcaggaggaugaaugaaaacugaagcuagacauugaaagagcauuccauaucccacccauauucuugaacccagcaaccuacagcugucuaucaagaacugggaggguauugguaaagucacaaaugaaacuaucccaacugaaggcuccuggcuagaggccucucuggggacacacagggaaagcgccccaaaaggaauuuuguuucuagaagucgggaaggggugcucccuuucacacgcacauuuacacacguucacacucacacucuucccaagguucagcagccccacugagcugccucccacccccccccaccacccuccccucuucuauucauucucuaccuguguaucaaaaaaaccagcagggcacgagcccuccacacuguagaaaauaguugcuaguugcuauucucagcaccugggccugugagcccacaccacaggauucaccuauauacauaucccgcugcagugaaaagaauccugcuguguuuucgugugagcugaaacccugagaaacguuccuucucucgcacuguaagaggacagacacucuaacagggaugauuucagagaccucccaccucucucaaccuuggaagacagagacuagagacuggcaaaucacaaucuuuaggcugagggcugcaaucccauucuccccaagauuuuacaggaauuaaucaaugggucuauagaaggggcaggcuauucugcucugccaucaaggacaguccccaggcuuucuuggccugggaauccuguaaaauagaaccacccacuggcagucuccaugccucagccaaacagcacaaaggcacaggaaaauggagaguugggacacuguaagccucccagcccaccagaccacauaucccaaaagggaaaggucgguaaagaaaauacaaacgguuaguuggugcaagugauugauaagagccaaucguuuauuuucacugucccagucacaagcucucccucuguccccacuccugccugcuccuaccugcuguggagagcacccucgcgcugccuccccacccuccccacaccaccucaucacucuccuuuacuuggcugccaguccagcugccucagaaugucagaagggugccauuuucaguucuuuuccugucugacuguaggguauagaacaggcagcccuaagugcugcuuucugcgcaaauguuuuuugauuacaaaucucuaacuagguuugaaauguuuuauagaauaagacaauauucuuuucaacaaacuuuaaaaaaaauguacaguuuuguuguuuguuuccaccuccccccucccccaccccugcuugagcacccuccccccccaccaccccuccccggcagcucagccccaccccgacagccccuguuuuccuugguuguguuuugcgggggugccuggcacccccagagauucagcuucauggcugacaggugaccauggcaggggcuucaccgauacccuugguacccguaguaauuccuguaguaucggucucuguccuggggguggugguaguaguaacucugccacuagaagagagggaaaccccaucacuuggagccagagcuggcugaggaugaagaggcauaacacucauccuucugcuccugccccccuucacccugugucuaucccaagaagauacucacaucccgauuguauugucuguaauagucucuguaucuguuguacucauaaucucgcccguaaaaucgaucauagucuccccuguaucgaucauagaaauuacgguaacccugagaaaggaaaagaaaaaggagugaagguuuauggguuuuuggcagcaugacccaccgugacccccuuuuaaaugcgacacaucuuagcucgauauuauaaauugguuuaauuuucccauaguaaaucuuccagaacauauuaaaugggcaaaacccuaagcccuaagaaaacaggcaaaccacucugcucccccaagccaacagaauggcucucacagcccagagugaggagcagaaggagagcugcacucaccccucuguuuccaggcugcccccaguacugcugcccguaggcccgguugucguagccucggcgcugcccgcccacuggaagagaaauggagagcgcgcucagacagcuggcaugggguccuggcuccacaucuggguggaaaucaaaaacuuggagccaaaggcaauucugggggaauaugaggccugcuucggccaggcucacacauguuaauuaaagcaccagccaggaacuuuuaaaaagucugaggggggagggcagaggaacagagacacaagaaaaccaagccacuuuguuuuugaagcuccccaauuccugcaaaacauuuaagauggcaaaaggauacauggcagaguuagaaacauaaggaaaaacugccauucauagaaucagacuuucagcccuggaagggauuucagauaucguauaacccauaccuaucauuuuaugcaaaagaaacaaagucucuguaaucagcuccucaagggcgggaacugucagcauuuacaguaccuagcacauagcaggcacucggaaauucugcugacuuaacaguuacacacacacauacacacacauuuuuaaagagcagugaaugcacacugggguuuuaacugacaaacuagacauucagggggaaaauuaauucuacuaauagccuaacuugcuugguuaaguucuuccccccacaaaaaacacugaauaaagcauucgcuuucuuguuaaucgaaaugacacagaagcaagaaaacugaagaugagaauuugauuucacugcacaaauccuucagauaagacaggaacagugacacugggaacccauauguuaaaaugaaaacuagauagaugagaaagcccaagcauugcuuuucaaagaaacaaauacuuuugugaaaaguaacucuuuuuuaaaaaagaggauuuuuguuguuguugaagaauuauggaaaaagcacaagaaaaaggcagggauaaagaacacaggaagaaauaagcuccaugaagaaggcacuuccguauuguuaaugaccugacuugguuuccuuggccuucccuugcacaucuugcuguacuaagcacaaagaauggacugaaguagggggcuggcagguccccaagacucaccauagccuuggccccggcuucgguucugccgguuacgcuuguuucgguuguuucggcgauuuguccgcuucucggaggggggcagaagcuuccuugccuccuccuuguacuuagugacaaugggcugagcuuccuccuucuccagcuccccauaugucaccucauccauauagucgcauuuuucaggcaaagagaaguuggcuauaagaguaagagagaagcuugugggccugaaaagugcauagauggguaagaacucauuaugaaaacucuacaagaagcauaugacuuucuaugccucaucuauuacugcacaaaaaugugcuacguuuauacccacucgcaucuaaauaaugacauuaacuuuuucuacucuaaguuuucccuaaauuguaacagacccaggcaaagggcuauguagauuuacaaguucuuaagugaucuauaauaaauuaggagugaacuggguuaaaguuucucaucaggacagaagcagguaaccagaggcuaaaaguaacugagaaaguucugguguuggucagauaagaugcuaagaaauaacauuuuaaaaagagacucagagauggccgggcaugguggcucacgccuguaaucccagcauuuugggaggccaaggcaggcggacugcuugaggucaggaguucgagaccagccuggccaacauggugaaacccugucucuacuaaaaauacaacaauuagccaggcaugguggcaggugccuguuaucccagcuacucgggaggcugagugccacugcacucuggccucgcugacagaagagagacucaaugagaaacugacccaagccuaaaggcaucugcucaucuauacaaggagaagagaagacaagaguacaagggcucucauuuaccaccuguccgugauaggccagcacaucugccagucucuggacgucaacuucagaagcugagucccaguggaaauucaguucaauggggcucucaugauucuuagaugaauccaguuggcccucaauuuuauaaaacugagcuacauuucucugagugccuaaguaagaguuauggacuggcauaguucauucucaguaaacucugaggaucuggcucauagauaugcaaaccaguucccaugccuggggauuaucaguauuugaagagcaagcaguugcuagacucggugggaugucaggaacuaaaggcagcaaugggaaaaaaaaucacguuuuaagggaauaggaggaucaaucaaaauauuaauauuucuuauguagacauuacucucugucuuauguauugcauuacagacuucagccaaauuaacaaacaaaacacaaacauaacgugauaccagaaaucaaguuauaccaaugagaucauucacuccaacugccauauuuuaaucugaaccauaauaaucucucccugcggccaggcgcaguggcacacaccuguaaucccagcacuuugggaggccgaggcgggcagaucaccugaggucaggaguucgagaccagccugaccaacauggcgaaacccugucucuacuaaaaguacaaaaauuagcugggcgggcaccuguaaucccagcuacucaagaggcugaggcaggagaaucgcuugaacccgggaggcggagguugcagugagccgagaucgcgccacuguacuccaaccugggcgacaagggcaagacucugucuuuaaaaaaaaaaaaaaaaaaagcagaauaagaaauguagacaaacaguagauguaccagaaauauuuacuuaacaaauaacugauucacagaagccucucccuugauccuuugaguuuaaauuacccuacggucacuuuuuuuuuuuugagaccgagucuucucacucuguuguccaggcuggagugcaguggcacaaucccagcucaccgcaaacucugccaccuagguucaagcaauucucugccucagccucccgaguagcugugauuacaagcgcccaccaccaugcccgacuaauuuuuuuuguauuuuuaguagagacaggguuucaccaucuuggccaggcugguugugagcuccugaccuuguaauccacccaccucaaccucccaaagugcugggauuacaggcgucagccaccgcgccuggcucacuauuucccuuucuguaucuuuuucaaaacgagccaaggcggcuaggcacagcggcguaugccuauaaucuaagcacuuuaggagaccaaggcgggcaaaucaccugaagucaggaguuccaagaccagccugggcaauauggcgaaaccccaucucuacuaaaaauacaaaaauuagcuaggcaugguggcacaugcuuguaaucucagcuacuugggaggcugaagcaagaggaucacuugaacccaggagguggacguugcagugagcugagaucacaccacugcacuccaggcugggcaacagggugagacucugucucaaaaccaaaccaaaacaaaccaagaaaacaaugagucaaaauuauugcuucucucuguucauucauuuaucuacaagugcucacgaccauuaaguuccucuucagauuuacauuuuagauguagagugucacuccaguugcuaagagaccucaauaaggugugcacugaccagggauaagaucucuuuaacuuguacaauuuuagcccacugcuaugguuugaguuaugucccaccaaaguacaaguguugaauacuuaauccccaaugagcaguauugagagggugggacuuuuaaugugauuuggucaugaggauuccauccucaugaauagauuaaugccauuauugugaaaguggcuuuguuauaaaagcaaguucucucacaugugcccucuugccuuuugcccuccugacauggaaugaugcagcaagaaggaccucaccagaugcuaaugcuaugcucuuggacuuccuagccuccagaaugagggaaauaaaccucuauuacuuacaaauuaugaagucuaugguauucuguuauagcagcagaaaauggacuaagacacccaccuuucaucuccagcauuauagauucaggcacaucaucucccucuacuuccuuccucaacuccagccucuucuuccaaucuuccucauuagggacaaccaccaccacuuuccgagagaaggucuugaacagcaauagcuuccgccguuggccagaauuguacacauuacacuaagaacaggaggaauaacugauguuuaggaagaaaauuaucacucagauuuaaccaaaagaaucaguaucagcugggcacgguggcucacgccuguaauccuagcacuuugggaggccgaggugggcagaucaucucaggucaggaguucaagaccagccuggccaacauggugaaaccucaucuauacuaaaauacaaaaauuaacucggcaugauggugggugcuguaaucccagcuauuugggaggcugagacggaagaaucgcuugaacccaggagauggugguugcagugggcugagaucacgccacuguacuccagccuggguggcggcugagcaagauuccaucucaaaaaaaaaaaaaaaaaaaaaaaaaaaaggccgggcgugacagcucacgccuauaauccuguuaucccagcacuuugggaggcugaggcagguagaucaugaggucaggagaucaagagcauccuggcuaacacgaugaaacccugucucuacuaaaaauacaaaaaauuagccaggcaugguggcgggcaccuguagucccagcuacucgggaggcugaggcaggaaaauagcaugaaccuacgaggcugagcuugcagugagccgagauagcgccacugcacuccagccugggcgacagagcgagacucggucucaaaaaaaaaaaaaaaaaaaaaaaagacucaguaucuuugacaacuuagacacgagauaaagggucaauacacaugaucuucuuuaacuuuucaaacuacaugacagguauuauccuguuuugcucaucagggaaacugagguucagaaaggauaagggacuuauccaagaucacaaaccagaaugugguggagccaggaauucaaaugaguuccaacucuuuccauugucuuuauuacauguuuuauagccuggguccauauauuuucaaguaaaaacacuaauuagggguaccucugaguucaaaaaacauugcaaccauaacacacaaccagauggucauaauuagguaagcugacucugcuccuuaauucagucucucuuuauauacacaucccaccuugacucuaggcaauuuuaucagauuaauaccugaucaagaauaaaguuccucuuuguccgggaagcaaucuggaccagcuuacuaaggcacugggaggcuugcugaacuaaaaggucucggcuuuugggguccaucucuggcuccucgagacccuucaucugauuaguuugagaggaagugaaaaaaaaaaacaaaacacaaguuauauugcaaguuaaagcccaagaguuauugguaaaugucaccucuucaaauacugaaucuaugauaucacucuauucccauucuucagugcugugaauguuguccauuuccugcaguagucauuucuaucuagucuuaaccuggauguauuucagaucucaucugcuuucagaaauuugacaacacagcaaagaaaaaaaaaaucaauccaccuaaaacgcauagagaaaaaucucauuucucuauuucugggacccuuguucucagacacuugagacuaauucuccauuaaagauagguuauaagagucuccaaauacuguauccgacaaauccccaacagcaacuuacccucauuugauugagcacagucucagcucccaggacauuguaucuuuucucaggguuuucuuuugcauauuucagugcccacugggucuuuccagauccggguagucccaccaucagaaucaccugcaaaaaacagaaccagaaauauaaugaaaaauaaaugagggucauguuuaucaaaaccaauuuaagaacauccucccauuccuguuugguaacgcucugagacccuggagagcauacgcacccaccucugcaaagcauacaaccucaguguucguauacuguuuggcauaccucacauuccucuauggucuugggagggacugcagugcguacacgcuccucaacaggcacagcaugaaugaacacaaacucuucugguggugggaagaagggcuccuccuucugaccgaaguuuaauucuacaacacaauuuuugcagaggacaugggguagaagggcccggucugccagggaauccuugcugauccagaaugccacaccuaggucuucuccauucuuggagaaggaaaguucuacuucuucagucucaaaauucuacaaugacaagggacaagagcacuuauuggcugacgaggcuuuggguugauuaaacuuuacaauuuauucuuuuuucacacagacugcugcacaaaguaacuaagcgagccacacacaucacaugcauaaaagccagcaguugaugggaagcacaagugaauucccagugcccucuauccgcuccuuguuauaacccacaacuuucaggagcacuuacagcaaagcagccaauaacaucauucuccccaaaagucuggccaaauuccucaaauuguccauuuucugccuugaguccucguccaucgaaaccguaagagaauucaucuucaccuagaacagucaacaaauuaguuaccuacaaccggacuucccauagaguaagcaauaugguaguaaacacuaaugaggaacuuaaagaaauaacuuuaccaagcuguggacgggaaaaaucaacagaccacccaacucgaaggagagagaccucugugcagccuucuuucauugggagauucuggguuaccuggccaagucagaaagggaacuauuagauauugugaccaacugaguagcaaacucugaguucgaaggacaagauuuuuauacaaacugaaaacgacauuuaccucaacucaacaucagaauaacaaucacugaacuuaaagccacagggaucaauuucuugguuacugaaacuaagguucuuguuaaagcacagugcuuuuaccuaccugcacuaauaaaagccugauuggacagaaguccaguauacauagguaguagcuuaaugaauaaaugaacggucuuuuuaaaaaaauauuucuuccccagccaggugcgguagcucaugccuguaaucccagcacuuugggaggccaagacgggcggaucaccugaggucgggaguucaagaccagcccgaccaacauggagaaaccccaucucuacuaagaauacaaaauuagccaggugugguggcgcaugccuguaaucccagcuccucgggaggcugaggcaggagaaucgcuucaacccaggaggcagaggcuguggugagccgagauggugccacuggacuccagccuggguaacaagagcgaaacuccaucucaaaaaaaaagagauaauaaucuucuuuucccccucuaagaaccguaagcauccaguaauaaaugaaugaaugaaugaauggucuuaaugagcuaccuuugccucaaagcagacuuuucccuuugucacuccguaaguacuccuugccccagaccaaaggguggggaacuucucugagaaaaguggcugcccuccauagcggucuuugcucacuugaaaaugcagauccgagguaucuguaaagaaagaagcaaucaguuuacuccaauguccaauacuuguaagccgccaacagagcauaaguauaccaguuguuguaguggauacaaagucucauagaauuuauaggcuaugaaguuuuaaucuccaaaaucacuuuuaggagauuaguuaaaaaccacagucugucugccuuauacauacacguguccagguucacaagaguuugauccuccuccucaucuuuugccucuucuucaggaggcaguggagacuuugagcuauauauguaagauagaaaagaaacacaauguaaacaaagcccucuucuuugagggguguguguguaugacauuauguccauuuuaaacugucagugaauaucaaaucccagcagacagcuuuuuccaauaaaugagaaagggcaauaggaguuuccaugguagaugcaaucuaaaacucaugccuauaaaaaccuauuccauuuugaauccacccuccuuccagucucuccagucaauaccagguauaccaaaaucagagcagacacucccuucaacgaaagggacuguuucccucaccggcugugguaagccuccucucggaauucauaguaagcucggccauguucauccuucucaucccgcugucucuuuaccccccgccgcucaccaucugagccugcugguuuugacuuuucacuauccuggucaucuccuacaaaaacgagggaaagaaaaucagcaguuuucauacuggaguguagaauaagcucacaacuaauagacacuaacagggaaucugagaaucugucugaucaaaacagccagguuauucccacuacauucacauaacauuuuauuucuaaagaucagcuuucugucauuggcugugauuuaauuuuuuuaaaaaggggcauuaugggcuaauuacagucaagcacuagauaaaaauuggacaauuuuugcauucuaaauuuauccacuuaaaucaggucaaacuugcagauuuccccaucaauaugacauaaaaaauauccucuaggucucuaagaaaaccucaaagguuaauuuaauuuugacucuugucagaucuagauuuaagguaggcaguuaguacauauuuuguaacacuuuuccacaccuucaugauacagagaagccucaauuucuuuuauuucccuuuccugcacugaaauacacagccauccauggcuuuauucauguggcaaauggacucaagugcauuauacacagcuguauuuuuaucagggacuucuacugaaaguugcaagagcaaaccacuaagucacaagagauccauaaauaauaccgcaucuagacugcacauuuggggcagaaagguguuguuguauauuuagcaacuucucugcaagaggaaaaaacuuggaguuuuucccuaggcuucuguauuuugcaacacuaggaagguuuuuaauaauaauuucuuuaaagcagucuuuuauccuucaauauauauuuuuuugagacagagucucguucugucgcccaggcuggaguguaguggcgcgaucucagcucaccgcaaccuccgccucccggguucaagccauucucccgccucagccucccaagaagcugggauuaccggcacccgccaucacgcccggcuaauauuuuguauuuuuacuagagacagggguuucaccauguugaccaggcuggucucaaacuccugaccucaggugauccacccgccuggccucccaaagugccaggauuacaggcgugagccaccacccccagccuauccuucaauuauuuuuuuaucugcucuuugggauauacauaagucaaagguuauguaaugggauuuuugcuccgggacacaggacaaacaaucugcaaguugcaugugauuguuguacaauggguuccgauuauaccaugacucuccauaguggccuaaaaauauuacuaacaaaagaacugaggccacccacuuuauaguaagacuuauccucccuacucggacacacacuguuauggaucaguucuaaccauccaaucacuucaaaagaaaggagaaaggucacuaacucccuggggcgauucuacaacacaccucuuccacaagguuacucaacggacccaacagcaccucagucauuaccauucaggaaccgagggaccugaaacguaaaagacuagcaccagguguucagcaaaucuacaaauaugccuauccacggacucagugggacaauuaaaauuuaaucauaauccaagcaagauaaaaacccuagccaaguaacguuaacuaacucuaaaugaacuagauuaagauuuuucucuucacugguuaacuauuaaacucgacacuguuacacuagaggcucucccuuacagcucaaagaggagcaagguuggauuuucagauucucuguggcucaagcucugguaacaugcuuuuaauggaacggacuuugacggacuucgauuuuugcuuaacauuuuuacggcgaaaaaguuaggucagguagcccaaagaccugacccucuaacugugggccuaguucuccguguaauccccaauugcuuagcacuuucucagcuaagaaaaauauaacaagcaccgugggagacuguuccacagguagcucacaaguaguucgcaugcaaaaucacucacugccauccacuaucaccaaggaaccaaguuaggcaggaaccuuccuccugcaaagaguagggccacgagaggcggccuaaccccucagaaagguggguagagaaugaaaggaguuccaucaaauggcacuuugaggcaagcgagaacaaggacucggacccugcggugcagggcggggugcuagaucaggggcgcagccggcagguuggagccgggcucggcugccagcuccucacccuguuccucggcggccuugucacccggcaccucggaucccggcgucucguccccgcuccgcuccucggguucgucuuccucccucuugccgaggcccugcucuucgccaccauuuaccccgccugacccggccguggccuccgccggcuucucggaagcaucuggcucggccgcggccuccauggcugccgccuccgggggcuccggcggcggcugcgcggccugacccaaggcuugagcaggggguggcuccucguccucguccucaagcagcgccuccucguccuccuccuccuccucuucguccuccuccucguccccgcccgggccgccgcccgacgcggccacaggccgaggcuccgccuugcaggccccgccgggcccggccccgccgccgccggccucguccucgagcaucucggcguccagcgccuccugcagccgcugcgccagauccaccuugaggccgcgcgaguccaggccccgccgcugcagcuccgaccgcagcucggucacuuucagccgcuucaccuccaucgccgccgccgccuccuccgccucccgccgccuccuccccugcgaaccgucgaccgaguccgaccgcgcaggcgccgccgccgccgcccgccuccgccucacgcgccagcacugagcccgcgcgagcgagcgcacgcacgcaggagcggaggccgcgcacggucccgcugcgcaguguuugcuucuccuucgucuccccucccccuuucggcucacggagcccaaaacaacgcagcagggagcuguuuccccuccaggcccuugguuccccagccgcgggcaggcgcgcgcggaggacgacggaguuccucccgcuuccucccgcccucuggcgcccccgggccaaucgccgccggugcuuuuaucgcgcagccgcaguggaguccaagacgggcaaggcuggcugcagcucaagugccucguagcacggaagcgugugcgcgccggucuuucaguacuuccagccggggaguucugcgcagccgcccggagcuccccgaugccaugccccucccaccacccuuacuuccgucugacuuccauuugcuguggcguuuuaggggucgcuagccucuuuucccuacugucugugcuugcagcaguaacgacaaaaaaaaagucauuagagaauguguugcaacauguaagccuaguagcaauuguuuuucuggcuaggaagcaaaagggcuccccagaacgaagaaauacuguaauccgggcccuccuuuuuccucaacgccucaacuucuacccagcaacagaggcccuugaacccgcccuuuuucucuuauuggacaacuugaaucgucauuugccguuccgauuggucauccgugaucguccggauuuuuccaauuggcgaagcugccaggggaauuuuuuuuuuuuuuuuuucccagguugguccgcugagga

SEQ ID NO: 18732 - RNA, 2616 nt, Homo sapiens
gucauaggcccagaccacgccauuugagagggggagucggccuuggccucagcucuguuggggaggucucuagcccagagucaggaugccugcaaugggggaggggcaggcagugaacuagcgacagugggggugugcgcagggaugcaggcagcuaggcucccccacuggccaggcaguugguaugcuccaggaucugagcagcuccuucuagcauccuucauccuucagguaccagccauccagacagugcuugagcugcagaaacugagaccagaccucuggccuggcccuccccaggggccuccuuucguauagucacugcuucugcaucagauacuuucagcugcaacucccuacuggguggggcacccauuucaggcagaagguuuugguacccuccacugacccuacacccagggcugcuacugccgcuuguggcuucagguaaguaauggccuguuuuucuccuguuggggcucacuggagcagacaggggugaugugcccuccucaucaggguugguugaggucuucagagcugggaacacacaugguuugaagggcugaaaagccuuaaaucauuuguguaagguuuaaugaucuguggcccaggccaugagggaguuuggggagcaccucaucccacccuauuuuuuuccaugaggaauacagggaugagacaguccacuggaggaggaggaggaggauaggaggggaacaaaauauugggguaugaccacagccuuguaaagguugguguggagugagcauggaggggggccuccagcugagacugugcucugagaggucccucuuuuuuccaggaugaaaggugagaccccggugaacagcacuaugaguauugggcaagcacgcaagaugguggaacagcuuaagauugaagccagcuugugucggauaaagguaggugggacccuggcuggcucccauuaguuggccaggcugugcugugcugcagguucccaaagcucaagauaagagaugcguucuuuccuucacucccugaggucaggggaggagucuggggcucuguagagagagcuguccccaggccucugggggggaugagggagaagacaagucguaaggagcccuggagauggcaaaagagaacccauuuggggagggaggcugcaguccccuucagagguccuggcuaacaauacccuuccuggcugugucccagguguccaaggcagcagcagaccugaugacuuacugugaugcccacgccugugaggauccccucaucaccccugugcccacuucggagaaccccuuccgggagaagaaguucuucugugcucuccucugagcuccccugucccuucucacaacuccucccuuuucccucuccugggcccuuccuuaggucaguaauuguugugagccccuuaggcuccuugcaucccaucccuaacccuugccugaccaugugagguuaucugaagcacaaggcccacccucaccuaucugucgaccccauuuccuaccaccuuuguggccgaccccaagcaccccagagauaugaggcacccuuugcuccacccacagcagggccccgucagacucugccagcgcguccugcccgcuucccucggugaccugcucagacaauggagagggaugggccagguucuugcucucagucucaccuggagcuacugggaggguaaagccauuugaagaauaaagucauccagagccucaggacagcuccuguguuagaauucuuggggggagaggaucaucaagcaauagaucugccauacccagggaaaagggccaaucaaugcaggcuagacaucgucaaggaucggagaucagaggggucgggggauggcgggcgcgagagagcguccacaguguaagaauuaaguacaaaagacgcucaagaggcugcgaagagcaaacacacacacacaaacgugcaacgaagccaaguuaaaagguaaacaggccgaagaggggggauuuaggggagggugcgggagugcagucguacagcagaggaacucuuaggaggguaggggcggagcuuggcuucaguuaccgcgacuggagccgauuuuauaccuaagauggcugcgcccacagccacucccauuccaagauggccguaccaacauggcagcccccacgucacggaguuuaccguacagggcuucucuuaaaauggcggcccccaggcaaccggcguucucaauauggucccuuccgcccucuucuggucucaaaauggcugccccugcccuaaccaagccggggcccgcgcccugcaaccccgaaaucuggauuucgguguccucccgauugagucgaaggcacacgggcggccauaacgaagaaucacuaaacaaggggaccccaggaaguacagcguggccgacgcuggucgcguggaucuugcgagggaaucuagguuucuacauuuugccaagaaaggagaggcucccuuuggagcggaaauauuagcggcaggggguuaacccccgacccuguccgucucggugcaccgcuccucaguugcuuccuggucuucccaggagcuggauaagccugaaguugcucaguuuggguuuccuaguagaac

SEQ ID NO: 18733 - RNA, 3406 nt, Homo sapiens
acuccccuuccagaacccaggcauccugggcuccagcugaaaccauugcauguggcuuuccccaucccuggccccgugacucagucccucugaagggagcagcccucuuuuuuggcaaucaccagggagguggggggaggaggaggggagcuagguggugacaucacagucgaagguuauaaaagcuuccagccaaacggcauugaaguugaagauacaaccugacagcacagccugagaucuuggggaucccucagccuaacacccacagacgucagcugguggauucccgcugcaucaaggccuacccacuggugaggagcugcuaugggccagagaggaggagggaggcaugcaggggccaggacuccuuggacaggauuugcacagauagcagguggggagggaggauuccagcgucccuauuuuuuucucuuguuuucaaaaaauacagcugugcuuacaauauuucuccauucuguucucuuuucucaacucugucuccuuucuggguuuuugccugugucacugacggauacauguuuuuguugaguugaggucucacucuugucacccaggcuggaguguuguggggcgaucaugguucacugcagccuugaacuccugggcucaagugauccuccugaguagcagggaccacaggcaugugcaguauauuuuuaauguuuuuuaacuuuuuaauaauuuuuaaauacuuuuuaauuuuuguagagauggggucucucuguguugccccagcugguuuggaauccuggccucaagcaauccucuugccuugacuuccccaaaguguugggauuauaggcaucagccuaggggcccggcuuuguuacuuguuuugcuuagaucuuuucucuggguggcagcuaguaaauauccuaccguucuucccugggcuaaguaaaucauguccuccucuucucucccucagcacuuuguuuauucauuaacuguuucuaauacuuaacacaugcugaucaugcaucugucucaugugucagaucauguuuuauuuuuugucugaaaccaagcacacagccuggacucagaaguugguugacaaaugagugugucugccucauuccaacuucuuuccucuucugauccccaguugcauuuuccugucuccagagauuguguccaggcagagggcauggcaggcuuuugggcugaacaggcuuuaucuauccaccccuucccuuccagucuccaugcugggcucucccugccuucuguggcuccuggccgugaccuucuugguucccagagcucagcccuuggccccucaagacuuugaagaagaggaggcagaugagacugagacggcguggccgccuuugccggcuguccccugcgacuacgaccacugccgacaccugcaggugcccugcaaggagcuacagagggucgggccggcggccugccugugcccaggacucuccagccccgcccagccgcccgacccgccgcgcaugggagaagugcgcauugcggccgaagagggccgcgcagugguccacuggugugcccccuucuccccgguccuccacuacuggcugcugcuuugggacggcagcgaggcugcgcagaaggggcccccgcugaacgcuacgguccgcagagccgaacugaaggggcugaagccagggggcauuuaugucguuugcguaguggccgcuaacgaggccggggcaagccgcgugccccaggcuggaggagagggccucgagggggccgacaucccugccuucgggccuugcagccgccuugcggugccgcccaacccccgcacucugguccacgcggccgucggggugggcacggcccuggcccugcuaagcugugccgcccugguguggcacuucugccugcgcgaucgcuggggcugcccgcgccgagccgccgcccgagccgcaggggcgcucugaaaggggccugggggcaucucgggcacagacagccccaccuggggcgcucagccuggcccccgggaaagaggaaaacccgcugccuccagggagggcuggacggcgagcugggagccagccccaggcuccagggccacggcggagucaugguucucaggacugagcgcuuguuuagguccgguacuuggcgcuuuguuuccuggcugaggucugggaaggaauagaaaggggcccccaauuuuuuuuuaagcggccagauaauaaauaauguaaccuuugcgguuuaagaggauaaaauggaggauauuauuauguggguauuuauaugaccuuuguaaccauuuaaaaauguaaaaacgaccugacuuaguaaugcgaaccuauaguagcagcuacuccagaggcugaaaugggaggaucucuugagcccaggaguuggaguccaguccagccagggcaacacagccagacgcccuuguuuuuuauuuuguuuuguuuugguuuuuuguuuuuugaggaguuucccucugucacacaagcuggagggcaauggcgccaucucagcucacugcaacguccaccuccuggguucaagcgauucuccugccucagcauccuaauuaguugggauuacaggcgcccaccaccaugcccggcuaauuuuuguguuuuuuuaguagagacgggguuucaccauguugucaggcuggucucaaacuccugaccucagguacuccacccgccuuggucucucaaagugcugggauuacaggcauaagccacugugcccaggcagacccccuucuuuaaagauguaaaacccggccgggcgcgguggcucacgccuguaaucccagcacuuugggaggcugaggcgggcagaucacgaagucaggagaucgagaccauccuggcuaacacggugaaaccccgucucuacuaaaaauacaaaaauuagccgggcauggugguggguaccuguagucccagcuacuccggaggcugaggcaggagaauggcgugaacccgggaggcggaucuugcagugagcggagauugcaccacugcacuccagccugggugacagagcaagacucccucucaaaagaaaaagaaaaaagauguaaaaaccauucuuaguuugugggccuuacaaaucaggccacuggcccauugcuuguaguuaguugauccaugucaugcacccuaaaaauggcucugucacugugaguggcuucaguaggauuuugagaauaaguuuauauucuugcuagguaaaacaaaacaaaaacgacaguaauaccaaggaaucuccccccccuuuuacccuccauuuguguuuauugcauauccacuauaacaacauuaaaggaccuuuaaaaggaaguaauuuuuauuguuuaugauuccuuucaagucacuguccacacacccauuuuucagaguaauauacauac

SEQ ID NO: 18734 - RNA, 2835 nt, Homo sapiens
uaggaguaaaaggugccauccaauguacucuccaccccuuuuagcaccucuccuccgcaacuuccccagcaguuaaucagacccagagauuacaaacaagugucuuuguuggaaacuaaagaugaggaagagggucuacuguuccguuuuagccucuuccucugccuuaguuuugucccucccagccauucaggaaggagucaggcauguacagaacucagggucuauuuauuaggaaggagaugucagugcuuuaucaaagaugaaggggucacagagggacaaugggacaaaggcccucagcugggacauuucuuggccacaaugagaacagcagaaggcacgaguccugaagauggaagaaaacaggcuugaaccacaaggauacuugguuuuugcucccaaaauuccuggccuugcaccauguucacaaagccccuucucuuugcaucccuccuuuuccuaggcaugccucccuacucccccaguuucuaguccugguuucuagucuugcagccauacccagcuccugcagaggccgcuccaugucagcuucugagaaggcccgucuggggaagccacugagcaauugcacaggguccuggcccccaccuaguuccuccccacgguggagcuccacauagagccucacagcugccagcuguucccgggcccggaacgucugggucagugaggucccaucuggcagccugaccuaaagggcaagggagauacucaguauugugggcaucaaaacugaaugaggugcccaaguaaggaaaagagcuaaagcugggcccccuucuucuuagauugaaccagcacaacuacuauuuaaagcaccaaaugaacagccacuuaggcuccgcuuuacuaagugcggaugagagacucccagcucccucacaaccuaagaaagacaaggauaagauuauacaaaagaaucuggauaaauaccacaucaccagauagcuacauaauaaaccaaauaaaaacaugaacaaguaaaaggguaacugcugaguaagagagagguauggguuuaaauacaacuggggcaggugaaauuugauaccuuucccaagaguagagauaggauuucaaaagucauuuacaaagaagggagagauuuggcaaagggcacguuaacugaaaaaagcucugagcugggcaccuuaacacggaacaaaggggucccaagaggaagauaagaauuagaaucaguaccuguaugcgacacuggucauacucccgcuuggugggaggcuccuggcugggagaagagggaacaggaccuggcucuggugccacuggggguggcugagagcccacacugccaccauacuaaagggcaaaguaaaacagucaaucagguacucacccauccucaggugaaacagaucauauaagcccaugcuuucccucugaagcuggaaaagauuuacuaaccugcccacuccauuacccguggcgucuucucagucaccuaccuucuuggcucucucugcuuugucccucucgaucuuuucucuaacucuuugucugaaauguagacaagaagaaauuaggucagacaucaacaaagcaaaucuugauuucuuucucaucugcuauccaucauuuccccugcccagaccuggcugcuaacuccucggccuuuucccuccgccucuccucagcagcccggcgcaucucaucuuccuguagccgcugucgugcugcugacaacucuugcccuugucuccugcgcugccguucccguuccaaugccucccguuccucucuuucuucacgcucccgcugcuucugggccaccagcuccaacauccuguguugccgagggaaaacaguucaagagaaauggacagagugggaagguguaaaguuuacaauaaacaaaauuaggcgacauauaucccaaaguagauuaaaggaaaagaaaaugccaagaaagaggaaauguggaaaggucaagguucuuugaccagacguguacuggggagagauggaagacgacccucagacacgugagauuguuguuacuguaccucuuaguuuguuccugucuuuccucuucacucaaagcggguuugccuucuccggcagcagaaccagauccuacaaacaaacaaucgguauuauuaucccuucagauucuccucggacccuccugaauaaucacaccguggacccucagucaggaccuucaaggccgccuugcucugaggaagugggcucccgucccaggauauguccaaggggagucucuaaaggcucguccacaucggggucgucuucgugcuccaucagccuggcagggaaagugggcggggagguuagcuuugaggcugccccucccgccagcccccaauucuccgccacccgggacgagcgcuuaccaguccaucgcagccucgaugcccugguucccugugagggccagagccuucucccugggggcagaaacaccaugaauagcgcccacgagccauggugacggucaggcuggggcaaaggccgagacagguccgcgaccccccacacccgcaggccgggguuggggaacucccuuacgcgcguccccuggggaagcccaucucgaugagacucucaagagccgucagcuccgccauggcgccgacaccgcggcuuccgcggggaccuggugugugacgagaaggagggcgggaagggucagcgcgaggcaacccgcccucgacacccgccgacgggcgcucgcucucucacccggcucuauagcagccgggaacaccgacgagaagaaagccgaggggaagcggaagugccggaucuguuugggucacgugggggcgg

SEQ ID NO: 18735 - RNA, 1506 nt, Homo sapiens
cugcuauagggcgcucuagccugcgccaagggguagugagaccgcgcggcaacagcuugcggcugcggggagcucccgugggcgcuccgcuggcugugcaggcggccauggauuccuugcggaaaaugcugaucucagucgcaaugcugggcgcaggggcuggcgugggcuacgcgcuccucguuaucgugaccccgggagagcggcggaagcaggaaaugcuaaagguagaagcaacugguagucccgaggaagggugggcggguggagagccccggacuggagcuccugcgaacuccccuuccugcccucaggagaugccacugcaggacccaaggagcagggaggaggcggccaggacccagcagcuauugcuggccacucugcaggaggcagcgaccacgcaggagaacguggccuggaggaagaacuggaugguuggcggcgaaggcggcgccggcgggaggucaccgugagaccggacuugccuccgugggcgccggaccuuggcuugggcgcaggaauccgaggcagccuuucuccuucgugggcccagcggagaguccggaccgagauaccaugccaggacucuccgggguccugugagcugccgucgggugagcacguuucccccaaacccuggacugacugcuuuaagguccgcaaggcgggccagggccgagacgcgagucggauguggugaacugaaagaaccaauaaaaucauguuccuccacccagaaugagcccugcagucgacaccuaccaaugcuuagagacgcguggucggugcugggggcgcggccuggagcugcugccugucccaccccaccagaagaggcugaucccgauagguaucugaccacauuuuuuuuuuuuuuuuuuuuuugagacggagucaaugucacccaggcuggagugcaguggcacgaucucggcucacugcaaccuccgccccuggguuccagcaauucuccugccucagcuucccgaguagccgggaucacaagugcgcgccaccaagcccagcuaacuuuuguguuuuuaguugagacaggguucaccauguuggcuagacuggucucgaacuccagacccaggugauccgcccgccucggccucccaaagggcugggauuacaggcgugaaccaccucgcccugccgcggccacauuuuuucuuuuuuuugagauggagucuugcucuugucacccaggcaggagugcaguggcgcaaucuuggcucacugcaaccucugccuccuggguucaagcuguucuccuuacucagccucccauguagcugggauuacaggcguccgcaaccacgcccggcugauauuaguaguuuuaguagaggcggguuucaccauguggccaggcugaucucgaacuccugaccucaggcaguucacccgucucagccucccaaagugcugggauuagaggcgugagccacugcgcccggccaaccacauuuucaaaacaggucauguggugucagguug

SEQ ID NO: 18736 - RNA, 3269 nt, Homo sapiens
ugaacagcuucuucuucagcuccugccggggagaaagaugcgaaucagauggagugggcucgccgcgacccggggccccuccaccaggcagccccggccccucacugaucccaucucgugcgagauaaaagggcucaggaacgcuugaggaaacaaagucgcggcccccacacagucaccguucggggccgguugaucuuuccccccggagcucccauagucgcgauuccacuccaguucacgguccguacuuccgcucagcgccggauccgcggggcuccgccccggccuuccgcgggccaaucgcaacucgggggcggguccucgggcuauauaaaggagcuccgcggugcgggaggccuuucggaggguggugagcuaguaagugugguuuuagcuguaguagccagauugggcggccgggaguggugggggugccggguggaaggcucugggcggggucucaggacccuccuuuucuuggcggggaucgggcuuguggugccgcuccccguaauguacggaggaagagggaaagggcucuggcccccucggcgucaugucuucggugcuggcggcuucccauccgcugguucuauccucaaacgccgggacaccgggaaucucggagaaggacaaccgagauccagcuggcuccuccaucggggugcucacacuuucucauuugauuucaggucugcggacgcuguauacccuccuccacuucccgcugcagccaauaaaggccguuccuaccauagucuguguccgcguucuuuuuuccgggacugcagaguucggggaagcuguacgccgccuuucgcuacgcggaauuugcagaucuuccccuggaccucaggccucuccggcuggaguaggguggacgcuucacauaagcuucucuggucgaacuuacccgaaucuccagauggccgcgcugcgucgaaugcuccacuugccgagccugaugauggggacgugccgccccuuugcggguagggaggugggggcagaguggagagggcaaggugggggcagaguggggaggguaagguggguuccucgugagucaggaguguagucccugaaauugugauucucaaacccuacggugggccgugcgugguggcucacggcuguaaugcuaacacuuugccaggccgaggcgggcagaucgcuuggcccaggaguucgagaccaaccuagggcaacauagcgagacccugucuacaaaaaaaauuaaccgggcacgauggcgccuauaguccuagcuacucaggaggcugagguggaggcuucagugagccaucauugugcuacuguacucaacccugggucacagagugagacccugucucaaaaaaaaaaaagacgccaguguguauauacgacguuuuugcaguggcgacauagaccaagugacacccuccaaccgugcccacaggcucacuggcugauaguugccuggcggaccgcugucucugggaucggcugcaugcccagccucguuugggcacuguccccaccuucgacugguucuuuggauacgacgaaguccaggggcuccuacugccauugcugcaggaggcacaggcugccaguccucugcgagugcuggaugugggcugugggacuuccagccuauguacaggccucuacaccaaaucuccacacccaguggaugugcuggggguggacuuuucuccuguggcuguggcccacaugaauagccuccuggaggguggcccaggccaaacaccucuaugcccuggacacccugccucaagccuccacuucaugcacgccgaugcucagaaccugggggcuguggcuucuucaggcucuuuccaacuacugcuggacaaaggcacaugggaugcuguugcccggggaggucugccuagggcuuaccagcuucuaucagaaugcuugaggguucuaaacccucaggggacccugauucaguucucagaugaggacccugaugugcgacugcccugccuggaacaaggguccuauggcuggacugugacugugcaggagcuaggcccguucaggggcaucaccuacuuugcuuacuugauucaaggcucucauuaaagacauuuuaguaguccugacccuaguauuucugugggcaaggagagggcugaagaacugucuuugcaagcuaucuggcugcaaagugagaauuugaguccuggcuuccacauuuacuagcugggugccauauugcugaauguuucuguuccccaguuuacucaucugcagagugagaauaacuuggaguuacggagauuacauacaaugaugugcgcaauauuuagcacaaaaugaaugcugaaaagagaagguacaauugggucauuccccaguuucaacuaacuggagcuccuaaaagcagcagacaggaacugaaucaaaaccccugcgcugacugacuuguauaaucuaguggccuaaccuguaagccucauuuuugucaccuguaaaaggagauuguaagaggauggguauaaggagcuucauaaaccuggaugagauauuugagggggagggaacaauacuuacccucaaagcuauuaggaggcaggagaugggaauauuccacaaagccacuucuacaaacacgggagccuguugagucccagaagggacagugguugguggcuuccagacaugcuguguccucaagaauccaacaagcaucuucuucauccugguccugcccccagcugaguccagcguuaaauguucuuaaaggacuucuaggguccugugggcuccaagcccagccugggauggaggaagagaggggacaaaaauauuacugauauauuaucaaauuacaaaacuaggccaggcaugcuggcucauaccuauaaucacagcacuuugggaggccaaggugggcagauugcuugagcccuggcaauaaagugacaccccuaacucuacaaaaacaaaugagcccgggauaguggcacaggcauguaguuccaacuacucaggaggcugagcugggaggacugcuugaacccugggaggucaaagcugcaaugggccaugauaagcugcugcacuugagcuaaaaauuaauuucugugguauuuuuugcuuauaaaaaaauagagcaauuauaucacuaagagccuaaccucgcagccucaauuuucucauuuauaaaggggaaguaccuucauuggguuguucugaaaaucaugaaguaaaaguguuuagcauaguaccugguacauaguaaaugcuca

SEQ ID NO: 18737 - RNA, 22559 nt, Homo sapiens
gccggaaggggcgggaacuaggauacguggcugagcgcgcgcgauggggcgggagguuuggggucaaggagcaaacucugcacaagauggcggcgguagcggcaguggcggcgcguaggaggcggugaggagcccggaaucugggggcgcgcccgggacgcccccagaucccccaagucccauuccacuccuuccugugugucucuugacacucugccacccccggccucgugaggaaccuuuguuccucuggaggcggccucagacgccuccggucuccccgugguagauccgagcgacgcugggggccuugccuguggggcuccgggcucccgcccggcgguuuaguaaagccacagcugugcgucuuucuuggucuuggccgcucucagccgccgcccuccuuuggcugcuugcggcggucaacgucgccgcccccuuccugcagugcgcggggucgucggggcgggggaaaagaugcggccuggccucggggaaugcagccugcggccccgcggccccucggcugagcuggaagcaccgggccagcaguuaagccuguacuacccuucuggcucuacccuguagagcuccgaauccuccucugcccuugucuucacgugagcaccagcucuggcuuaguucaguguccacggucgcugggcacggcccaggguccaguaagcucacggcguggaugguguugcucaaacacaacauguaaucgaauggcuugguccacgcucucggguuuauauuacuggggaaaaaaaaagauucgaaacauaucaccagugccacaaauguuuacuaggaccuaacggauauacuggggugggguaggcguguacucuccaaagcgaugaagaaagcguggaucauaaacucaguucccucggagccugugaucugaaacaauaaaugcgugcaacuugcccugcagcuuauuccugacuuuggccuaugaacaccucucuugggguggucaaggccgccgugaauuccuuagggcccuccaacaggucauaucugaaagaugcuuuaggaauccuaucuccauuggcaucuuuccgaaccaauuuuacagacugugcaaauagggccccagaggguauuuaacucacuguacgucuuuuuuuuuuuuuuuugagagacagagucucgcucuguugcccaggcuggagugcaguggcgagaucucggcucacugcaagcuccgccuccuggguucacgccauucuccugccucagccucccgaguagcugggacuacaggcacccgccaccacgccuggcuauuuuuuuguauuuuuaguagagacgggguuucacuauguuggugaggaugaucucgaucucuugaccucgugauccacccgccucggccucccaaagugcugggauuacaggcgugagccaccgcgcccggccucaacucacuguacuucuauuuacugcugcuuuuggcagguggacgugggucaguggccaagagugccuguugcagucacucaggucacucacugcaggaccugugccgcaugccuugcuauggaguuuugugguagcauuuauucugcuuggccuauuaaaccacagugccuaguguuuucuucauuuuucugucuggccugcuguggaacaguuguuucguacauuccucuggagcuggaggagaguccugugaugagaucauaguacacucugugaucucauuucugguaauuuucuuuuagcuuucaagcagaugcugaagcuaaugcuagauaacuagauacaauguguauaauagacccugucuuuaguuaccuuauuauagguugucaaauuuuauuuauuuauuuauuuguuuguuuacuuauugaaacagggucucgcucuguugccuaggauggagugcaggggugcaaucucggcuuacuccagcuuccaccucccgaguucaagcgauucuccugccucauccucccgaguccugggauuacagacgugugccaccgugcccagcuaauuuuuguauuuuuaguagacaccccauugaccagucuuaauuaauuuacuuuuuugagacagagucuugugcuguggcccaggcuggagagcaguggugcaaucguagcucaugcagccucaaacucuugcguucaggcaguccuccggcuucagccuccugauuagcugggacuacaggcaccugccaccaugccuugcuacucuuuuuuuuuuuuaaguagagacgaggucuugcuguguugcccaaucuucccuuuuugaccucccaaagugcuaggauuauagacgugagccacugugccuggcugguuguaaaacuuuauugcuuagaagaacccucccacccccaguuugaaacacuuucucagaguaugcucguauucugcccauaucagugucacugggagagcauguuuaaaauguggugucagccgggcacgauggcucacaccuguaaucccagcacuuugggaggccgaggcuggcgaaucaccugagguugggaguucgagaccagccugaccaacacagagaaaccccgucucuacuaaaaauacaaaauuagccgagugugguggcacgcgccuguaaucccagcuacuugggaggcagaggcaggagaauugcuugaacccgcgaggcagagguugcggugagccaagaucgugccauugcacuccagcaugggcaacaagagugaaacucaguuucaaaaaaaauuaaaaauaaaaugcgguauccagggugggugcaguggcucacgccuguaauuccagcauuuuggaaggccaagguggaaagauggcuuuagccuagaaguucaagacaagccugggcaacuuuuuuuucuuguuuuugagacagagucacacuuugucacccaggcuagagugcaguggugcgaucucagcucacugcaaccucugacucccaggcucaaaccauucucguuccucagccuccccaguagcugggauuauaggcaugugccacuacgccuggcuaauuuuuguauauaucuauuuuuuucuaggugguguuucgcugugucgcccaggcuggaaugcaguggcacaaccuuggcucacugcaaccucugccucccggguucaagcaauuuuccugccucagccuccugaguagcugggacugcaggcgugugccaccaugcccuguuaauuuuuuuuuuguauuuuuaguagagacgggguuucaucauguuggccaggcuggccucaaacuccugaccucaggugauccacccgccucagcuucacaaagagcugggauuacaggugugagccaccacgcccggccuaauuuuuguauuuuuaguagagauggaguuucgccauguuggccaggcuggucuaacuccugaucucgugaucugcccaccugggccucccaaagugccaagauuauaggugugagcuaccaugccuggcugauucuuaacagacauuaaaauuugagaaucucuguuuaggauuuauucagaauccuaaggaugaauccuggaugaauauauucuucaaacuaacuuauuuaaauaagccuauuagucucuuaucugucauuucauagcacauugggaaauugacaauucgugauaaccuugggaugaugguccucaaugagacaggcccauuucauccugcuagugauuagugugcuguauugugcaucaugguaaagcacaugggccccagagucaagcacaacuggguucaguucguuucaucccuuaccagcuauuuaaucuugggugaacuauucaaccuuuuaugcuuuaauuuucccaucuggaaauaaaccccaacccuauauucaccaagaaaacaauggaagaaagggaaaagaagaugcauguaaagaagugguugugaacccagguugcucauuagaguuguuuagggaacuuuaaaaaaacuuuagccaguggggcgcgaugacacaacgccuguaaucccagcacugugggagacugagacgggcggaucuaggucaggaguucgauacgagccuggccaacaugaugaaaccccgucucuacuaaaaauacaaaaaauuagcugggcaugguggugggcaccuguaaucccagcugcucgggaggcugaggcgggagaaucgcuugaacccaggaggcagagguugcagugagcugagaucaugucacugcacuccaaccugggugacagagcaaggcuccaucucaaaaaaaaaaaaaaagucugaugcccaggcuucucucugauuaaguuaaaauuuuuagaagugagaccaggucacugauauuguuaaaaacugcaggcaggcugggcacaguggcugacacuauaaucccaacacuuugggaggccaagaugggaggacugcuugagcccaggaguuuaagaccagccugggcaacaaagugaggcccuguugcuaccaaaaaaaauuuuuauuuauuuuuuuugagucagagucacgcucuguugcccaggcuggagugcaauggcaugaucugcucaguguaaccuccaccuccugguucaagcaguucuccugccucagccuccugaauagcugggauuacaggccccugcucccaugccuggcuaauuuuuguauuuuuaguagagaugggguuucaccauauuggccaggcuggucucuuugccagccuggucucgaacuccugaccuugugauccgcccaccccggccucccaaagugcuggguuuacaggugugagccacugcgccuggccagaaaaaaaacaaaaaccacaacuuuuuaaaaauuagcugggugcuguggcgagcaacuguagucccagcuacuugggagggugaggcagguggaucaccugaggucaggaauucaagaucagccuggccaacauggugaaacuccgucucuaccaaaaauacaaaaauuagcugggcaugguggcgugcuccuguaauucaguuacuuaggagguugaggcaugggaauugcuugaaccugggaggcggagguuacagugagcugagaucaugccauggcacucuagccagggugauggagugagacugucucaaagcaaaaaacaaaaacugcaggcaguauuaaaaacuaguaauauaaagugauuacccaggccccuaggggugcauuagggcucagaacauuuuagcuauuguuauuuuuuuucagcuuuggguagugauggugguguuuugaagauacaggaguagaaaucagagaaacaggcugccuagggugcuagggauguuaggacccuaggaacuguaaccagcaggcuagcugaggguacaucuuuuuuuuuuuuuuuuuucugagaguuuugcuccaucaccuaggcuggagugcaguagcacaaucuuggcucacugcaaccucugccucccggguucaagcgauucucaugccucagccucccgaguagcugucacuacagaugcucaacgccaugcccagcuaauuuuuguauuuuaaguagagaugggguuucaucauguuggccaggcuggucuugaacuccugaccucaagugauccacccgccucagccucccaaaguggugggauuacagacgugacaugagccacugcgcccggccuucauguuuagcucuuuaacuuugcauccacccaaugccuugccgauagaaagauguggcuugcuuuguuucucuguuccacgcauaugguacuaccauuuccucugagacuggcuguuacugcuccuuuccucugagaggcugaugucaccagagucaacaccagggccucugaaggugaaagauccucuguguacucugccuuuuuuuuuuuuuuuuuuuuugagagggaguuuuacuuugucgcccaggcuggagugcaguggagugaucucagcucacugcaagcuccaccucccagguucacaccauucuccugccucagccucccgaguagcugggacuacagcugcccaccaccacgccuggauaauuuuguguauuuuuaauagagacagaguuucaccguguuagccaggauggucucaaacuccugaccucgugaucugucagccuuggccucccuaagugcugggauuacaggcaugagccaccgcacccggcccuuuuuuuuuuuuuuuuuggagauggagucucacucugucacccaggcuggagugcaguggugcgaucuugacucacugcaaguucugccucccggauucaugccauucuccagcuccagccucccaaguagcugggacuacagacaccugccaccacgcccggcuaauuuuuuguauuuuuaguagagacgggguuucacuguguuagccaggauggucucgaucuccugaccucgugauccgcccacuucagccucccagagugcugggauuacaggcgugagccaccgcgccuggcuuuuuuuuuuuuuuuuuuuuuuuugucuagcucugucgcccaggcuggagugcaguggcacgaucuuggcucacuguaagcuccgccuccuggguucacgccauucuccugccucagccucccgaguagcugggacuucagguggccgccaccacgcccagcuaauuuuuuuuguauuuuuaguagagacaggguuucaccguguuagccaggauggucuugaucuccugaccucgugauccgcccgccgcagccucccaaagugcugggauuacaggagugagccaccacgcccagccuacucugccuuucaaagggaaggugugagugagccaacuucucaggccugauccuuaacccuguguccacucugccuuguuuuguauuugaugugacuacaucuuucuccccucuuuccucaacuaucuucuagugcuaugacaggaagaagcuuuuccuuuugaagggggccccuucugaccuccaugcugauugcucugucuuuguccuuuucuccuuaggucuugggcgucuuugguacuggcuuuuuuaggggucugccuggggauuacccuugcuguggauagaagcaacuuuaagaccugugaagagaguucuuucugcaaguaugauauuucugggggagagggauggaauguaggguuguaggguaaugugggagauaucuguggcagauggagugccuaaggacacugcaggugauagacugacuuagggacauugcagguggccuuuaccuuacuucccaacccuucacuuggcaggcgacagagaagcauacggccaggccucucuccauaccgagccuugcuggacucucuacagcuugguccugauucccucacgguccaucugauccaugaggucaccaaggucaggagagacaaggaagagucugguggggguggggcaauggcugugggguaauuuggaaagggggaaauuguggccaacaucuugucccagccuaaucuuuggacuuuuacuuuaugaagaaaugugaucuuggccuuuaggcaaagggcucaaaggaagaaaccccuuaggagagaauggguucaaagagcauuccaugguguaucccauuuccuuucuccagauccaaaccucuguccccgcagguguugcuggugcuagagcuucaggggcuucaaaagaacaugacucgguucaggauugaugagcuggagccucggcgaccccgauaccguguaccagauguuuugguggcugauccaccaauagcccgguaaauuuuuccugagaaacauccauuucuguggccccuuucuccuuccugaugaaccuuuuuuugguugcugauauucuuucccaaaauaagguaguaguuaacuagcauagcaccuugccauacuccucaaccuuuccccaccucuucuucuguuucacuuuucucuuuaucccuuuauccucauucauucauucagcaaacaauuauugcuuuuuccucccugacaggccugggcuggaugcugguuauauaagcagaaauaaacaaggcccuguuuauuuacagaucucguucuccaggaauacaaugucuaccugcuugcuuguuugcuugcuuccuuccuuccuuccuuccuuccuuccuuccuuccuuccuuccuuccuuccuuccuuccuuccuccuuuccuuuuccuuagauauucagaauaggauuacucagauucuugugucaugauacucugucaccaguguuccaugcauccauccaugacuuucucuuaaauacauaauucagaaaauaacauaguggccgggcaugguggcucaacgccuguaaucccagcacuuugggaggucgaggugggcagaucacgaggucaggaguuggagaccagcuuggccaacauggugaaaccccaucucuacuaaaaauacaaaaaucagccaggugugguggugcggaccuguaaucccagcuacucaggaggccgaggcaggacgguuacuugaacccaggaggcagagguugcagugagccgagauugugucacugcacuacagccugggcgacagagugagacuccgucucaaauacuccacccuauaaacucuucacucagcccaacccgcacuguccuguacccuugacggcuccagacguagguagucguuauucugaagcuuauccuuccuuugccuuuuuuuuguucuuacaguuguauuauguguguauacauaugcacacauaugucugugugccuaagcaauaaauuauauauauuuuuuguuuuugagcuuuacagaggaagugucuuagugcauguggucuucugggguuuccguuuuuucuuuuuuuuuuuuugagauggagucucgcugucucccaggcuggaguacaguggcgugaucugcguuagccaggauggucucaaucuccugaccucgugauccgcccgccucagccucccaaagugcuggaauuacaggugugagccaccgcgcccggcuggguuuccguuuuucacauaacuuuauuuaauuccauuucauauagcucuaguucauucauuuuuacugcugcauauuauuauguuguaugaauauaccccaacugauuaauccauuuuuagguugauaagccuugggguuguuuccaguguuuugcuagccaaaguguugcuacgaaccuucuuguacaugucuccuguuauccuugcuugggaguuucucuuugguguauaacuaggagaggaauugcaggauuguagaauauggagaugaucagcuucgcaagauaaagccaaagugguuuaccaauuuacacuuccaccagugauuuauaagaagcccucauugaagcugggcaagccaggauggucucgaucuccugacaucgugaucugcccaucucagccucccaaagugcuaggauuacaggcuugagccaccacacccggccagccuucccuauuauuaauaugacuaugguucauuugugauaccuagugaauugauagugauacauuaguuacuaaaguucauacuugagguuucuuuaguuuuuguguauguucuuuuucuguuccaggauuucauccaggauauguuauuacauuuaguugucauguuuccuuagggcccucuagacugauaaaauuucuuagacuuuuccuuuuucuuaaugauccuaaagguacuuuugauaaacagaaauuccuaauuuuaauguauuuagauguaucagucuuuuaccuucuguuguuagccuuuuguuuguuguauuuagucuuuaucuaccccaaggucagaaaaaaauauauauauauauauuuuuugagacagagucuugcucuguugcuuaggcugagugcaguagugcgaucuuggcucaccacaaccuccgccuccuguguugaagcgauucuuucuucagcaucagccucccgaguagcugggacuacaggcgugcaccacuaugccugaguagcugggacuacaggcgugcaccacuaugcccgaguagcugggacugcaggcucaugccacuaugcccaaguagcugggacuacaggcgugcgucacuauacccggcuacuuuuuguauuuuuaguagagacaggguuucacuauguugaccaggcuggucucaaacuccugaccucaugauccaccugccucggccuccgaaagugcugagauuacaggaaugagccaccaugccuggccaaaaauauauuuuuuaauuuucuucuaacacuuuugcuuucauuuauuuacuuauuuugagaucggguuaugagacuggcuaauuuuuguauuuuugguagagauggguuuuugccauguugcccagucuggucuugaacaccagggcucaagcgauccaccugccucggccucccaaagugcugggauuacaauagugggccaccgagcccauccuaaagcuuuuacuuuuaaauuuuaagcaggcugggugugauggcucauaccuguaaucccagcacuucgagaggccaaggcggacagaucacuugaggucaggaguacaagaccagccuggucaacauggugaaaccccgucucuacugaaaauacaaaacuuagccgggcgugguggugggcgccuguaauuccagcuacucgggugccugaugcacaagaaucacuugaaacugggaggcagagguugcaaugagccgagauugugccacugcacuccagucugggugauagagugagacuaucuuaagaaaaaaaaauuuuuuaagucauaaucuuucugcaguugauacuuguaucugguauuagauagaaauaugauaucaagggguugggcgugguagcucaugccuguaaucccagcacuuugggaggccgaggcaaguggaucacuugaggucaggaguuugagauuagccuggccaacauggcgaaaaaucauaucuccuaaaaauacaaaaaaaaauuagccgggugugguggcaccugccuguaauaucaguuacuagggaggcugagucaggagaaucacuugaaccuggaagguggagguugcagugagccaagguugugccacugugcuccagccugggcaacagagcgagacuccaucucaaaaaaaaaaaaaagaaguacaucauuuuucuucauauuuggaaaaucauuuuuuuuccuauauggaaaauguuuuuucaguuccauuuuugaauaguucuccuuuccucucucaucugcuaugccaccucuuaguauuuaguacauuuaaaaaaguaauaaguggccaggcacaguggcucacgccuguaaucccagcacuuugcgaggccgagguggguggaucaccugaggucaggaguuugagaccagccucaacaugaagaaaccccaucucuacuaaaaauacaaaauuagccaggugugguggugcaugccuguaaucccagcuauuuggaggcugaggcaggagaauugcuugaaccugggagacggagguugcggugagccgagauugcgccauugcacuccagccugggcaacaagagugaaacuccgucucaaaaaaaaaaaagaaaaaaguaauaaauaugcuugggucuguuucugggcccuuugguucuguuuauuaacuugucuaucccugcucuguuaccacacugccuauuucucuuaacagguagauuucccccggucuucuaaagugucauuacuccucuuggcccuuuguacuuccuuauauuucuuuugauauguuucccaggcuuucugucucuggucgugaugagaacaguguggaguuaaccauggcugagggacccuacaagaucaucuugacagcacggccauuccgccuugaccuacuagaggaccgaagucuuuugcuuagugucaaugcccgaggacucuuggaguuugagcaucagagggccccuagggucucgugaguacagggguugggacugcagggaaccuagugugaaagagcauagggguguugugaggucuggcacggggaggagacgguggugggacagccagguagggccugggggcugggagaagcucucugucagggaggguaggaaccagacccgggugcgguuuuuuccauuuccuguacagaccaggaggcagucacuuuugucccugagcuguacccugggcaucucugggaggccugccugggucugugucuccuucuuccccuucucacaucaucacauuucccagauuuauuuucuucguuuuuauuuauuuauuuuuuuugguuucuuuuuccccccaucucuggaaguuugucgacugaaacucacuuuuauguuucuguuuuuguguugguuuugugccucuuuuuccccuucccuacccaucuccuccugccccaguuucucggauaagguuaaucucacgcuugguagcauaugggauaagaucaagaaccuuuucucuagguaaauccauggccaccgguacuguaucuguuccucugcccuuacccauuccucacucuagccuuuggggggaggugccccagacccuuccagccuuucacucaccccacuuuccccugcugugugaugucugguccuguuaccuguuacccuggcugggagcccccagaagaaggaaggugagauacugaaagucagguccuucgggaauguagggagcuuauugcuuugccaggggauggagagaugcugccuauugcugggguuccugacucucagcugaggggcaccugagguucugggcagagcuacuugcccuugaaagcauuuuuuggcagaaucucuugaagucccuauguaugucuguagaggcuugguauaguaugacccacaugccuuugcaaagccauugugucaggccaggaggcugaggcccagggagagcacuuggggccagaaucucucaguagaggcaacagagccaggauuggcauucauaacccaggccccugaaucauucugccuuucucuucugggauguugacagaggcugguguucaggccugugccuccugguggcacuuauuccucauuuuccuuucucauuucucuccccauccuuugcaaacuuaucugcucauuguggguucccucuccaagcuuuaacauuuagucccuuccuccaaugccuucguuccuuuggacccuuggcucucuauuccccaaccccuccuuccacuagccccucgucccugcccccucuggauuggagcagacagcucuccuaccuuccaggcaaggaucaaaagacccagcugagggcgauggggcccagccugaggaaacacccagggauggcgacaaggcaaguuggagcgggugggugguuggaggauagggcuggcugggaggguggaggggagaggcccaugagaaacuugaacuuagucuccccaucagggaugggauuuaguugaugggagcggggaaagagagaacugguaugauuggagagugguccucuuuucuucuuaacagccagaggagacucaggggaaggcagagaaagaugagccaggagccugggaggagacauucaaaacucacucugacagcaagccguauggugaggggcucggguuccuugggcuggggugcagggcuccuuuccaagcagaagcucugaagcuuguuuguuuuucuuccaggccccaugucuguggguuuggacuucucucugccaggcauggagcaugucuaugggaucccugagcaugcagacaaccugaggcugaaggucacugagugaguccuauggugacaucaggaagauggaggugggcaggaaggagucaggccuuuagggagaugggugugcauauuggauacucuaggcaagcaugggucauuucuuguguccagaaucaccuuuggugauagaaaauuuuuugagaaaggacaagaggagccuuugcuuaucucucaccugugucuguggagugguguuagcauauaacgcagccuggggccaguuagcagcccaagucugucuguuugccugcagggguggggagccauaucgccucuacaauuuggauguguuccaguaugagcuguacaacccaauggccuuguaugggucugugccugugcuccuggcacacaacccucaucgcgacuugggcaucuucuggcucaaugcugcagagaccuggguugauauaucuuccaacacugccgggaaggugagagcacaggcacggggaaaaaggagggagugaagcuuccaggccuugaggcaaauagguauacuaggggcauuagcuauuuggggacuggguuuaagaaggggcugugggccuggugggcagcauuugaguucccuaaucacucccaggugacacgcucacucacauucuuagggaaggcauugccuauucugggcugacggaaugcacuuauuaucaguguguuacgugcuagguacucuucugggugcuggggauauaguguuaacugagguugaaaagguucugggcugggugugguggcucaugccuguaaucccagcacuuugggaggcugaggugggcggaucaccugaggucagaaguuggagaccagccuggccaacauggcgaaaccucaucucuacuagaaaaacaaaaauuagcaggguguggcggcggacuccuguaaucccagcuauucgggaggcuaaggcagguuaauugcaugaaucugguugguggagguugcagugagcggagauuucaccacugcacuccagccugggugacagagugagacucuguuucagaaaaaaaaaaaagaaagguucugacucacagggaggaagacacguuaaacacauaacaaaggaggcaagauggggccgggcaugauagcucaugucuguaaucccagcacuuggggaggcugaggcaagaggaucgcuugaggccaggaguucgagaccagccugggcaacauggcgagaccccaucucuauaaaaacguuugaaaaauaaaaauaauaagcaagaugaugccgggugcaguggcucccaccucuaaucccagcacuuugggagggcgagguggacagaucacaaggucaagagaucgagaccauccuggccaacauugugaaacccuguuucuacugaaaauacaaaaguuagcugggugugguggugugcgccuguagucuuagcuacucgggaggcugaggcaggagaacugguugaacuggggagguggagauugcagugagcuaagaucacaccauugcacuccagccuggcaaaagagugagacucugucuaaaaaaaaaaaaaagaaugcaagaugaguuuggggugauuaagugcuaacaaagacaugaaagagagucuuuguuagcacuuaaccaccccaaacuggugggguaggggugggggcuguacugcuuuagauaguguggucuaggaaagccucacugaagaggccccguuuagucuuaccgaaagcagcuuacaugagccagcucuguguggacucugggagaaaauugcuacuuuuugucuugggguuggaaaaugggagggcaggaggugucugaccccuuuguggucaccuauacagacccuguuugggaagaugauggacuaccugcagggcucuggggagaccccacagacagauguucgcuggaugucagagacuggcaucauugacgucuuccugcugcuggggcccuccaucucugauguuuuccggcaauaugcuagucucacagguacaugguuuucccugccucauucuucugcucuuuucuugucgggugauucuauguguuuucagagauccugugccccagcuuguuuucuagguuuauaccccucagccugccucuaguucacaagccucccucaguuucuggguguugggccugauccucguugugacccccaucccucaugaaccugcaggaacccaggcguugcccccacucuucucccucggcuaccaccagagccguuggaacuaccgggacgaggcugaugugcuggaaguggaucagggcuuugaugaucacaaccugcccugugaugucaucuggcuagacauugaacaugcugauggcaagcgguauuucaccugggaccccagucgcuucccucagccccgcaccaugcuugagcgcuuggcuucuaagaggcggaagguaagggguugcagucacgcuuggucuucucaggguagggcugaagcauaguuuagccuuaaagagaccugaacaccccuguuccuugcccccagcugguggccaucguagacccccacaucaagguggacuccggcuaccgaguucacgaggagcugcggaaccuggggcuguauguuaaaacccgggauggcucugacuaugagggcuggugcuggccagguaagcagacccagaauugagggagaguugauuggccagcgggguagaaugguggcucuuuugccccuuaggggauugagagccacccuuaacuucucccaggcucagcugguuacccugacuucacuaaucccacgaugagggccuggugggcuaacauguucagcuaugacaauuaugagguagggaaggccucuccccaugaccugcgucugucuguuccaccugccucccugaaucucucucggcuugccaacccuucuaugguugauugccugcaacauaucagggggccuugaugauccggggagggcccugaaaaaugcaucuuuuuagauuccuaggagcucucuucucugacacuguuugucuucuuccuccccucuguccuucuguccccauuuucugcccacguucccagggcucagcucccaaccucuuugucuggaaugacaugaacgaaccaucuguguucaaugguccugaggucaccaugcucaaggaugcccagcauuaugggggcugggagcaccgggaugugcauaacaucuauggccuuuaugugguaagggccugagagaggagaguugguggaaagagggaaaacagcccagagacugagggccuagggaacuugcaccagaugacagcuggcuuuugcuccucacuacccgucucuucucuccucacccagcacauggcgacugcugaugggcugagacagcgcucugggggcauggaacgccccuuuguccuggccagggccuucuucgcuggcucccagcgcuuugguaagguuuagagaauggagcuguggcagaagggugugaaggccagaucucaggagccauggaccuggaccugccucucugaggaaugggagccacacacugcaucuguuuccucucagcuaugcgcuuugaaggaagucagggugugggagguccacuccuuguucaaauguucuugugaacugcaucuucagcaggguucuggggacccagagcggaugugggaggucagccauguaaaaagcugaacuccuuuaccaugugcaagcuccccacuucuugucuuccucaggagccguguggacaggggacaacacugccgagugggaccauuugaagaucucuauuccuaugugucucagcuuggggcuggugggacuuuccuucuguggggguaagacagggaggaauuuggggucuugguuuggugggaaaggggcaaaguagagggcacaggaccaagguguuguaagcaaagagaguugagaguccaaguuagggccuugggaaguuucucaagcaguaucucuccuucacccucuuuuccaaccugcuuccucucucuccucuaccagcggauguggguggcuucuucaaaaacccagagccagagcugcuugugcgcugguaccagaugggugcuuaccagccauucuuccgggcacaugcccacuuggacacugggcgacgagagccauggcuguuaccaucucagcacaaugauauaauccgagaugccuugggccagcgauauucuuugcugcccuucugguacacccucuuauaucaggcccaucgggaaggcauuccugucaugaggugaggcauucacuugggcugugaagagugggcugagguggcuggggguauuagggacugggcuucaucucugggucucuuucuucacucacuacagccuuguaaaggauggaaaaucauuaaggucaagagugaaggggagcuuaauggagaugaauaauaguaaacauuuaaagaaaauugacagcagucauaagcucuuucagaaaaauaaaacaggguaaugggauuagguggucauaaaaucccuuuuugaggccgggcacaguggcucacaccuguaaucccagcacuuugggaggccgaggugggcagaucaccugaggucaggaguuugagaccagccuggccaacauggcaaaaccccaucucuacuaaaaauacaaaaauuagcugggcaucauggcgccuguaaucccagcuacucgggaggcugaggcaugagaaucacuugaacccaggagguagagguugcagugagccgagauugcucugcugcauucuagccugggugacagagggagacuccaucucaaaaaaaugaaaaaaaaaaaaaaaaaaaaguuuugagaagaaggcugugugagaugaggccugaaugagugggacagaccauguuauguaggaagaaucuuccaagcagagggaauugcaaguacaaaaauucuaaaggagaaauuaguuuguuauguacuaggaauagaaaaaaacaguaugucuuggguaaagaagcagaaggagagcuaggagaugagauuaagaagaaagugugaucugcuccuggagggccuugcaagccaggguugcaacccaggguuguaagccagggcggugaaacaugcaaggaggcuacuggcaggcugcugugcagcaugguuucaguagagggcagagaagaagcagggagauggcuuaggaaguuaaaugucuaagacuggauuguauaacugagaccugaaccccaacccgacugucugacugcaaacuccugggucuuaaccccugugcuguucuuuucuuuucuuuuuuuuuuugagacaaagucucacucucgucccccaggcuggagugcgauggugugaucuuggcucacugaaugcacuccgccucccggguucaagugauucuccagccucagccuccugaguagcugggaucacaggugccugccaccaugcccggcuaauuuuuguauuuuuaguagagacgggguuucaccauguuguucaggcugaucucgaacuccugaccucaggugaucuucccgccucggccucccaaaguguugggauuacaggugugagccaccacacccggccuaugcuguucuuuucuuauugccaguuccuggaggagcauuucugacuugugccaaaauugaaaaguuuuccuuuauugucuuucuuccuuccuaggccccugugggugcaguacccucaggaugugacuaccuucaauauagaugaucaguacuugcuuggugagaaaugaggauaguuggugguggguuggcuuugggccaagcagcacugcggaugcccagggagggacuagugaagcugguggugcagagggcaggcacuuugguguucccuguucugggaacuaaucccccuauucagaguugauucuggcauauuuuaggggaugcguugcugguucacccuguaucagacucuggagcccaugguguccaggucuaucugccuggccaaggggaggugaguuaaggaagggcaugguggggaaagaugguggaagccaaaggaggcaaacaggacgggaccccugugcacugagugauccgguaucuuaccucuuuugucacucacaggugugguaugacauucaaagcuaccagaagcaucaugguccccagacccuguaccugccuguaacucuaagcagugugaguaagccuggucuggcugccgguuccaucucccuguaaauuuccagaaggggagggaaugugugccuuaggguccaguaccuaugugggcauacaugaguaagcaaaacaugcuguggggcccaagguuggacaagggggcaacuucauccuggcauugcucuugcccuagaucccuguguuccagcguggagggacaaucgugccucgauggaugcgagugcggcggucuucagaauguaugaaggaugaccccaucacucucuuuguugcacuuagcccucagguaagugcauaggcagcgagucuccucagccauuugccugccuuccuaggacucaguucucugggguugugccccucacucccucuugggcucaggcgcucaccuaucccacuucuugcucaggguacagcucaaggagagcucuuucuggaugaugggcacacguucaacuaucagacucgccaagaguuccugcugcgucgauucucauucucuggcaacacccuugucuccagguaaugggucacccacucuuccuuggcugccuuugcuggggccugauccuugugggggcucccaguucacugugcucuuuucucacauucugaccuugcuuugggucuccuccuuccuucuguucuguuauuuuucccccugauggacaucugcuuuuaccaucuccagcucagcagacccugaaggacacuuugagacaccaaucuggauugagcggguggugauaauaggggcuggaaagccagcagcugugguacuccagacaaaaggugagugaccaaucuggccccuaggaugggggaaggaggggaagccggggcagguuuagggaugcccuugccuguaggaacguuguuguuaugcuauagcccauugguaugacuauggcacucuuuuauuccuccuccaggaucuccagaaagccgccuguccuuccagcaugacccugagaccucuguguugguccugcgcaagccuggcaucaauguggcaucugauuggaguauucaccugcgauaacccaagggauguucuggguuagggggagggaaggggagcauuagugcugagagauauucuuucuucugccuuggaguucggcccuccccagacuucacuuaugcuagucuaagacccagauucugccaacauuugggcaggaugagagggcugacccugggcuccaaauuccucuugugaucuccucaccucucccacuccauugauaccaacucuuucccuucauucccccaacauccuguugcucuaacuggagcacauucacuuacgaacaccaggaaaccacagggcccuugucgccccuucucuuucccuuauuuaggagcccugaacucccccagagucuauccauucaugccucuuguauguugaugccacuucuuggaagaagaugagggcaaugaguuagggcuccuuuuccccuucccucccaccagauugcucucccaccuuucauuucuuccuccaggcuuuacuccccuuuuuaugccccaccgauacacugggaccaccccuuaccccggacaggaugaauggaucaaaggagugagguugcuaaagaacauccuuuucccucucauucuacccuuuuccucuccccgauuccuuguagagcugcugcaauucuuagaggggcaguucuaccuccucugucccucggcagaaagacguuuccacaccucuuaggggaugcgcauuaaacuucuuuugcccccuucuuguccccuuugaggggcacuuaagauggagaaaucaguugugguuucagugaaucauggucaccuguauuuauugcuaggagaagccugaggguggggggagaugaucaugugugcucgggguuggcuggaagcccugggugggggguugggggaggacuaauggggagucggggaauauuuguggguauuuuuuuuacuuccucuugguucccagcugugacacguuuugaucaaaggagaaacaauaaagggauaaaccauaaauaacuggugguagucuggauucuaguucuagccugagccacagacccuagaagccuagagaccuuacauuugcuuuccuuuuuuuuucuuuuuugagacugagucucacucuguugcccaggcuggaaugcaauggcaugaucugggcucauugcaaccucugccucccagguucaagcaguucucgugccucaaccucccgagucgcugggacuacaggcaugcgccaccaugcccagcuaauuuuuguauuuuuauuagagaugggguuucaccauguuggccaggcuggucuggaacuccugaccucaggugauccgccugccucggccucccaaagugcuggaauuaaaggagugagccacugcgcccugggucuuuuuuuuuuuuuuuuuuuuuuugagacagagugucgccaggcuggaguacagugugugauccuggcucguugcaaccucugccuccuggguucaggcaguucucccaccucagccuccuuaauagcugggauuacgggcaccugcgaccauggccagcuucauuuuuguauuuuuaguagagaugggguuucgccauguuagccaugcugaucuugaacuccugaccucaggugaucugcccgccuuggccucccaaagugcugggauuacaggcgugaggcaccaugccuggccaugggccuuacauuuucauuuggcuuca

SEQ ID NO: 18738 - RNA, 22559 nt, Homo sapiens
ugaagccaaaugaaaauguaaggcccauggccaggcauggugccucacgccuguaaucccagcacuuugggaggccaaggcgggcagaucaccugaggucaggaguucaagaucagcauggcuaacauggcgaaaccccaucucuacuaaaaauacaaaaaugaagcuggccauggucgcaggugcccguaaucccagcuauuaaggaggcugaggugggagaacugccugaacccaggaggcagagguugcaacgagccaggaucacacacuguacuccagccuggcgacacucugucucaaaaaaaaaaaaaaaaaaaaaaagacccagggcgcaguggcucacuccuuuaauuccagcacuuugggaggccgaggcaggcggaucaccugaggucaggaguuccagaccagccuggccaacauggugaaaccccaucucuaauaaaaauacaaaaauuagcugggcaugguggcgcaugccuguagucccagcgacucgggagguugaggcacgagaacugcuugaaccugggaggcagagguugcaaugagcccagaucaugccauugcauuccagccugggcaacagagugagacucagucucaaaaaagaaaaaaaaaggaaagcaaauguaaggucucuaggcuucuagggucuguggcucaggcuagaacuagaauccagacuaccaccaguuauuuaugguuuaucccuuuauuguuucuccuuugaucaaaacgugucacagcugggaaccaagaggaaguaaaaaaaauacccacaaauauuccccgacuccccauuaguccucccccaaccccccacccagggcuuccagccaaccccgagcacacaugaucaucuccccccacccucaggcuucuccuagcaauaaauacaggugaccaugauucacugaaaccacaacugauuucuccaucuuaagugccccucaaaggggacaagaagggggcaaaagaaguuuaaugcgcauccccuaagagguguggaaacgucuuucugccgagggacagaggagguagaacugccccucuaagaauugcagcagcucuacaaggaaucggggagaggaaaaggguagaaugagagggaaaaggauguucuuuagcaaccucacuccuuugauccauucauccuguccgggguaagggguggucccaguguaucgguggggcauaaaaaggggaguaaagccuggaggaagaaaugaaaggugggagagcaaucuggugggagggaaggggaaaaggagcccuaacucauugcccucaucuucuuccaagaaguggcaucaacauacaagaggcaugaauggauagacucugggggaguucagggcuccuaaauaagggaaagagaaggggcgacaagggcccugugguuuccugguguucguaagugaaugugcuccaguuagagcaacaggauguugggggaaugaagggaaagaguugguaucaauggagugggagaggugaggagaucacaagaggaauuuggagcccagggucagcccucucauccugcccaaauguuggcagaaucugggucuuagacuagcauaagugaagucuggggagggccgaacuccaaggcagaagaaagaauaucucucagcacuaaugcuccccuucccucccccuaacccagaacaucccuuggguuaucgcaggugaauacuccaaucagaugccacauugaugccaggcuugcgcaggaccaacacagaggucucagggucaugcuggaaggacaggcggcuuucuggagauccuggaggaggaauaaaagagugccauagucauaccaaugggcuauagcauaacaacaacguuccuacaggcaagggcaucccuaaaccugccccggcuuccccuccuucccccauccuaggggccagauuggucacucaccuuuugucuggaguaccacagcugcuggcuuuccagccccuauuaucaccacccgcucaauccagauuggugucucaaaguguccuucagggucugcugagcuggagaugguaaaagcagauguccaucagggggaaaaauaacagaacagaaggaaggaggagacccaaagcaaggucagaaugugagaaaagagcacagugaacugggagcccccacaaggaucaggccccagcaaaggcagccaaggaagagugggugacccauuaccuggagacaaggguguugccagagaaugagaaucgacgcagcaggaacucuuggcgagucugauaguugaacgugugcccaucauccagaaagagcucuccuugagcuguacccugagcaagaagugggauaggugagcgccugagcccaagagggagugaggggcacaaccccagagaacugaguccuaggaaggcaggcaaauggcugaggagacucgcugccuaugcacuuaccugagggcuaagugcaacaaagagagugauggggucauccuucauacauucugaagaccgccgcacucgcauccaucgaggcacgauugucccuccacgcuggaacacagggaucuagggcaagagcaaugccaggaugaaguugcccccuuguccaaccuugggccccacagcauguuuugcuuacucauguaugcccacauagguacuggacccuaaggcacacauucccuccccuucuggaaauuuacagggagauggaaccggcagccagaccaggcuuacucacacugcuuagaguuacaggcagguacagggucuggggaccaugaugcuucugguagcuuugaaugucauaccacaccugugagugacaaaagagguaagauaccggaucacucagugcacaggggucccguccuguuugccuccuuuggcuuccaccaucuuuccccaccaugcccuuccuuaacucaccuccccuuggccaggcagauagaccuggacaccaugggcuccagagucugauacagggugaaccagcaacgcauccccuaaaauaugccagaaucaacucugaauagggggauuaguucccagaacagggaacaccaaagugccugcccucugcaccaccagcuucacuagucccucccugggcauccgcagugcugcuuggcccaaagccaacccaccaccaacuauccucauuucucaccaagcaaguacugaucaucuauauugaagguagucacauccugaggguacugcacccacaggggccuaggaaggaagaaagacaauaaaggaaaacuuuucaauuuuggcacaagucagaaaugcuccuccaggaacuggcaauaagaaaagaacagcauaggccgggugugguggcucacaccuguaaucccaacacuuugggaggccgaggcgggaagaucaccugaggucaggaguucgagaucagccugaacaacauggugaaaccccgucucuacuaaaaauacaaaaauuagccgggcaugguggcaggcaccugugaucccagcuacucaggaggcugaggcuggagaaucacuugaacccgggaggcggagugcauucagugagccaagaucacaccaucgcacuccagccugggggacgagagugagacuuugucucaaaaaaaaaaagaaaagaaaagaacagcacagggguuaagacccaggaguuugcagucagacagucggguugggguucaggucucaguuauacaauccagucuuagacauuuaacuuccuaagccaucucccugcuucuucucugcccucuacugaaaccaugcugcacagcagccugccaguagccuccuugcauguuucaccgcccuggcuuacaacccuggguugcaacccuggcuugcaaggcccuccaggagcagaucacacuuucuucuuaaucucaucuccuagcucuccuucugcuucuuuacccaagacauacuguuuuuuucuauuccuaguacauaacaaacuaauuucuccuuuagaauuuuuguacuugcaauucccucugcuuggaagauucuuccuacauaacauggucugucccacucauucaggccucaucucacacagccuucuucucaaaacuuuuuuuuuuuuuuuuuuuucauuuuuuugagauggagucucccucugucacccaggcuagaaugcagcagagcaaucucggcucacugcaaccucuaccuccuggguucaagugauucucaugccucagccucccgaguagcugggauuacaggcgccaugaugcccagcuaauuuuuguauuuuuaguagagaugggguuuugccauguuggccaggcuggucucaaacuccugaccucaggugaucugcccaccucggccucccaaagugcugggauuacaggugugagccacugugcccggccucaaaaagggauuuuaugaccaccuaaucccauuacccuguuuuauuuuucugaaagagcuuaugacugcugucaauuuucuuuaaauguuuacuauuauucaucuccauuaagcuccccuucacucuugaccuuaaugauuuuccauccuuuacaaggcuguagugagugaagaaagagacccagagaugaagcccagucccuaauacccccagccaccucagcccacucuucacagcccaagugaaugccucaccucaugacaggaaugccuucccgaugggccugauauaagaggguguaccagaagggcagcaaagaauaucgcuggcccaaggcaucucggauuauaucauugugcugagaugguaacagccauggcucucgucgcccaguguccaagugggcaugugcccggaagaauggcugguaagcacccaucugguaccagcgcacaagcagcucuggcucuggguuuuugaagaagccacccacauccgcugguagaggagagagaggaagcagguuggaaaagagggugaaggagagauacugcuugagaaacuucccaaggcccuaacuuggacucucaacucucuuugcuuacaacaccuugguccugugcccucuacuuugccccuuucccaccaaaccaagaccccaaauuccucccugucuuacccccacagaaggaaagucccaccagccccaagcugagacacauaggaauagagaucuucaaauggucccacucggcaguguuguccccuguccacacggcuccugaggaagacaagaaguggggagcuugcacaugguaaaggaguucagcuuuuuacauggcugaccucccacauccgcucuggguccccagaacccugcugaagaugcaguucacaagaacauuugaacaaggaguggaccucccacacccugacuuccuucaaagcgcauagcugagaggaaacagaugcaguguguggcucccauuccucagagaggcagguccagguccauggcuccugagaucuggccuucacacccuucugccacagcuccauucucuaaaccuuaccaaagcgcugggagccagcgaagaaggcccuggccaggacaaaggggcguuccaugcccccagagcgcugucucagcccaucagcagucgccaugugcugggugaggagagaagagacggguagugaggagcaaaagccagcugucaucuggugcaaguucccuaggcccucagucucugggcuguuuucccucuuuccaccaacucuccucucucaggcccuuaccacauaaaggccauagauguuaugcacaucccggugcucccagcccccauaaugcugggcauccuugagcauggugaccucaggaccauugaacacagaugguucguucaugucauuccagacaaagagguugggagcugagcccugggaacgugggcagaaaauggggacagaaggacagaggggaggaagaagacaaacagugucagagaagagagcuccuaggaaucuaaaaagaugcauuuuucagggcccuccccggaucaucaaggcccccugauauguugcaggcaaucaaccauagaaggguuggcaagccgagagagauucagggaggcagguggaacagacagacgcaggucauggggagaggccuucccuaccucauaauugucauagcugaacauguuagcccaccaggcccucaucgugggauuagugaagucaggguaaccagcugagccugggagaaguuaaggguggcucucaauccccuaaggggcaaaagagccaccauucuaccccgcuggccaaucaacucucccucaauucugggucugcuuaccuggccagcaccagcccucauagucagagccaucccggguuuuaacauacagccccagguuccgcagcuccucgugaacucgguagccggaguccaccuugaugugggggucuacgauggccaccagcugggggcaaggaacagggguguucaggucucuuuaaggcuaaacuaugcuucagcccuacccugagaagaccaagcgugacugcaaccccuuaccuuccgccucuuagaagccaagcgcucaagcauggugcggggcugagggaagcgacuggggucccaggugaaauaccgcuugccaucagcauguucaaugucuagccagaugacaucacagggcagguugugaucaucaaagcccugauccacuuccagcacaucagccucgucccgguaguuccaacggcucuggugguagccgagggagaagagugggggcaacgccuggguuccugcagguucaugagggaugggggucacaacgaggaucaggcccaacacccagaaacugagggaggcuugugaacuagaggcaggcugagggguauaaaccuagaaaacaagcuggggcacaggaucucugaaaacacauagaaucacccgacaagaaaagagcagaagaaugaggcagggaaaaccauguaccugugagacuagcauauugccggaaaacaucagagauggagggccccagcagcaggaagacgucaaugaugccagucucugacauccagcgaacaucugucuguggggucuccccagagcccugcagguaguccaucaucuucccaaacagggucuguauaggugaccacaaaggggucagacaccuccugcccucccauuuuccaaccccaagacaaaaaguagcaauuuucucccagaguccacacagagcuggcucauguaagcugcuuucgguaagacuaaacggggccucuucagugaggcuuuccuagaccacacuaucuaaagcaguacagcccccaccccuaccccaccaguuuggggugguuaagugcuaacaaagacucucuuucaugucuuuguuagcacuuaaucaccccaaacucaucuugcauucuuuuuuuuuuuuuuagacagagucucacucuuuugccaggcuggagugcaauggugugaucuuagcucacugcaaucuccaccuccccaguucaaccaguucuccugccucagccucccgaguagcuaagacuacaggcgcacaccaccacacccagcuaacuuuuguauuuucaguagaaacaggguuucacaauguuggccaggauggucucgaucucuugaccuugugaucuguccaccucgcccucccaaagugcugggauuagaggugggagccacugcacccggcaucaucuugcuuauuauuuuuauuuuucaaacguuuuuauagagauggggucucgccauguugcccaggcuggucucgaacuccuggccucaagcgauccucuugccucagccuccccaagugcugggauuacagacaugagcuaucaugcccggccccaucuugccuccuuuguuauguguuuaacgugucuuccucccugugagucagaaccuuucuuuuuuuuuuuucugaaacagagucucacucugucacccaggcuggagugcaguggugaaaucuccgcucacugcaaccuccaccaaccagauucaugcaauuaaccugccuuagccucccgaauagcugggauuacaggaguccgccgccacacccugcuaauuuuuguuuuucuaguagagaugagguuucgccauguuggccaggcuggucuccaacuucugaccucaggugauccgcccaccucagccucccaaagugcugggauuacaggcaugagccaccacacccagcccagaaccuuuucaaccucaguuaacacuauauccccagcacccagaagaguaccuagcacguaacacacugauaauaagugcauuccgucagcccagaauaggcaaugccuucccuaagaaugugagugagcgugucaccugggagugauuagggaacucaaaugcugcccaccaggcccacagccccuucuuaaacccaguccccaaauagcuaaugccccuaguauaccuauuugccucaaggccuggaagcuucacucccuccuuuuuccccgugccugugcucucaccuucccggcaguguuggaagauauaucaacccaggucucugcagcauugagccagaagaugcccaagucgcgaugaggguugugugccaggagcacaggcacagacccauacaaggccauuggguuguacagcucauacuggaacacauccaaauuguagaggcgauauggcuccccaccccugcaggcaaacagacagacuugggcugcuaacuggccccaggcugcguuauaugcuaacaccacuccacagacacaggugagagauaagcaaaggcuccucuuguccuuucucaaaaaauuuucuaucaccaaaggugauucuggacacaagaaaugacccaugcuugccuagaguauccaauaugcacacccaucucccuaaaggccugacuccuuccugcccaccuccaucuuccugaugucaccauaggacucacucagugaccuucagccucagguugucugcaugcucagggaucccauagacaugcuccaugccuggcagagagaaguccaaacccacagacauggggccuggaagaaaaacaaacaagcuucagagcuucugcuuggaaaggagcccugcaccccagcccaaggaacccgagccccucaccauacggcuugcugucagagugaguuuugaaugucuccucccaggcuccuggcucaucuuucucugccuuccccugagucuccucuggcuguuaagaagaaaagaggaccacucuccaaucauaccaguucucucuuuccccgcucccaucaacuaaaucccaucccugauggggagacuaaguucaaguuucucaugggccucuccccuccacccucccagccagcccuauccuccaaccacccacccgcuccaacuugccuugucgccaucccuggguguuuccucaggcugggccccaucgcccucagcugggucuuuugauccuugccuggaagguaggagagcugucugcuccaauccagagggggcagggacgaggggcuaguggaaggagggguuggggaauagagagccaaggguccaaaggaacgaaggcauuggaggaagggacuaaauguuaaagcuuggagagggaacccacaaugagcagauaaguuugcaaaggauggggagagaaaugagaaaggaaaaugaggaauaagugccaccaggaggcacaggccugaacaccagccucugucaacaucccagaagagaaaggcagaaugauucaggggccuggguuaugaaugccaauccuggcucuguugccucuacugagagauucuggccccaagugcucucccugggccucagccuccuggccugacacaauggcuuugcaaaggcaugugggucauacuauaccaagccucuacagacauacauagggacuucaagagauucugccaaaaaaugcuuucaagggcaaguagcucugcccagaaccucaggugccccucagcugagagucaggaaccccagcaauaggcagcaucucuccauccccuggcaaagcaauaagcucccuacauucccgaaggaccugacuuucaguaucucaccuuccuucuucugggggcucccagccaggguaacagguaacaggaccagacaucacacagcaggggaaaguggggugagugaaaggcuggaagggucuggggcaccuccccccaaaggcuagagugaggaauggguaagggcagaggaacagauacaguaccgguggccauggauuuaccuagagaaaagguucuugaucuuaucccauaugcuaccaagcgugagauuaaccuuauccgagaaacuggggcaggaggagauggguagggaaggggaaaaagaggcacaaaaccaacacaaaaacagaaacauaaaagugaguuucagucgacaaacuuccagagauggggggaaaaagaaaccaaaaaaaauaaauaaauaaaaacgaagaaaauaaaucugggaaaugugaugaugugagaaggggaagaaggagacacagacccaggcaggccucccagagaugcccaggguacagcucagggacaaaagugacugccuccuggucuguacaggaaauggaaaaaaccgcacccgggucugguuccuacccucccugacagagagcuucucccagcccccaggcccuaccuggcugucccaccaccgucuccuccccgugccagaccucacaacaccccuaugcucuuucacacuagguucccugcagucccaaccccuguacucacgagacccuaggggcccucugaugcucaaacuccaagaguccucgggcauugacacuaagcaaaagacuucgguccucuaguaggucaaggcggaauggccgugcugucaagaugaucuuguagggucccucagccaugguuaacuccacacuguucucaucacgaccagagacagaaagccugggaaacauaucaaaagaaauauaaggaaguacaaagggccaagaggaguaaugacacuuuagaagaccgggggaaaucuaccuguuaagagaaauaggcagugugguaacagagcagggauagacaaguuaauaaacagaaccaaagggcccagaaacagacccaagcauauuuauuacuuuuuucuuuuuuuuuuuugagacggaguuucacucuuguugcccaggcuggagugcaauggcgcaaucucggcucaccgcaaccuccgucucccagguucaagcaauucuccugccucagccuccaaauagcugggauuacaggcaugcaccaccacaccuggcuaauuuuguauuuuuaguagagaugggguuucuucauguugaggcuggucucaaacuccugaccucaggugauccacccaccucggccucgcaaagugcugggauuacaggcgugagccacugugccuggccacuuauuacuuuuuuaaauguacuaaauacuaagagguggcauagcagaugagagaggaaaggagaacuauucaaaaauggaacugaaaaaacauuuuccauauaggaaaaaaaaugauuuuccaaauaugaagaaaaaugauguacuucuuuuuuuuuuuuuugagauggagucucgcucuguugcccaggcuggagcacaguggcacaaccuuggcucacugcaaccuccaccuuccagguucaagugauucuccugacucagccucccuaguaacugauauuacaggcaggugccaccacacccggcuaauuuuuuuuuguauuuuuaggagauaugauuuuucgccauguuggccaggcuaaucucaaacuccugaccucaagugauccacuugccucggccucccaaagugcugggauuacaggcaugagcuaccacgcccaaccccuugauaucauauuucuaucuaauaccagauacaaguaucaacugcagaaagauuaugacuuaaaaaauuuuuuuuucuuaagauagucucacucuaucacccagacuggagugcaguggcacaaucucggcucauugcaaccucugccucccaguuucaagugauucuugugcaucaggcacccgaguagcuggaauuacaggcgcccaccaccacgcccggcuaaguuuuguauuuucaguagagacgggguuucaccauguugaccaggcuggucuuguacuccugaccucaagugaucuguccgccuuggccucucgaagugcugggauuacagguaugagccaucacacccagccugcuuaaaauuuaaaaguaaaagcuuuaggaugggcucgguggcccacuauuguaaucccagcacuuugggaggccgaggcagguggaucgcuugagcccugguguucaagaccagacugggcaacauggcaaaaacccaucucuaccaaaaauacaaaaauuagccagucucauaacccgaucucaaaauaaguaaauaaaugaaagcaaaaguguuagaagaaaauuaaaaaauauauuuuuggccaggcaugguggcucauuccuguaaucucagcacuuucggaggccgaggcagguggaucaugaggucaggaguuugagaccagccuggucaacauagugaaacccugucucuacuaaaaauacaaaaaguagccggguauagugacgcacgccuguagucccagcuacuugggcauaguggcaugagccugcagucccagcuacucgggcauaguggugcacgccuguagucccagcuacucaggcauaguggugcacgccuguagucccagcuacucgggaggcugaugcugaagaaagaaucgcuucaacacaggaggcggagguuguggugagccaagaucgcacuacugcacucagccuaagcaacagagcaagacucugucucaaaaaauauauauauauauauuuuuuucugaccuugggguagauaaagacuaaauacaacaaacaaaaggcuaacaacagaagguaaaagacugauacaucuaaauacauuaaaauuaggaauuucuguuuaucaaaaguaccuuuaggaucauuaagaaaaaggaaaagucuaagaaauuuuaucagucuagagggcccuaaggaaacaugacaacuaaauguaauaacauauccuggaugaaauccuggaacagaaaaagaacauacacaaaaacuaaagaaaccucaaguaugaacuuuaguaacuaauguaucacuaucaauucacuagguaucacaaaugaaccauagucauauuaauaauagggaaggcuggccgggugugguggcucaagccuguaauccuagcacuuugggaggcugagaugggcagaucacgaugucaggagaucgagaccauccuggcuugcccagcuucaaugagggcuucuuauaaaucacugguggaaguguaaauugguaaaccacuuuggcuuuaucuugcgaagcugaucaucuccauauucuacaauccugcaauuccucuccuaguuauacaccaaagagaaacucccaagcaaggauaacaggagacauguacaagaagguucguagcaacacuuuggcuagcaaaacacuggaaacaaccccaaggcuuaucaaccuaaaaauggauuaaucaguugggguauauucauacaacauaauaauaugcagcaguaaaaaugaaugaacuagagcuauaugaaauggaauuaaauaaaguuaugugaaaaacggaaacccagccgggcgcgguggcucacaccuguaauuccagcacuuugggaggcugaggcgggcggaucacgaggucaggagauugagaccauccuggcuaacgcagaucacgccacuguacuccagccugggagacagcgagacuccaucucaaaaaaaaaaaaagaaaaaacggaaaccccagaagaccacaugcacuaagacacuuccucuguaaagcucaaaaacaaaaaauauauauaauuuauugcuuaggcacacagacauaugugugcauauguauacacacauaauacaacuguaagaacaaaaaaaaggcaaaggaaggauaagcuucagaauaacgacuaccuacgucuggagccgucaaggguacaggacagugcggguugggcugagugaagaguuuauaggguggaguauuugagacggagucucacucugucgcccaggcuguagugcagugacacaaucucggcucacugcaaccucugccuccuggguucaaguaaccguccugccucggccuccugaguagcugggauuacagguccgcaccaccacaccuggcugauuuuuguauuuuuaguagagaugggguuucaccauguuggccaagcuggucuccaacuccugaccucgugaucugcccaccucgaccucccaaagugcugggauuacaggcguugagccaccaugcccggccacuauguuauuuucugaauuauguauuuaagagaaagucauggauggaugcauggaacacuggugacagaguaucaugacacaagaaucugaguaauccuauucugaauaucuaaggaaaaggaaaggaggaaggaaggaaggaaggaaggaaggaaggaaggaaggaaggaaggaaggaaggaaggaaggaagcaagcaaacaagcaagcagguagacauuguauuccuggagaacgagaucuguaaauaaacagggccuuguuuauuucugcuuauauaaccagcauccagcccaggccugucagggaggaaaaagcaauaauuguuugcugaaugaaugaaugaggauaaagggauaaagagaaaagugaaacagaagaagagguggggaaagguugaggaguauggcaaggugcuaugcuaguuaacuacuaccuuauuuugggaaagaauaucagcaaccaaaaaaagguucaucaggaaggagaaaggggccacagaaauggauguuucucaggaaaaauuuaccgggcuauugguggaucagccaccaaaacaucugguacacgguaucggggucgccgaggcuccagcucaucaauccugaaccgagucauguucuuuugaagccccugaagcucuagcaccagcaacaccugcggggacagagguuuggaucuggagaaaggaaaugggauacaccauggaaugcucuuugaacccauucucuccuaagggguuucuuccuuugagcccuuugccuaaaggccaagaucacauuucuucauaaaguaaaaguccaaagauuaggcugggacaagauguuggccacaauuucccccuuuccaaauuaccccacagccauugccccacccccaccagacucuuccuugucucuccugaccuuggugaccucauggaucagauggaccgugagggaaucaggaccaagcuguagagaguccagcaaggcucgguauggagagaggccuggccguaugcuucucugucgccugccaagugaaggguugggaaguaagguaaaggccaccugcaaugucccuaagucagucuaucaccugcaguguccuuaggcacuccaucugccacagauaucucccacauuacccuacaacccuacauuccaucccucucccccagaaauaucauacuugcagaaagaacucucuucacaggucuuaaaguugcuucuauccacagcaaggguaauccccaggcagaccccuaaaaaagccaguaccaaagacgcccaagaccuaaggagaaaaggacaaagacagagcaaucagcauggaggucagaaggggcccccuucaaaaggaaaagcuucuuccugucauagcacuagaagauaguugaggaaagaggggagaaagauguagucacaucaaauacaaaacaaggcagaguggacacaggguuaaggaucaggccugagaaguuggcucacucacaccuucccuuugaaaggcagaguaggcugggcgugguggcucacuccuguaaucccagcacuuugggaggcugcggcgggcggaucacgaggucaggagaucaagaccauccuggcuaacacggugaaacccugucucuacuaaaaauacaaaaaaaauuagcugggcgugguggcggccaccugaagucccagcuacucgggaggcugaggcaggagaauggcgugaacccaggaggcggagcuuacagugagccaagaucgugccacugcacuccagccugggcgacagagcuagacaaaaaaaaaaaaaaaaaaaaaaaagccaggcgcgguggcucacgccuguaaucccagcacucugggaggcugaagugggcggaucacgaggucaggagaucgagaccauccuggcuaacacagugaaaccccgucucuacuaaaaauacaaaaaauuagccgggcgugguggcaggugucuguagucccagcuacuugggaggcuggagcuggagaauggcaugaauccgggaggcagaacuugcagugagucaagaucgcaccacugcacuccagccugggugacagagugagacuccaucuccaaaaaaaaaaaaaaaaagggccgggugcgguggcucaugccuguaaucccagcacuuagggaggccaaggcugacagaucacgaggucaggaguuugagaccauccuggcuaacacggugaaacucugucucuauuaaaaauacacaaaauuauccaggcgugguggugggcagcuguagucccagcuacucgggaggcugaggcaggagaauggugugaaccugggagguggagcuugcagugagcugagaucacuccacugcacuccagccugggcgacaaaguaaaacucccucucaaaaaaaaaaaaaaaaaaaaaggcagaguacacagaggaucuuucaccuucagaggcccugguguugacucuggugacaucagccucucagaggaaaggagcaguaacagccagucucagaggaaaugguaguaccauaugcguggaacagagaaacaaagcaagccacaucuuucuaucggcaaggcauuggguggaugcaaaguuaaagagcuaaacaugaaggccgggcgcaguggcucaugucacgucuguaaucccaccacuuugggaggcugaggcggguggaucacuugaggucaggaguucaagaccagccuggccaacaugaugaaaccccaucucuacuuaaaauacaaaaauuagcugggcauggcguugagcaucuguagugacagcuacucgggaggcugaggcaugagaaucgcuugaacccgggaggcagagguugcagugagccaagauugugcuacugcacuccagccuaggugauggagcaaaacucucagaaaaaaaaaaaaaaaaaagauguacccucagcuagccugcugguuacaguuccuaggguccuaacaucccuagcacccuaggcagccuguuucucugauuucuacuccuguaucuucaaaacaccaccaucacuacccaaagcugaaaaaaaauaacaauagcuaaaauguucugagcccuaaugcaccccuaggggccuggguaaucacuuuauauuacuaguuuuuaauacugccugcaguuuuuguuuuuugcuuugagacagucucacuccaucacccuggcuagagugccauggcaugaucucagcucacuguaaccuccgccucccagguucaagcaauucccaugccucaaccuccuaaguaacugaauuacaggagcacgccaccaugcccagcuaauuuuuguauuuuugguagagacggaguuucaccauguuggccaggcugaucuugaauuccugaccucaggugauccaccugccucacccucccaaguagcugggacuacaguugcucgccacagcacccagcuaauuuuuaaaaaguugugguuuuuguuuuuuuucuggccaggcgcaguggcucacaccuguaaacccagcacuuugggaggccggggugggcggaucacaaggucaggaguucgagaccaggcuggcaaagagaccagccuggccaauauggugaaaccccaucucuacuaaaaauacaaaaauuagccaggcaugggagcaggggccuguaaucccagcuauucaggaggcugaggcaggagaacugcuugaaccaggagguggagguuacacugagcagaucaugccauugcacuccagccugggcaacagagcgugacucugacucaaaaaaaauaaauaaaaauuuuuuuugguagcaacagggccucacuuuguugcccaggcuggucuuaaacuccugggcucaagcaguccucccaucuuggccucccaaaguguugggauuauagugucagccacugugcccagccugccugcaguuuuuaacaauaucagugaccuggucucacuucuaaaaauuuuaacuuaaucagagagaagccugggcaucagacuuuuuuuuuuuuuuugagauggagccuugcucugucacccagguuggagugcagugacaugaucucagcucacugcaaccucugccuccuggguucaagcgauucucccgccucagccucccgagcagcugggauuacaggugcccaccaccaugcccagcuaauuuuuuguauuuuuaguagagacgggguuucaucauguuggccaggcucguaucgaacuccugaccuagauccgcccgucucagucucccacagugcugggauuacaggcguugugucaucgcgccccacuggcuaaaguuuuuuuaaaguucccuaaacaacucuaaugagcaaccuggguucacaaccacuucuuuacaugcaucuucuuuucccuuucuuccauuguuuucuuggugaauauaggguugggguuuauuuccagaugggaaaauuaaagcauaaaagguugaauaguucacccaagauuaaauagcugguaagggaugaaacgaacugaacccaguugugcuugacucuggggcccaugugcuuuaccaugaugcacaauacagcacacuaaucacuagcaggaugaaaugggccugucucauugaggaccaucaucccaagguuaucacgaauugucaauuucccaaugugcuaugaaaugacagauaagagacuaauaggcuuauuuaaauaaguuaguuugaagaauauauucauccaggauucauccuuaggauucugaauaaauccuaaacagagauucucaaauuuuaaugucuguuaagaaucagccaggcaugguagcucacaccuauaaucuuggcacuuugggaggcccaggugggcagaucacgagaucaggaguuagaccagccuggccaacauggcgaaacuccaucucuacuaaaaauacaaaaauuaggccgggcgugguggcucacaccuguaaucccagcucuuugugaagcugaggcggguggaucaccugaggucaggaguuugaggccagccuggccaacaugaugaaaccccgucucuacuaaaaauacaaaaaaaaaauuaacagggcaugguggcacacgccugcagucccagcuacucaggaggcugaggcaggaaaauugcuugaacccgggaggcagagguugcagugagccaagguugugccacugcauuccagccugggcgacacagcgaaacaccaccuagaaaaaaauagauauauacaaaaauuagccaggcguaguggcacaugccuauaaucccagcuacuggggaggcugaggaacgagaaugguuugagccugggagucagagguugcagugagcugagaucgcaccacugcacucuagccugggugacaaagugugacucugucucaaaaacaagaaaaaaaaguugcccaggcuugucuugaacuucuaggcuaaagccaucuuuccaccuuggccuuccaaaaugcuggaauuacaggcgugagccacugcacccacccuggauaccgcauuuuauuuuuaauuuuuuuugaaacugaguuucacucuuguugcccaugcuggagugcaauggcacgaucuuggcucaccgcaaccucugccucgcggguucaagcaauucuccugccucugccucccaaguagcugggauuacaggcgcgugccaccacacucggcuaauuuuguauuuuuaguagagacgggguuucucuguguuggucaggcuggucucgaacucccaaccucaggugauucgccagccucggccucccaaagugcugggauuacaggugugagccaucgugcccggcugacaccacauuuuaaacaugcucucccagugacacugauaugggcagaauacgagcauacucugagaaaguguuucaaacugggggugggaggguucuucuaagcaauaaaguuuuacaaccagccaggcacaguggcucacgucuauaauccuagcacuuugggaggucaaaaagggaagauugggcaacacagcaagaccucgucucuacuuaaaaaaaaaaaagaguagcaaggcaugguggcaggugccuguagucccagcuaaucaggaggcugaagccggaggacugccugaacgcaagaguuugaggcugcaugagcuacgauugcaccacugcucuccagccugggccacagcacaagacucugucucaaaaaaguaaauuaauuaagacuggucaauggggugucuacuaaaaauacaaaaauuagcugggcacgguggcacacgucuguaaucccaggacucgggaggaugaggcaggagaaucgcuugaacucgggagguggaagcuggaguaagccgagauugcaccccugcacuccauccuaggcaacagagcgagacccuguuucaauaaguaaacaaacaaauaaauaaauaaauaaaauuugacaaccuauaauaagguaacuaaagacagggucuauuauacacauuguaucuaguuaucuagcauuagcuucagcaucugcuugaaagcuaaaagaaaauuaccagaaaugagaucacagaguguacuaugaucucaucacaggacucuccuccagcuccagaggaauguacgaaacaacuguuccacagcaggccagacagaaaaaugaagaaaacacuaggcacugugguuuaauaggccaagcagaauaaaugcuaccacaaaacuccauagcaaggcaugcggcacagguccugcagugagugaccugagugacugcaacaggcacucuuggccacugacccacguccaccugccaaaagcagcaguaaauagaaguacagugaguugaggccgggcgcgguggcucacgccuguaaucccagcacuuugggaggccgaggcggguggaucacgaggucaagagaucgagaucauccucaccaacauagugaaaccccgucucuacuaaaaauacaaaaaaauagccaggcgugguggcgggugccuguagucccagcuacucgggaggcugaggcaggagaauggcgugaacccaggaggcggagcuugcagugagccgagaucucgccacugcacuccagccugggcaacagagcgagacucugucucucaaaaaaaaaaaaaaaagacguacagugaguuaaauacccucuggggcccuauuugcacagucuguaaaauugguucggaaagaugccaauggagauaggauuccuaaagcaucuuucagauaugaccuguuggagggcccuaaggaauucacggcggccuugaccaccccaagagagguguucauaggccaaagucaggaauaagcugcagggcaaguugcacgcauuuauuguuucagaucacaggcuccgagggaacugaguuuaugauccacgcuuucuucaucgcuuuggagaguacacgccuaccccaccccaguauauccguuagguccuaguaaacauuuguggcacuggugauauguuucgaaucuuuuuuuuuccccaguaauauaaacccgagagcguggaccaagccauucgauuacauguuguguuugagcaacaccauccacgccgugagcuuacuggacccugggccgugcccagcgaccguggacacugaacuaagccagagcuggugcucacgugaagacaagggcagaggaggauucggagcucuacaggguagagccagaaggguaguacaggcuuaacugcuggcccggugcuuccagcucagccgaggggccgcggggccgcaggcugcauuccccgaggccaggccgcaucuuuucccccgccccgacgaccccgcgcacugcaggaagggggcggcgacguugaccgccgcaagcagccaaaggagggcggcggcugagagcggccaagaccaagaaagacgcacagcuguggcuuuacuaaaccgccgggcgggagcccggagccccacaggcaaggcccccagcgucgcucggaucuaccacggggagaccggaggcgucugaggccgccuccagaggaacaaagguuccucacgaggccggggguggcagagugucaagagacacacaggaaggaguggaaugggacuugggggaucugggggcgucccgggcgcgcccccagauuccgggcuccucaccgccuccuacgcgccgccacugccgcuaccgccgccaucuugugcagaguuugcuccuugaccccaaaccucccgccccaucgcgcgcgcucagccacguauccuaguucccgccccuuccggc

SEQ ID NO: 18739 - RNA, 5042 nt, Homo sapiens
guugccuugccuuuaggaaguuaccucauuucugugagucucaguuguccuguuuguaaaauggggagaauaacagauguguuggcaguaugaggaugagacauaguagucagugcaugcaauggcugggaguucuuacuguauugcgacagccaagcuggcccuguuucucacuccccugcacccccaaaacaugaucuaccuggggcuuugccaacagagaccuaugggauuguggcccaggcucacgcucaugaagguucuaucuucgccuugugucuccggagggacgggacagugcugagugguggcgggcgggaccgccggcugguacagugggggcccggguugguggcccuccaggaggcugaggugagggcugggcuggggucaagggagugagggagaagagcaauagucagugggcucuugacauucugcuaccacucugcagauucccgagcacuucggggccgugcgagccauugcugaagggcuuggcucugagcugcuggugggaaccacgaagaaugcauugcugaggggagaccuggcccagggcuucuccccuguaauccagguuggggguuaagggcucaggggaggaagggacaaaggggugugagagaggggcaggagugacagucaugcugugcugcagggccacacugaugagcucugggggcucugcacacaccccucccagaaccgcuuccucaccugcggccacgaccggcagcucugccugugggauggggagagccaugcacuggccuggagcaucgaccucaagguagagcccugugccccuggaucccccaugccacacccaccaggacaccuguggccaccacgccuuccccagcaccuugccuucugccucccagagguggccaguuuguacugguauggcugcacuggcuacucaaauauuaauuuuucuguacugacugguaaaagcugaugcuucuaguaccaccugggcacucccugccgcccccagaaccccucagacuuccucuugauccagcaccuaaaugguuaaucuccagcacagcuauuggcaucaguucugugguuaaauauuuugguaucacucccuguucaggcuccagugauacccggguaucccuucccucucuucccaucuucuccuugggaguaaguggcuuugaaguuaggaggacaagggguucacucugguucccucacuagaaagacaucaucuugaauucaccuucuccccucucccaggagacuggucucugugcugacuuccacccgaguggggcaguuguggccguaggacugaacacggggaggugagagagagccaggacucccaggagggaaagcagggaggacugggaaggguuccugguacugggggagugggcgagagugaccaccucuacccaggagccaccugcgccuuggcacuccucugugccucucccugcagccccugccacccgggcuccccuccucuucugugguaacuguuucucccccucccccaacccagugucuccuccaagccugggaguggaggaggcagcagcccaggauagagaaacagugggaaugggaggggcauagacaaacacagggaagugacaggcuuccagcuugcacagugccuuuguagucggccccuggucuguaguuucagauuacuuuuucagacgacaucagaagccccucagccuuuauccacacuuagcuccuucccauuucucagcauaagaaugcagugguggccaggugcgguggcucacgccuguaauccuagcgcuuugggagcugaggcggguggaucacuugaggucaggaguucaagaccagccuggccaacauggugaaaccucgucuccacuaaaaauacaaaaauuagacgggcauggugguacgcaccuguaauucuagcuacucaggaggcugaggcaugagaaucacuugaacccaggagguggagguugcguugagaucuugccacugcacuccagccugggugacagagugagacucugucucaaaacaacaacaacaacaacaacaaacuaaaaaagaagaaugcaguugugaccugucuucuacaucagagccuuucugugugugucucugagcuucucuuauuugccauccccaagccuacccaggguggccucccugggggucuccuuacauccugccuuuucgucuuccuaucugccuccacuucccucccuuccaggugguugguuuuggacacagagaccagagagaucgugucugaugucauugauggcaaugagcagcucucagugguccgguacagcccaggugggagccaccccaacccuggacucacaugcgucccuggcccuucccucucugagugacuguauuugcagauggguuguaccuggccauugguucccaugacaacgugaucuacaucuauaguguuuccagugauggugccaaauccagccgcuuuggccgcuguauggugaggaaguuggggugugugguggggcaugauaacagcugcgaaacucaggggucugaugcaucaagggggcucuggggaugggaaauggaugggauacuuuaaaacucuugaccuuugcucccagggucacuccagcuucaucacucaucuugacugguccaaggaugggaauuucaucauguccaauucuggggacuaugagauucuuuacugugaguggcaguggagcaggacauggggagaggguaauuggaguggguuuuguguagggggggcuguuagagguguuguuagauaaggaaguggagaugggguuaaaguggaguuggaauuauauguaggagaaauuucgugauuuggaaacaacuaguuucacaccaugucuuguugacuugagggaguucaaaaaugcgcuaagaaaagauuguuugggaaaaguuucucagggcaaguguggagcacuugacuuaucuagggaggaggaacucguggaagcuguuagaacuucagccagagcucaggacaggacgcacacaggguggguuucacagggggaggaggugaugcuacuacggugaccagaucacaugccaucgccggguuucaugccagucuuuccagucuggcuuucccuggcaucuucccuacugagggcagggugagagcugagcugggcgggcucccucuccccaggggacguggcuggaggcugcaagcagcugaagaaucgcuaugagagccgagaccgggaaugggcuaccuacaccugugugcugggcuuucacgucuacggugagcaggggcguggaaaccugcuggaagggugggggacaagguggagcccaguuugggcuuggaacgcugggcgugugucguugggugagaguccagaaaccugaagauccagcccaggaggccccucgggaccgggaaggcuugccuggaacgcggcaguggguggccgcggcugccggagcgccugaaaugguguagcucugggccguggguggcgguggguaggaggucgggcugaggccggccgcugugcuaggcgucuggccggacggcuccgaugggaccgacaucaacucccugugccgcucccacaacgagcgcgugguggcgguggccgacgacuucugcaaagugcaucucuuccaguacccgugcgcucgugccaaggugaggccgcggggaucgccggggugggaccggugggcccgagggcucagccgccaccgcaacucuucccuccggcccaggcgccgagccgcauguacgggggccacggcagccacgugaccagcguccgauucacgcacgacgacucgcaccucgucucgcugggcggcaaggacgccagcaucuuccaguggcgagugcugggcgcugggggcgcggggccggcgcccgccacgcccucucgaacccccucccugucccccgccuccucccucgacguuugaucgcugccuggcgggaccgacuggcccggcggcguggccccgccccgcccugcccuucccuggcccaaucccccacgacuaggggccgacucuuuccuggacugacuucgagacauucccgaucgcgcauuuuccuggagggcgcgaacggcgccccugcacacacuguuuagacccgcuggcugagccgggcagccccagccuaggccuugacucccgcugccugcugaggggcaauaaaccagaaccaaagucgccucccggugcuuuuguggggcgcugccgggcgccuccggggcucugugggguggggacgaaggaaaagaggcgugcggaaaggguaagggagcguagaccauuuaugcaaaugacaggcaaagccgcuugcaaauaaccuggcgaagcgcuaaggcgcgcgagucuuuggggcgcgaggaggagcugcagggcuccagcgaggacagaguuaagcccgacuccucucccgcccucggaaaaggggguggggccgagcugcgacggaaauagccgagcgguugcccgacaggagccgaacuucuuccggaaguagccgaucugcggggucucgcucuccgaccugagccgagcagugggccuuguucuccggaucggccgaagguguuccggaaggaggcgaacccugaggcgggcccggcaagccuucccugcggccggcagagcccaacgacuagugggacuccgcgggggcggggguagcuggagccuggcucuggccuggcaggagccgagcucguuccggaagaagccgagcggacgggggccagccucagcgucccgggagugaggcgauagcugcggcggcgacagcgcgggccgggaugaaccgcgacggcugaggcagcggaggugccggcugcgcgggccccagugagacucccucgaagcggcagcccaccguucggggcuuugccucgagccgagcccugcccccgcgagccucccggaccccuuugugcggccggaggcggcggcgggaacggccauggcggccaacauguaccgggugggaggugaguaccgggcgcagggauacggggccc

SEQ ID NO: 18740 - RNA, 5042 nt, Homo sapiens
gggccccguaucccugcgcccgguacucaccucccacccgguacauguuggccgccauggccguucccgccgccgccuccggccgcacaaagggguccgggaggcucgcgggggcagggcucggcucgaggcaaagccccgaacggugggcugccgcuucgagggagucucacuggggcccgcgcagccggcaccuccgcugccucagccgucgcgguucaucccggcccgcgcugucgccgccgcagcuaucgccucacucccgggacgcugaggcuggcccccguccgcucggcuucuuccggaacgagcucggcuccugccaggccagagccaggcuccagcuacccccgcccccgcggagucccacuagucguugggcucugccggccgcagggaaggcuugccgggcccgccucaggguucgccuccuuccggaacaccuucggccgauccggagaacaaggcccacugcucggcucaggucggagagcgagaccccgcagaucggcuacuuccggaagaaguucggcuccugucgggcaaccgcucggcuauuuccgucgcagcucggccccacccccuuuuccgagggcgggagaggagucgggcuuaacucuguccucgcuggagcccugcagcuccuccucgcgccccaaagacucgcgcgccuuagcgcuucgccagguuauuugcaagcggcuuugccugucauuugcauaaauggucuacgcucccuuacccuuuccgcacgccucuuuuccuucguccccaccccacagagccccggaggcgcccggcagcgccccacaaaagcaccgggaggcgacuuugguucugguuuauugccccucagcaggcagcgggagucaaggccuaggcuggggcugcccggcucagccagcgggucuaaacagugugugcaggggcgccguucgcgcccuccaggaaaaugcgcgaucgggaaugucucgaagucaguccaggaaagagucggccccuagucgugggggauugggccagggaagggcagggcggggcggggccacgccgccgggccagucggucccgccaggcagcgaucaaacgucgagggaggaggcgggggacagggaggggguucgagagggcguggcgggcgccggccccgcgcccccagcgcccagcacucgccacuggaagaugcuggcguccuugccgcccagcgagacgaggugcgagucgucgugcgugaaucggacgcuggucacguggcugccguggcccccguacaugcggcucggcgccugggccggagggaagaguugcgguggcggcugagcccucgggcccaccggucccaccccggcgauccccgcggccucaccuuggcacgagcgcacggguacuggaagagaugcacuuugcagaagucgucggccaccgccaccacgcgcucguugugggagcggcacagggaguugaugucggucccaucggagccguccggccagacgccuagcacagcggccggccucagcccgaccuccuacccaccgccacccacggcccagagcuacaccauuucaggcgcuccggcagccgcggccacccacugccgcguuccaggcaagccuucccggucccgaggggccuccugggcuggaucuucagguuucuggacucucacccaacgacacacgcccagcguuccaagcccaaacugggcuccaccuugucccccacccuuccagcagguuuccacgccccugcucaccguagacgugaaagcccagcacacagguguagguagcccauucccggucucggcucucauagcgauucuucagcugcuugcagccuccagccacguccccuggggagagggagcccgcccagcucagcucucacccugcccucaguagggaagaugccagggaaagccagacuggaaagacuggcaugaaacccggcgauggcaugugaucuggucaccguaguagcaucaccuccucccccugugaaacccacccugugugcguccuguccugagcucuggcugaaguucuaacagcuuccacgaguuccuccucccuagauaagucaagugcuccacacuugcccugagaaacuuuucccaaacaaucuuuucuuagcgcauuuuugaacucccucaagucaacaagacauggugugaaacuaguuguuuccaaaucacgaaauuucuccuacauauaauuccaacuccacuuuaaccccaucuccacuuccuuaucuaacaacaccucuaacagcccccccuacacaaaacccacuccaauuacccucuccccauguccugcuccacugccacucacaguaaagaaucucauaguccccagaauuggacaugaugaaauucccauccuuggaccagucaagaugagugaugaagcuggagugacccugggagcaaaggucaagaguuuuaaaguaucccauccauuucccauccccagagcccccuugaugcaucagaccccugaguuucgcagcuguuaucaugccccaccacacaccccaacuuccucaccauacagcggccaaagcggcuggauuuggcaccaucacuggaaacacuauagauguagaucacguugucaugggaaccaauggccagguacaacccaucugcaaauacagucacucagagagggaagggccagggacgcaugugaguccaggguugggguggcucccaccugggcuguaccggaccacugagagcugcucauugccaucaaugacaucagacacgaucucucuggucucuguguccaaaaccaaccaccuggaagggagggaaguggaggcagauaggaagacgaaaaggcaggauguaaggagacccccagggaggccacccuggguaggcuuggggauggcaaauaagagaagcucagagacacacacagaaaggcucugauguagaagacaggucacaacugcauucuucuuuuuuaguuuguuguuguuguuguuguuguuuugagacagagucucacucugucacccaggcuggagugcaguggcaagaucucaacgcaaccuccaccuccuggguucaagugauucucaugccucagccuccugaguagcuagaauuacaggugcguaccaccaugcccgucuaauuuuuguauuuuuaguggagacgagguuucaccauguuggccaggcuggucuugaacuccugaccucaagugauccacccgccucagcucccaaagcgcuaggauuacaggcgugagccaccgcaccuggccaccacugcauucuuaugcugagaaaugggaaggagcuaaguguggauaaaggcugaggggcuucugaugucgucugaaaaaguaaucugaaacuacagaccaggggccgacuacaaaggcacugugcaagcuggaagccugucacuucccuguguuugucuaugccccucccauucccacuguuucucuauccugggcugcugccuccuccacucccaggcuuggaggagacacuggguugggggagggggagaaacaguuaccacagaagaggaggggagcccggguggcaggggcugcagggagaggcacagaggagugccaaggcgcagguggcuccuggguagagguggucacucucgcccacucccccaguaccaggaacccuucccaguccucccugcuuucccuccugggaguccuggcucucucucaccuccccguguucaguccuacggccacaacugccccacucggguggaagucagcacagagaccagucuccugggagaggggagaaggugaauucaagaugaugucuuucuagugagggaaccagagugaaccccuuguccuccuaacuucaaagccacuuacucccaaggagaagaugggaagagagggaagggauacccggguaucacuggagccugaacagggagugauaccaaaauauuuaaccacagaacugaugccaauagcugugcuggagauuaaccauuuaggugcuggaucaagaggaagucugagggguucugggggcggcagggagugcccaggugguacuagaagcaucagcuuuuaccagucaguacagaaaaauuaauauuugaguagccagugcagccauaccaguacaaacuggccaccucugggaggcagaaggcaaggugcuggggaaggcgugguggccacagguguccugguggguguggcaugggggauccaggggcacagggcucuaccuugaggucgaugcuccaggccagugcauggcucuccccaucccacaggcagagcugccggucguggccgcaggugaggaagcgguucugggaggggugugugcagagcccccagagcucaucaguguggcccugcagcacagcaugacugucacuccugccccucucucacaccccuuugucccuuccuccccugagcccuuaacccccaaccuggauuacaggggagaagcccugggccaggucuccccucagcaaugcauucuucgugguucccaccagcagcucagagccaagcccuucagcaauggcucgcacggccccgaagugcucgggaaucugcagagugguagcagaaugucaagagcccacugacuauugcucuucucccucacucccuugaccccagcccagcccucaccucagccuccuggagggccaccaacccgggcccccacuguaccagccggcggucccgcccgccaccacucagcacugucccgucccuccggagacacaaggcgaagauagaaccuucaugagcgugagccugggccacaaucccauaggucucuguuggcaaagccccagguagaucauguuuugggggugcaggggagugagaaacagggccagcuuggcugucgcaauacaguaagaacucccagccauugcaugcacugacuacuaugucucauccucauacugccaacacaucuguuauucuccccauuuuacaaacaggacaacugagacucacagaaaugagguaacuuccuaaaggcaaggcaac

SEQ ID NO: 18741 - RNA, 14828 nt, Homo sapiens
auaauguaaaguuccuuugcgcucugugaauuauacacguuagcucuuguuauuagcagcuauucucucccuucacugggaaaggccuggaaucugaucccuaagaauuagguagucacaaagccccaugucacuacccgccccaacugcuuccgcucuuucccagcuagaagacagucaucaccguaggaggcaggguaauuaaaaucacaagugaacacaggccucuauuucuguucuucugaagucuucucuccugcauaucgagguacugcgaacacagaaaguacccugcuucaacauaucuacuccccuugaagacgccaccacucacaaaggaggcaggacaggaaaggguucaauguucaguuuccuuuaaugacccccaucucccugaagggcaggugcaggcagcuaggugauggcaagagauguucacuugaagaucuugcccugauugaaggcuuugcccacaugcuggaaggcccccucccaggaaaaguacucucgaaccagcgucugggucuccucgcugccaggauccaguuuccgccauguguaugacucguaguccaccugccaaucuggacucagcuggggauaaaaagccagcauguggucaaguuaugagacaccaccccacaccuguguuacuuccagcucaaacacaugucaucagaccccaggucuccugugaacaugaacugcuccuuccuauaagcauuccugaacccuccuaaacauccaucaacucagaaauaaaacacagugcuucuuauaucccugccccacccuaaagagacuccucuccuccaccuuccucaccggaaaggcaagcuccuggccucggaagacccagacuccagaaauggagcugcuauuguugguuccaaaaaggaugacacuggcgaaggcauucuuccucagcuuguccagucgcuggaacauuccugaagcggcaagggagaacauucagccuuuggaaucacagcacuugcuacaccuuguucuccuuccuucucagacccacucucuuaccagugaugagauugcagcucaugaaggucugagugaguucuucagggaagcgauacucugaguaccacagggaccagccguccuuaucaaagugcucccagaaauauggcagugccacagagaguguguccucauuggaguacuugcgcuuaaauucauccaacacaaagguacuaagaggaagaaagcacaggggucaaucaauaaggaggaagguugccaggcuaagagaagugaagggugcuuucacuuaaaauuuacuaauauaaaggaaauggucauugugcuggcagauguguaugaccuuaugagggaaguaagcucaagggguuugaacaggggccuaggacacuccucugcauaaguaugcaaggcauguggaggguggaacucaaagugggacucugagaccugccccaggaagggcauggcuaacugcugcccccagguggagacagagugaggacuucuuuuucccuguucaggcccuccccaggcuguuuuccaugaaccacacuaagucacugacucacccaagucucuucccccccaccauacaggccucuucagguuacacaagcuguaacaggaauguaagcagugaacauucucaaagggccuccaccccaaaucuuacacccauguccuuuaguccaucucugccuauaaacaagcuuuagucuuuuccaagguuuuccgaugcuggaaagcccuuagguucagguuaucuuaaaagcaaucuggcauacugagccaagaaugccagcaucaauauagcagaggucacucccuccacgauuggugcucuguuuucuuucuuuccaguuauaaacauauacacuggccagaugcgguggcucacgccuguaaucccagcacuuugggaggccaaggcagguggaucaccucaggucaggaguucaagcccagccugaccaacaaggugaaaccccguuucuacuaaaaauacaaaaauuagcugggcgugguggcaggcugagacaggagaauagcuugaacccgagaggcagagguugcagugagcagagaucgcgccacugcacuccagccugggcgauagaggaagaguccugucuggggggaaaaaaaaggacaggcaggguggcucacaccuguaaucccaacacuuugggaggccgaggcgggcggaucacgaggucaagagaucaagaccauccuggccaacauggugaaaaccuaucucuacuaaaaaaaaaaaaaaaaaaaauugguggcacacgccuguagucccagcuacucgggaggcagggacaggagacuugcucgaacccaggagacagaggcugcagugagccgaaauugcacuccagccuggcaacagagcaagacuccgucucaaaaaaaaaacaaaaaaaaaacaaaaaaaaaaaaaacaaccaaaaaacacauauaugugugugugcauacauguguuaaaugccuaaccuuguuuuuacucuaacucacuacuuugaaucuucccuguuugucucuuuaaccaccuagccuugcuucucauguaaauaagacucucucucuagcugggaaagccggacaaacuccaauugacccuuuaauuuacaagacacuaagggcuccucacccaacccccuuccacaaggaguugaccuguguuaagcagauccucagcauuucaaaggagcccaauuaacugauaagguacuggcacaaacaauguaugaaguucccaggauuuuucucaaagugauaacaacauaaagccuugaguugugucccgcauagccccauaucuaauuauaaugaaggauuuagagcccugcaccugguacgguugcuuuuuguaaccauuugucuuuuaaauuguuuaucucucuguaaccauuuugcuucuuuugauucuugcauguuuuuaccucuguaaaauuauugcauuugaguuccccuccccuuccuaaaccaagguauaaaaguuagucaagccccuuccucagggccgagagauuuuugagcguuagccgucucuugguugccggcuaauaaaggacucuuaauucgucucaaaguguggcguuuucucuaacucgcucagguacaacauguguguguauauaugugugugugugcauauacauacacauauauauauauaugcugacugaagaaaaucaccuauaaugccaacaagaggauaaucuuuuuuuuguuuuguuuuuuugagauggagucucgcccugucacccaggcuggaaugcaguggugcgaucucggcucacugcaaccucuaccuaccggguucaagcgauucuccugccucagccucccaaguagugggauuacaggcacgugccacuacgcccagcuaauuuuuguauuucuaguagagacgagguuucacuauguuggucaggcuggucuugaacucuugaccucgugauccgcccgccucggccucccaaagugcugggauuacaggcaugagccaccgugcccagcccaggauaaucuuuuauguauuuuccuacagccuuugauuuuucaaagauguagccaugacauaugcaguuuugugcuuauacuuuguuguuacuggacauccuauccaugcuguuaagaauucuuucagccugggaaauauagcgagacacugucucuacaaaaaaauuuaaaaauuagcugggagcugggcaccauggcucacgccuguaaucccagcuacucagaaggcugaggcaagagaauugcuugaguccgggaggcagagguugcagugagccgagaucacaccacugcacuccagccugggagaagagcaagacccugucaaaaaaacaaaacaauccuuuuuuuuuuauuuuuccuugagacggagucuagcucuguugcccaggcugcagugcaguggugcaaucucggcucacugcaagcuccgccuccuggguucacgccauucuccugccucagccuccugaguagcugggacuacaggcgccugcuaccgcccccggcuaauuuuuuguacuuuuuguauuuuuaguagagacgguauuuuuaccguguuagccaggaugguuucaaucuccugaccucgugauccacccgccucagccucccaaagugcugggaucacaggcgugagccaccgcgcccagccuaaaacaaaacaauuuuuugcacuagcagucccagcuacucaagaggcugagguagaaggaccaccugagaucaggaguuggacaccggacuaagcaacauagcaagacccuaccucaaaaacagaauucuuugcaaacauuuuaauggccaaacaaucuucuaaugcaggauugugccauaaaucuacuaaacauugaauauuaaacugaauguuuaguugguucuauuguucauagcauaaauauugccaugaguauuccaauuucacucaauccuuauaacccaugaguuaucaacuguuacccugacccuccccucucuuuacagaugagaccaaguagaaugaccuguccaagauuacacuguagcaaagcagaggaucuguccuuuaacccuaggucccagguuccuuuccaaaugcauaagagaccucaucugaggagccuuaaaaccucaaccacaccaaaacuggggcugggaauuuuuucacacccuccugaacuguucaagcuauuuguuuugagacagggucuugcucagucacccaagugcaggggcacgaucauggcucacugcagccucaaccugcuggacucaagugacccucucaccucagccugccaaguaguaugagccacugcaguugaccuagcugggucuuaaaagaacuagaauuaaaaucuggacauuaauagucuuggucuuuuaggauaucacuuuuaugacauuaaaaauguugggggagccaggggcgguggcucacgccuguaaucccagcauuuugggaggccaaggcaggcggauugccugaggucaggaguuugagaccagccugaccaacauggugaaaccccaucucuacuaaaaauacaaaaauuagccaggcaugguggcacgcaccugcaauccccagcuacucgggaggcugaggcaggagaauugcuucaacccaggaggcggagacugcaguaagccgagaucacaccacugcacuucaaccugggcaacagagugagacucugucucacaaaaaaaaaaaaaaaggccgggagcaguggcucauaucuguaaucccagcacuuugggaggcggagacgggcggaucacgaggucaggaguucgagaccagccugcccagcauggugaaacccugucucugcuaaaaauacaaaaaauuagcugggcaugguggugcgugccuguagucccagcuacucaagaggcugaagcagaacugcuugaacccggcagguggagguugcagugagccaagauugcaccacuacaucccagccugggcgacagagccagacuccaucucaaaaaaaaaaaaaaaaaaaaaaaagggggccaggcacgguagcucacaccuguaaucccaccacuuugagaggccaaggugggcggaucacgaggucaagagauugagaccauccuagcuaacacggugaaacuccgucucuacuaaaaauacaaaaaauuugccagccguggugucacgcgccugucauuguagucccagcuacucgggaggcugaggcaggagaaucgcuugaacuggggaggcggagguugcagugagcugagaucacaccacugcacuccagccugggugacagagugagacucugucuccaaacaaacaaaccaaaaaaaaacaaaaaacacaaaaaggagccagguacaguggcucacaccuguaauuccagcacuuugagaggccaaggaucacuugagcccaggaguuugugaccagccugggcaacauagugagaccuagucucuacaaauaauaaaaaauuagcugggugugguggugugugccuuugucccagcuacuccagaggcugaggugggaggaucgcuugaguacaggaggucaagacugcagugagccgugaucacgcuacugcacuccagauuggacaacaaaguaaaacccuguuuccaaaaaaaaaaaccuuggggaaagcauuucuggcagcccuguagggcaucaugguaacccaauaaauagacauuaauaaacauucccaaaaccauguuaagaaaauguaaaguuuauuaaauaaagauuuuaaguuuacuacugccucauuuauuuccugcccagaguacugaccuacuauaugugaaaaucucuagcuaauaauuaacaacgucugaguuacaacacaauauguaauuuggguuaauuaucaugaccuauuuacacacaccaaaaauccugcucacucuugaccugcaccugugcuaaauucaaggcaaaucacuaguucaaaaaauacaucuuuaaagagugccugugucuggauggagccuuccuggucuuguacaaaauacccgggaguaagaacuuucagcuauaccccaaguugcucccaucuauuagugcaaugcuuguaauucacaauucuaugcacagcuacugugucccuaccagugggugcuccuuuaggcugguucacccgguauccaagccauuacaagaugggagagggugaaauguaaacccuagcagaccaagcaguaaaaagaugaacggcuuuggaaaugacagggugagugggaggaaaaaguacagagaaagaggaguuccaaagcaaagugaccacagaauauauauuucucaaacugcuugaacucccaauaaaaugacuuggagcagugauggaagaaagacuccaucccagagaacugggcaagcacucagcguccuacauuuuucaugccaaaaaucucguuuuuacuauauuauuucuuccaagaagcccuaccuuuaacugaaaaagggauacagaggacaccuacuuucuucuacuuggggacuuuacucgguuguggaacaaugaacuagacagacacuacuuagcuaugaucuucauccuuuuucuuagugagcaauuuuuguacagucugauucagcaaaacagaaaacaaaacaauucaaaggacccugcucuggcauccacuaucuccgcacagccgggcgcguggcgcaccgcaaggcucucugcacuuucuuccuccccacgccucucccuguauuuguucucagagcucucaaauggucaaaugagcuugcucaaaaccaacuuaccacuauaucaaaaucuguuccugucuuuguuggaauaggaguucaaucuuccccaguacuggcuguacuugaaacuugcucuccacaaucaaaauuugcccaauuccugauuaucagccagaaagcugcuuuauuugcaacuaaaauauaccuuuaacuuuauauggacaaccuaaaauucuggcucuagcugugugugaggggggacauacagaggugagaacaggccuucuuuggucccacacccuccacccuccaauauccuuaccucuugggcaggugagcgaagggguccuuggccuugggcucagcagccagcgccugcucacauucauccaucuccuccucaggagcaggggcagccgccuuuuucuccuccuuccgcucagccuggggcuucugcuucucuucccgugaacccuucucuuuccgugguguguccuuuuuagguugggucucugcaaacuuuuuagcuggugcagaggaaggcaggaaagugaacgaauguucugccucuuuccacaccccuccaaaaccacacagagcaagcaagguaacagaggaaacugacgaaugggacaaguaaggaacuuaggccccagacugcucaucaguucacuguguguccuccagcaacaacacacucagcaacaaauacuuuauaucgcaaaucuauauaguaauacaaauuagucaggguaugaguguacacgaaacugcacauaauauuagcuaccacauugacacccuacauucugcagguccccauaacccaaaagcaagacaggaaaucaagggguugaugcagagcaaaccagacccugauccuggccauaugccucccagucuccucagacucaccaucaaacugggccaucuucucacacaguuucacuucgcccaagacagcccggaacuggggcugguuaaugcaggugaggaaccagcgguugguauugggaaaggccuggcggaaagaaggcucuagaaccugccaggacauaaggguguaaacaaagucaguggaaaggcccugaagaguucuguucacagcaagaguccuugcucuaccuaagucccagugcucaccuucuuuucaaacccuauagacaauagcuucauacaacaucauccuucccuggauuacuucccauuucuucauuuuuuucaauuuuuuuuuuuuuugagacagagucucacucuaucgcucaggcuggggugcaauggcgugaucucagcucacugcagccuccaucuccuggguucaagugauucucgugccucagccucccaugccuuagccuucugaguagcugggacuacaggugccugccaccacacccagcuaauuuuuguacuuuuaguagagaugggguuucgcccuguuggccaggcuguucucgaacucugaccucaagugauccgcccaccucggccucccaaacugcugggaucuccgaggcgggcggaucacgaggucaggagaucgagaccauccuggcuaacacggugaacccccaucucuccuaaaaauaaaaaaauuagcugggcgugauggcgggcagcuguagucccagcuacucgggacgcuaaggcaggagaauggcgugaacccgggaggcggagcuugcagugagcggagaucgcggcacugcauuccagccugggugacagagugacucugucucaaaaaaaaaaaaauuagcugggcgugguggcacgugccuguagucccagcuacuccagaggcugaggcaggagacucacuuaaacccaggagguggagguugcagugaaccgagaucacgccacugcacuccagcuugggugacagagugagacucugucucaaaaaaaaaaaaaaaaaaaaaaaauuuuaauagagauggggucucacuauguugcccaggcuuaucuugaacucgcaugcucaagcaauccuccugcccuggccuccuaaagugcugggauuacccgugagccaccacaccuggccuccauuucuuuuucuaaucuuuuuuuucaguguaguccaguuuaauggauggaugcuuggguccauccuccauuuaggaguaggaguaauaauugucuugcuccuuuacaaaacuauuucagaucuacuguuuccaaucuuuuaaauuucaaacgucggccaggagcgguggcucacgccuauaaucccagcacuuugggaggccgaggcgggcagauaaccugaggucaggaguucgagaccagccuggcaaacauggugaaaccccgccucuccuaaaaauacaaaaaucagccaggcaugguugcacaugcccguaaucccagcuacucaggaggcugaggcaagagaaucacuugaacccgggaggcagaaguugcagugagccgagaucgcgccaucgcacuccagccugggggacaagagcgagacuucgucucaaaaaaaaaaaaagauugagacccacagagggcuaucgaggacuuuuuugccaaauaaaaucuaaacacuauagguauuuacuaucuauauuggccauacuauacacacacgcacacacacacacacaccccccacacccacccauccaucaaacuucagaaaguaaagaacauucaaagaaaauauucaaacgcauuuagaauaauggacaguccuggcugggugugguggcucacccccgcaaucccagcacuugggaggccgaggcggguggaucaccugagguccucaggagaucaagaccagucugaccaacauggcaaaaccccaucucugcuaaaaauacaaaauuagacggguuugguggcgcaugccuguaaucccagcuacuugggaggcugaggcaggagaaucgcuugaaccugggagguggagguugcaaugagccaagaucgugccacugcacuccagccugggugacagagcaagacucugucaaaauaaauacauaaauaaauaaauaauggacaguccuucaaauuaaacuuagugucugguguauuaagcauggucaaagaaaaauaagaauaaacagcuucagguagaacuguugucaguuuucaguuugcaaagcuucagguagaacuguugucauuuuuuaguuugcaaagaccagaagaggaaaaaaaaucuugucauggaaacagaacacagcagucagagugcugguuccacaguacuuggguucaaauucuacucuaccacuuaguagauucacucacuaagaugauccccaugaggccccuggcacagggucuggcaugcaguaaguguuuuuucuuuugcuaugaucacauuacuauucuggaccagcaucaguccaagagcuuuuauuuggaaaccagugacuugucauucuuuuuugacccaauaaccuugacagugauuauuacuacccugauuuuauagauugcaaagaguaaaaaacaggacuaaaggaauucacccgcauauaaccccuuaccuacauugguaaacaaugaagccaaggcuugaaccuguaucugucuccaaaagagcuuaaagagcuuuuuuuuuuuuuuugagauggagucucgcucuugucccccaggcuggagcacaguagcuggaucuuggcucacugcuaccuccaccuccuggguucaagccauucuccugccucagccucccaaguagcugggauuacaggcuccuaccaccacgcccggcuaauuuucguauuuuuaauagagacaggguuucgccaugcuggccaggauggucucgaacuccugaccucaagugauccacccgccuaggccucccaaagugcugggauuauagguguuagacacagugccuggccugccuccaaaaagaucuuaaugcugaagcuaccaucaucaccucugucuucacaacuaagaauaaccaaucuucccaggaaauauggcaacaaacuaaacaucuuagcugccaaacagaaacuaaaggcaagacauuacccagcuucuuaagagaauggaaagcaagugaugguacucaguccugggauuccuggcuguuuuuuguuuguuuugacacgaagucucacucucacccaggcuggagugcaguggggcgaucgcugcucacugcaaccuccaccucccagauucaagugauucuugugccucagccucccaaguagcuggggcuauaggugugcgccaccacaccuggcuaauuuuuuguauuuuuaguagagacaggguuuuaccauguuggccaggcuggucucaaacuccugaccucaggugaucugccuaccucggccccccagugugcucggauuacaggcaugagccacugcacccaccucuagcuguuuuccaaguccucagcagaauacaggguaaccuagauaccucgucacuuuguuucuaauccccaucuacccacugccaaauggauuuuccauaaacuucaccugcuuauagagccacaacagggugcagacaacugugaugucagccaaugucacucguucgcccaccagaaaaguccucgucuucaaguaagcauccagcagccccagaauucgccucacuuccuccuuugcauucucaguggccuagugauucaacaugauaaaacucaucaguggguaccaaucccuuucccucaccucccccauuaauagaacuaagagggcuauuuucaccuagaagucugagcucacccucacucucuuucaauggaggcagauccuagggucauucuaaauguauuacaaacaaugaacuucagagguccucugguccagccacccccuuaccauuugguauaaucucuucacagcagcaaucccucuucugaucacucaugacagacacuuccuccaucaacugcccacugcuucaaacucguacccuagagauuacgucuucucauugccuacauauccuuggcaucuuuuuuucaaccuauuuuauuucuuacucccaacacccaggagcugaugccaccccugccccuggcuucucucaaaguuccaaggcucaccuguuuguuguggugcaugaugcccaagguggggaacacccagguacuggcugggggcacuauaucggaaucagcaaagcucacccacugcaccaccugggcugcugccucuggaguacuuccccgcagcuccucauugcucacugcagaggcagaacacgaaggucagaacucugggggaaugccaacaccaguccagguccuggagaauuccuucauauccacccccgcucacacuuauccucuccuacacccucaccuccaaauucucccauucccauauaccccugcaaauuaccauaguaggcaauggcguugcucucaaacacacagaauccaucaucacccucaaaugcugggaccuggggacaaagcagugaaaagauaagguaaaacacacaaaauuucuuccuaaccaauaccaggagccaaacugcuuugaaaauacuuauauaaggcugaugauucucacuauccaaacucuugauacucaagaaccauaaauaaauacuucaagaacuuggccuccuuugcaaucugaauucacaauguuaacuaggaagcccaauagauuugaauauuacaggauauuuguaugaaaucucuggaucaaacaagcagaaggccaaaagcaacuccuguaucaaugucuguaucaguuaaaguauuagugugugacccagacccacacagcacuucaucuccuccauucuuagcauguuucuucaccuaucucuauaaaccccuugggguaagaauucugcucauaacagauaucugauauauuugcacugaaaaugcuuagucaaaacucauucucuuucccacaaaguaaacucgugaauuuuauaaagucacagaauagcucuguauuuuuuuucacaacuacauguaaaucuguauuuaucucaaaauaaaaucaccgaaauugaauaaaacaacaugggaagcucccuuuuagagaugggggccaccaccagagugacagaaucgcagggccuugguuucucagaaccgaaggaugcuccccaucucccaacucaccuugccggcaggaaauuugcggagaaauucaggggugcgguugguuuggccaaaauggaagugggguggugcggagagcacgcggaccugagccccgcuguacugagcagcgaugagagccuugaaggcccuccaguuuucaggauacguguacagggucuaugggagaaagagagggacaaaauuaaugaguagaagggucccaguccuuaaugccacucuccaggaugacuuuccugaauaaucccaauguauucaacucacccuuuuacuuccucuggugaaccaaguccuuuaguacuugucauauguaaucagaauccuccgaaauaccaagaacagaacuacacaccaacugcuaaauaaagcuuguugacagauuugaccuucccuaaggacaccucuggaaguauucucuuccucucaaaucuaucuccaagaaauccagaacuucuagcuccaucagacuccaucugccuacaaacauacucuccucccuucccggagcccucgcuucauucauugaugguuccgagcgccugccuacucuacugcucagcugcucaccgcuucaaaagcaucguccugucucuaaggcacgcacgacgaucgagagauuucuaguuccccucagacuagccagagauaggggauggcaugccgucuucuuaaaucaacuccucucucucaaaaagccuuucuuuccgugucgcgaauaucaucccuccgguccugucccgcagcgaguuccccggcguugggcuucucuauuaugccggccagcggaguccaauuggucugacuucacuguccggagaauccucucgcucccaaaccucccugagagacgaccuuuaaccgugccagccggaccugccuacaaagacccuccucuucaaccuguccccuguguuacuccacaaaacggacacagaaguucgucaaccugcccagauaccacgccucaaagcggcaacagagccgaaccccuuucucaggcuucggacggcccagacccggcaucucuuuucuccucuuccccagacccuuccaccucuggccuccgagagccccagccucaguuccccuccaggcccuaggaacccuacucuccagcaguacagucuguagacccccgaaucaguuccccacucaaccucagaacuccucuggcgccgacuggccccacucgggcaaaggauggcgguggauaggaugacccgaaccaccagagccagcaaacuuaccccagccgccauggugauuccgcaaagaaagggggugggguucucggcgcugccgcaaaguaagccgcccgggagagaagggagggggaaagaggagagccguggagaaacagcagccggaaagcgaggacgaaacagaagacauacguacgacaguucgguauccaguggcgcugaauuggaaaaagaacuggguggguggggccugcuggccagcgcggaaaaagcucgggccugcgca

SEQ ID NO: 18742 - RNA, 113276 nt, Homo sapiens
ccggccacucggagcugcucugccgcggggacugcaccgcccgcccugccagacccgcccggaacggggcucgucgccgccaguagccgcagcaccgcagccuugggccucgcgccggcuauggccgugcccuggggcugagcccucagguaggggcgccaggcgcaccguggcgccaucgggguccggggcaccaagggcgggucgcggggagguggguugcggugcuccggcagggcgcguuguugggggugucacugugaggauucaagcaguuuggagcaagcggggccacccggggcggcgacgcgucgcucucugggagcggaguucugccucuggaguuggggcgcaaguugguuaaaguuggaaaaucgcuccgaagugcuuugcuccacucuuuauuucuccggagggcggacuguuggcuccacugcaaggcagggcgccccguuccgggccugguggccucugucccaccuccucucccugcauggggcgguggcucgggggcugcuccguucguaucccauguuuacuggaggggaaauuuccgagaucgccaccgcggcccccagcgccuccgcgccuccgcgaccccgcaccgugcgcccccucggcuguccuuccgcgcucccugcaccucugccccuaaccgcgucccgagucguccaggccccacccuguucuguaccaccagccccucagccuccuccagcugccccgcccuagccuugccucuccgcguuccccgcuccagaaaaccuuccucucgggccgcggaaccuggaaguuugcaaugcgccucccagcgggauggguggggagggggacaaaauuagggagauuccuaugcugaggugggcgaggaggggggugcgcugcggcggcccaguccucgggaccgccccuuccccuccggaggcggcgcuuuccccccgcccaacucccaaacccguccgggcgggauggcccccgccccagagccuggcccggcgccagcagccugaggaauguggugguuggagccggugacuaauucaaaccagaacucagggaggaguggugaggggcaaaggggaggaggaaggggcugugugugggaguugggggcaggagccgggcuuggcgugggaggagggcuaagcugcgcucgcuggaacccugcgcuccagcggugcgcgccaggagagggggcccgaagcgaggucucgccuagaguuggaaaggcagcgugcuuagggugugugcagagcuguguuauguaaggcuuucccaugcaaggggagggggugugugugugcagugugcgagggccugggccgucccuggcagggcuggucgccccccagcagugcccaggccgggaugugggggcgcagccccuuggcggcgcugaccaugagggacuccaggggcccaaacagggcuggcugugccccuugcugggaggggugcggagggggcagauggguguucucagcuguagccgaggccccacaacaagguggggaacggcucuggccccucugcacaaugaggccacugaggguugugugcgaugugugugcuugccgguuucgcaggguguggcucccgccgcggcgaccguggcagugaggugcucccagggagcgugcggucgcugcagagugcccugcucuguggaggggauuuguggaaaggcagugugggagccucccaagucagucagguccuuagaccuccggagucuccggaggaaaagggaccgagauaucuaccucugugucuccagcacagcgcugggcgcucaguaaauacugguuucgaacccgucuucauuagaauccaaccucggauugcagggcuccugcucucugcuugcccgucccagcacagccuagugcaugguagguguuggguugauuuuguggaauacagugaggggcugcagcagugaagcugagagugggggaaggcguuuaagggccccugcaccuauacuggcuguaauucaggguagagaucucgcuuucauccccuccccgugagggaaaucccaggggcaggguguggcacucacuuccuuucagaagcugaauggggggaagcuuccuucuccaguccuuagggacagcggggucacccaccccccaccgcguggauaguggccugugcagaauggggaggacaggggagcccccaaguuaggggcaccucuuugcucugagcugugagcuuuggggugagggagggugggagaggagcuagggaggguaagaguggagcuaggagaggucgcaggguuugggggcugugggaauguggguuagagggugucugagccccucucuaaagccuuugucccuaagagguuaugcacagggacacuggucagagaacagggacacauggggagccacauaagucaugcgggcugauauggaggcccacagcagcgauucagggguccugguccgggaacuccuugaggagccaaccccucggagcugaggacuuguggcagccagacaugguccagggccaggggugggacacagggaccuguugagggagaagguccagcgucagcccaggguacggaguuggcuggggguccccggagucaucuuagcccucaggaaguccuggggaaagguggcggugcugccaggcuggauucuuuugcucgacuuggaauuggcugguggguccuggcagagccggucacccugagccugaggagcugguuugagggguuggggcaaagccgugggggcggagggguguguggggcucugggguguggucaccaccuucuuuagaacuugggaacugccuggagacagacagagagacagaccgggagagcuaguccuacuccuuaugggaacaguguggcucucucccccaccauucccgaggccccaaaguuucucuccccggagcugggcuggcaccgugcugugcacgcuuagguuugaggaagggugauggccgcuggggaggauuuagaaugugcugcuugggcgguggcaguggcagggauggagggccuucugacuucucuucgucccccaucgauucauccaggcuggcauuucccugggcucaggccauccggugggacucccaaggcuuccugagcacgagcaauuuccagcguuccugggugugcccgagggaguguggggggcacgugggugggccacaagaggauuccgaaggaaugaagccccuuuuccucccugcuggccucaguucccaccagggcuguggcugagcugucgcuggcagucuuagguaggucacugauagcauugcaggugucgucccacuguggcuuuagguccuugugaccaccaugucacagcuugucucugagugagaugugugucauugccugugagagaguaucccacugguugugaaugaaggucuuccccuuguggcgugccuggaugugucaccucugccugcguugucaucgggcuuggaggcagaggauggcaguggcauucugcucuggugguggagguuuccugcgggcccguagggguuguagguaaggacugaagugaguuucucgguccuggacauguccgcacgcgcaguuuguguccagaagccuuugggagguugaggacagccuugggggugcaggccccagcugagcaggcuaagcaaggcacugcacacggccugucagggaggggcauccugcccggucccccgggggcuggagcggagguucugggggaaggggaagugccuggagcugaucccgucuacagcuacguguccuggcggggcucggggguagcucuucagcgacagagccggagcggccuggccccacgccccugcaguagcgugguccgaccgcuggggggagagcaagcagcgcccuccccagaucccggccuuggguggggcagacaggcagcuuccaaacuguaaucuaccccacagggcaagaccaagcguucugcuccacccccucuccuauaggacgccacccucagaguuggugucuuaaucccagugguucuggguaaaggcccacucuucccugcuucuguguccagguguggggacuccccacuggaucauaggcuguccccagcccccuuucacaaggauugcagagucccuccuggccagggagggaagagggaaucucccucgcugcuggaagugagagcuuggagcuucagggcuuccaagcucacuguagcaugggauggggcugugcguggcugggguagagagagauggagaaaggcgucacagcagagucagaaagcaaccagcuggcugagguugggguguaagggcugcccuggaagucagcaugaugugaggggccaggggaagggggugauggggaggggagggcuggaaugacaaggauggaaaaacuuccuccuggugggaguuguggcugggcuggcgccucccucuccuaagggcagggagcagggaggaggccaggcaggugcacacacacaaggggaggugcaggcucaagggacacaggugccagguaaacaggcauagggaccugcaggacaacugucuauugugagccggugaaggcuggcuggggcugcaggcugcccugggcuguguagaguggagaauggggcugagggucuccguguacuaaugguguguaugugugugugugugcuugugugccuuucuuugaaggugcccaaguugcauguguuuugcaacauguucaucuaauucuuccugguaauuccaccucccuaaccugccccuccucccugcacacugcccagaaucagcuagguggguuuguaaaaguuguuaaugccagcuuagacucugagaugucugcgcacuucugcuccgguuagaauguggcauaauguuuuuuccuaaacaagccuggcagcugcauccucggggguccauucagagggccaggcccuggaagggaugucacccuuguuccuuuggaacaagggccuugggggucagagacuccugggcuugcauuucaacucugucucacacuugggcaagucaucuuaucucuugggccugcuuucacuucucugaaauaaggauauuaauucuuuugacauagcaucaucauuugggaguugaaugagaccccaggcaugggauguugccaacacagucccuggcacaucagagcgcucugcagaauucucuuucuacuugugugugggguuuuuuuuucuuucaacauggaacuuucuguuccucuuugccuccuguugaguguuuaugagagcagaccauacugucuucugggugugucucucugaauagccucccucuccuccugguuccgaauguugggggcuuccccucugguaggggucucuaacucugggcaugagucauuuuguuccugggaugaggacugcuucucuuuggccuuguguguguggugggucgauuggccuaugugcgugcugccaugcugggcggaaguuucacuguggccgguacccucccuaccacggauggggugauuuucuuccccucggaggguugccuccugugucccgccugugcuggguggaugcacagucaugggccccugugguguguaucuuguccucagguuuggugcauuugggcacugaggccuguggccugucucugggggaguguguguuucaauuccugucaucuccacacugacgcuggcugcagggcugucucuagcugcugcagcaguuggcccgguuuccauccuggcugucuuuauacuggcuccuccggggaaggggcacuguucuccgagggcaguggaggaaggaggcuccucuggaggucaccccuggcagaggccaucugcuggggucaagaaucugcuuccuggaguucugcgucuacuuggcguuguccccaguugcaggguaugggcagagcccugcugcucggcacauccucuuugcaguuuugaagugacaggaugggcuguucucuugcugcuucuggccugaauuacagucugucccgcagcgucaggcauacgugcucucaccuuugcagcuggagcggccucgccaucucauucuuuucugcccuccaagcagucuucugccuuagggggucuccacucuggcccugcuccuucuuuuuuuauuuaaaaaaaauacauuuuuauuuuuuauagagauaggguuuugccauguugcccaggcuggucucaaacuccuggguucaagcgaucagugugucuuggccucccaaaguucugggauuacaggcaugagccaccacgccuagcucugucccgcuucuugcuaucacgagggaggcuguuggguggaccaccgggcugugugcuagcaggcucugggacuagggucccagcacacucccauucucucaccucucuggaccuuacuuucuccauccuuaaguaacaggcagugccaucccauaaaacucucggcagugggggaaguguucuguguccacgcuaauauaguagccaguagcuacauguggcuguugagcucuugaaauguggcuagugcagccaaagcuaaaauuuuaauuuaacugaauuuuaauugauuaaguuuaaauagccacauguggcugcugcguuggguggcacaacucuaggucucuccuagcucugaaggcuuauggcacuuggcugaaucgugcagaauuccccaaagcuccaaagaccuucuuuuggcuagcaacagggcagagcccucagccuccagggaaagccugacuuaaccuaacuugugugggaggagaagaaaggaccacuugggcuugauacaggcuccagagguggaggagagacugagggcugggacccaaaugcagagaaugggaaaccuggcuacacaguaucccacgccccuccuucaguauucccuucaguauuuccaugcccuuccgcggaacugaauggcccaggucagaugagaggggaguccuuccaggcugugccaggacagcagggccacagccagagcaggcagggugguuggcagccccaccuggccgggaagccacugggugcccugccagggccaaccugcagcuucggguccaauggcucccguccucacgggcuauuggaucggugucuacuuaggaugguuucuccccuccucaggaaccacguagguugcaucuguccugggccucaaaagggacuucugcccugggacucugccugaggcccuggcagggaagccaacugccugucugcagggcagcccugguuccucuggcaccugggggucuggcccaggaggcacuuuguccuugggguuuuaggcucaacccuuugcaggucuggagcuguugcagccagcugcagugacucacuggggcgggaggguggggccgaggugugggcgagggugagcuggcccagcuagcucuuucccccucgcuggcugcuggcacagcaccaggaugcuggggugagcaaaggggcccugcuccaggaggaggacaggggugucugggcgaucugaaggaguggcuucaguucugucugagagaugaagucuggaaucuguuuuccuucccugccucugccuggcugcuuuucugcagggcuggcuccugagcacuggacagugggagagaaugugccauuuaagccccagcuuugcuguuucuugcugggaagggucagagugauuuccugucgcagccuucucugcagccggaagggaggagguguuuucgccaguuugcaccugagcccagaggcucagagucuuugcucaccuuguagccagcaccuguguugacaaggagacacauuguccacaccgcguugucaaacaggaggauggcugucgggggcuggggucuguguuucucuuucauccguguugugaucugccugagauaggaacugcuaagugcccacgaauucccaagagacauagucucauccucagaggucaccuguagcaccuucaagaccccauguauauuucauuuccccuagaaggcucccaagccuucuggaauauucugcggcaaaaucggucacagcuagugcacuuugcucaucauauguaucugugacaggaacugagucuuaaaucucccugucuggcacaugggugcgugagugaugugaggucaccgucuaacgcagcguguaauuaggugcugggcccagcuguguccaucccuggcugguuccgucuguagugcaaaguauaguguugggcauauggaggcagccgguauacaugcauugauugacuguugauacuuuccggauguaaacggcuguaggcggggcuuuggcuuagguuccccaugacuuauagugucccccacaccauuucaauugguggcugcugccgccauuuugugcuguggcuguaguccguggcccuaugcagaguccugccuggugucuuucuagggcaccugcagaugacagcucaccuuguggcuggagggcgaauuuauuacuaaaugcuugcaccuauaagggccuggcucagggccugguguggcagccgggaggccugaacucacugugggccaaggugggcucagcugggcucuaaccucuggggcuugggcggugccugguggggccggggccuccuuuguucaggcagcugccuguggcagggcucccagagcugccagcuggugaggcaccccccugguccuggguacugggugagacuggguggcccaagucucugucucugagggagguggaacacugacauuccugcuuggaggcagacucugaggaggcucccaccuguuacaagcagcagaccugggguggaguaggcaaaagacuuacagacucggucggccgggugcgguggucacgcccguaaucccagcacuuugggaggccaaggcggguggaucacagggucaggaguucaagacaagccuggcuaagauggugaaaccccaucucuacuaaaaauacaaaaaauuagccgggcaugguggcgggcgccuguaaucccagcuacucgggaggcugaggcaggagaauugcuugaaccugggagggggagguugcagugagcugagaucgugccauugcacaccagccugggcuacaaagugagauuccgucucaaaaaaaaaaaaaaggaguuacagacucggguccaagcccagcauaguugugcucucauguguaccccggguaagcuguucucucagagacucagucucugucugugaaauuggcacaguaacaucucccucuugaagcugugguugagaauguggguagaugcugggcgugguggcuccugcuuauagucccagcacuuugggauuguuugagcccaggaguuccggaccagccugggcaacauggcaaaaccccaucucuccaaaaauacaaaaauuagccaguuguggaggcacguggcugugguccgagcuacuugggugggugaggcaggaggaucacuugagcccaggaggucgaggcugcagugagucgugauugcgccccugcacuccagccugugugacagagccagacccugucucaaaaaaauaaaaagaggccaggugcgguggcucacgccuguaaucccagcacuuugggaggccgaggcgggcggaucaugcggucaggagaucgagaucauccuggcuaacacagugaaaccccaucucuacuaaaaauacaaaaaauuagccggguguggugcaugguggcgggcgccuguagucccagcuacucgggaggcugaggcaggagacuggcgugaacccgggagguggagcuugcagcgagccgagauccgcuauugcacuccagccugggcaacagaacgagacucugucucaaaaaaaaaaaaauaaauaaaauaaauaaaauacauaaauaaaaagaauguggcaagagugugcaugugaagcggcuccugccggccagugcucuauuuuuucuccuuuauugccuccauuuucacagaugaggaaauggagguucagaaaacugaagugucuuggccagggucccacagcuagaaggaggcagagccaggaucugacugcaagucuggcuccucugaagccccuuucugcuaugccgggcuggagagucauggacgaguggaauugacggcgguggugggggucggguucugagcuggccuggguagcagaggaccuggcuaucccuuggguagagacuuggagcaagcagacugccgaccggagugcgagcaucaucgugaacuuuucccuagguugugaccgagauucccgacgagagagacugaggggaagagaggaaggaggggcgggcuccuggcaaggcauucgcuccugagcggaauccugcaaaggucaguaggugggagaggcagagagaggcggaggugacgggauguggggagggugggcccuguguggaugggaggcuggggccgugggggacagggaugaagggccagcuaccuccggguccaguugccucugcugucuccuuuccaucuucuuugcugugccuugggagaacuuccacaguggaaggacgugagacgaauuaccccacccccaacaccucaccuggcaggugagccagcugcaggggcaggugcauugcugagggccccacucccuggaguucacagcgccagagauugcuagcuuucccaugcccucauguccucccacccccacugaccccaguuccauuuccucaccucauuccagauggagaaggaggagacaacccgggagcugcugcugcccaacuggcaggguaguggcucccacgggcugaccaucgcccagagggacgacggcgucuuugugcaggaggugacgcagaacuccccugcggcccgcacugggguggucaaggagggugagucaccccaggguguggacugggugcuggugguuggggggucgguggggguguuggagggaagggcagggagcaggcagaagugggugaguggcugucgagggcccauucccaguggcaucagggugguugguacccaagcccugcccucccuuggccacucugugucugucacuugugguccucaggggaggcagcugugugggguaguggacaccugguccucagaucugacuccaccacccacuagcucugcagauuugggcaaaugaguuggccuuuuuuuuuuuuuuuagauggaguuuuguucuuguugcccaggcuggagugcaauggcgcuaucucagcucacugcaaccuccgccuccuggguucaagcgauucuuaugccucagcuuccaggguagcugggauuacaggcaugcaccaccacaccagacuaauuuugcauuuuuaguagagacgggguuuuucuauguuggucaggcuggucucgaacuccugaccucaggcgauccaccugccucggucucccaaagugcugagauuacaggugugagccacugcaccuggcccccacaaauuggccuuucuaagccucaguuuccgugucuguacaauggguauuaccaugcccaccuugcaggguggucaugaguucaagucaguucagugcccagugugugguggcugugugcgguuucccugaggcucuuugggccuuaccugcuuccugcucuucccugcucaggggaccagauugugggugccaccaucuacuuugacaaccugcagucgggugaggugacccagcugcugaacaccauggggcaccacacggugggccugaagcugcaccgcaagggggaccgcucucccgagccuggccagaccuggacccgugaagucuucagcuccugcagcucugaagugguucuggugaguaccucgccggcccaucugugcccugagcucccccggccaugccggccugcugaccccacuccugagccuuccaugugccuccggacccucucuuuuugcuccuucuucuccucucaccugucuucacucucuugagcccuuggccacccuguuucuuuccgcuuucgugugacauguggcugugcucccucuaaaugucuucaaucagucucuucagagcggccacaguaugggaacugacuugugcagcccggcccuagaugcuaggaggaaggucagcugcuuugcaagaaucuuugaaaugacuucacaggugcccagcuccaccucacagacaccauuuuucucucugcagaggccugauacauucugugggucagacgcugggcagcaaagugccuguggggacauugguccuucugauggcuuguuuauuuaacaaauaauggguccucaaagugagacuguuaacccaagcacaaccagucucuuaggcucaacgagugcuuucaggguccaagggccucugagaagauuccccuccugauuaaacaaacaagccaguggcuugagaguugggagcugaagggccuggucucuugggaggugucccuggcacaggcugauuugaaucucuaacugaauggaaauccucccaguccaagaguauaccucccacucccuccccacgguuuuugcuuagcgguaugaccuccagagaauuucugauuuccuccugugauguggcugucagccccuuucuucacuccccugugcugugccccaggaggcuccauggaccucuguuuuggucccagcuucucugggaaacaggcaacguguugucggcugggcuguggccgggcaucugcuaacucaggcagacucugcugcaaccucugcccggcgugucuuucugcagagcggggaugaugaggaguaccagcgcaucuacaccacgaagaucaagccacggcugaagucggaagauggaguggaaggagaccucggggagacccagagccguaccaucacagugaccagaagggucacggccuacacuguggaugugacuggccgggaaggagccaaggacauagacaucaguagcccugaauucaagaucaagauuccaagacaugaacugacugaaaucuccaauguggauguggagacccagucugggaagaccgugaucagacugcccucgggcucgggggcagccucuccgacaggcucugcuguggauauccgagcaggggccauuucugcuucaggaccagagcuccaaggugcuggccacucgaagcuccaggucaccaugccugggauaaaggugggaggcucaggugucaaugucaaugcaaagggcuuggacuuggguggcagaggagggguccaaguuccagcaguggacauuucaucuucucuuggggguagggcaguagagguacagggcccaucucuggagaguggugaucauggcaaaauuaaauuucccaccaugaaagugccgaaauuuggugucucaacagggcgugagggccagacaccaaaggcagggcugaggguuucugcaccugaagucucuguggggcacaagggcggcaagccaggcuugacuauccaagccccucagcuggaagucagugugcccucugccaauauugagggccuugaggggaagcugaagggcccccaaaucacugggccaucacuugagggugaccuaggccugaaaggugccaagccacaggggcacauugggguggaugccucugcuccccaaauuggggguagcaucacuggccccaguguggaaguucaggccccugacauugauguucaggggccugggagcaaacugaaugugcccaagaugaaaguccccaaguucucuguaucaggugcaaagggagaggaaacugggauugaugugacacugccuacaggugaagugacuguuccuggggucucuggggaugucagccugccugagauugcuacuggugggcuggaaggaaagaugaaagguacuaaagugaagacuccugaaaugauuauucagaaaccuaaaaucuccaugcaggauguggaucugagccuugggucuccuaaacugaaaggagauauuaagguuucugcuccuggggugcaaggugauguuaaaggcccucaaguggcacuuaaaggcuccagaguggacauagagacaccaaaccuagagggaaccuugacaggcccuaggcuuggcaguccuuccgggaaaaccggaaccuguaggaucucuaugucagaaguagacuuaaauguggccgcaccuaaagugaaaggggguguagaugucacacuccccagaguagaagggaaagucaaagucccugaaguugaugucagaggccccaaaguggaugucagugccccagaugucgaagcgcauggcccagaauggaaccugaaaaugcccaagaugaaaaugcccacguucagcacuccaggagccaaaggggaagguccagauguucauaugacucuacccaaaggagauaucaguauuucagggcccaaggucaauguggaagccccagaugucaacuuggagggucuggggggaaaacuuaaaggccccgauguuaagcugccugauaugagugucaagacaccaaagaucuccaugccugauguagauuugcacgugaaagguacaaaggugaagggagaguaugauguaacuguaccaaagcuggaaggagaacucaaaggcccaaaaguggacauugaugccccagauguggauguucauggcccagacuggcacuugaagaugcccaagaugaaaaugcccaaauucagugugccaggguucaaagcagagggcccagaaguggaugugaaccugcccaaggcugauguggacauuuccgggcccaagauagauguuacugcuccugaugugagcauugaggaaccagaagggaaauugaaagggcccaaguuuaagaugccugagaugaacaucaaaguccccaagaucuccaugccugauguggacuuacaucugaaaggcccuaacguaaagggagaauaugaugucacaaugccaaagguugaaagugagauuaaaguuccugauguugaacuuaaaagugccaaaauggacauugaugucccagauguggagguucaaggcccagacuggcaccugaagaugcccaagaugaaaaugcccaaguucagcaugccuggcuucaaagcagagggcccagaaguggaugugaaccugcccaaggcugauguggacaucucaggacccaagguggguguugaaguuccagaugugaauauugaaggaccugaaggaaagcugaagggccccaaguucaagaugccagagaugaauaucaaggcccccaagaucuccaugccugauguggacuugcauaugaaagguccuaaaguaaagggagaauaugauaugacagugccaaagcuggaaggggaccugaaaggcccaaaaguagaugucagugccccagauguugaaaugcaggguccugacuggaacuugaagaugccaaagauuaaaaugcccaaauuuagcaugcccagccucaaaggagaggggccagaauuugaugugaaccuguccaaagcgaauguggacauuucugcaccaaaaguagauacuaaugcuccagaucugagccuugaaggaccugaagggaaguugaaaggcccgaaguuuaagaugccugagaugcacuucagagcuccuaagaugucuuugccagauguugaccuggaucuuaaaggacccaaaaugaaaggaaauguagauaucucugcaccaaagauagagggugaaaugcagguuccagauguggacaucagaggucccaagguagauauuaaagcaccagauguggaaggccaaggccuggacuggagccugaaaauacccaagaugaaaaugcccaaguucagcaugcccagccucaaaggcgagggcccagaaguggaugugaacuugccuaaggcugacguuguugucucaggacccaagguggacaucgaagccccagaugugagccucgaagguccagaagggaagcugaagggucccaaguuuaagaugccugagaugcauuucaagacccccaagaucuccaugccugauguggacuuacacuugaaaggccccaaagucaaaggggauguggaugugucugugcccaagguagaaggugaaaugaaagugccagauguugaaaucaaaggacccaaaauggacauugaugccccagauguggagguucaaggcccagacuggcaccugaagaugcccaagaugaaaaugcccaaguuuagcaugccuggcuucaaaggagagggccgagaaguggaugugaaccugcccaaggcugacauugaugucucaggacccaagguggauguugaagucccagaugugagccuugagggcccggaaggaaagcugaagggccccaaguuuaagaugccugagaugcacuucaaggcccccaagaucuccaugccugauguggaccugaaucuuaaggggccaaaauugaagggagauguggauguguccuugccugagguagaaggugaaaugaaagugccagauguugacauuaaagggcccaaaguugacauuagugcuccagauguggauguucauggcccagauuggcaccugaagaugcccaaggugaaaaugcccaaguucagcaugcccggcuucaaaggagagggcccugaaguggaugugaagcugcccaaagcugacguugaugucucaggacccaaaauggaugcugaaguuccagaugugaauauugaagguccagacgcaaaacuaaaaggucccaaauucaagaugccagaaaugaguauaaagccucagaagauauccauaccagauguugguuugcauuugaaagguccuaaaaugaaaggagauuaugauguaacaguuccaaaaguagaaggagagauaaaagcuccugauguugacaucaaaggccccaaaguugauauuaaugcaccagauguggagguucauggcccagacuggcaccugaagaugcccaagguaaaaaugcccaaguucagcaugccuggcuuuaaaggagagggcccagagguggauaugaaccugcccaaggcugaccuugguguuucaggacccaagguggacauugauguuccagaugugaaucuugaagcuccagaggggaaacuaaaaggcccuaaguucaagaugccaagcaugaauauacagacgcacaaaaucucuaugccugauguuggacuuaauuugaaagccccuaaacugaaaacugauguagauguuucccuucccaaaguggaaggagacuugaaggguccugaaauugaugugaaagccccuaagauggaugugaauguuggugauauugauauugaagguccagaagggaaguugaagggccccaaguuuaagaugccugagaugcauuucaaggcccccaagaucuccaugcccgauguggacuuacacuugaaaggccccaaagucaaaggggauauggaugugucugugcccaagguagaaggugaaaugaaagugccagauguugacauuaaagggcccaaaguggacauugaugccccagauguggagguucacgacccagauuggcaccugaaaaugcccaagaugaaaaugcccaaguucaguaugccuggcuucaaagcagagggcccugaaguggaugugaaucugccaaaggcugacauugaugugucuggacccaguguggacacugaugcuccugauuuggauauugagggaccagaaggaaaguugaaaggcuccaaauuuaagaugcccaaguugaauauaaaagcucccaaggucuccaugccagauguggacuugaauuugaagggacccaaacugaagggagagauagaugcuucugugccagaacuggaaggugaucucagagggccgcaaguugaugucaaagguccuuuuguggaagcggaggugcccgauguugaucuggaguguccugaugcaaaguugaaagggcccaaguuuaagaugccugagaugcacuucaaggcccccaagaucuccaugccugauguggacuuacaccugaaaggccccaaagucaaaggggaugcggaugugucggugccaaaauuggagggagauuuaacaggccccaguguggguguggaggugccugauguugagcuggaguguccugaugcaaaguugaaaggcccuaaauuuaagaugccagacaugcacuucaaggcccccaagaucuccaugccugauguggacuuacacuugaaaggccccaaagucaaaggggauguggaugugucggugccaaaauuggagggagauuuaacaggucccaguguggguguggaggugccugauguugagcuggaguguccugaugcaaaguugaaagggcccaaguuuaagaugccugagaugcacuucaagacccccaagaucuccaugccugauguggacuuacaccugaaaggccccaaagucaaaggggauauggaugugucugugcccaagguagaaggugaaaugaaagugccagauguugacaucaaaggacccaaaauggacauugaugccccagauguggauguucauggcccagacuggcaccugaagaugcccaagaugaaaaugcccaaguucagcaugccuggcuucaaagcagagggcccagaaguggaugugaacuugcccaaggcugauguuguugucucaggacccaagguggauguugaagucccagaugugagccuugaagguccagaagggaagcugaagggccccaagcuuaagaugccugagaugcacuucaaggcccccaagaucuccaugccugauguggacuuacacuugaaaggccccaaagucaaaggggauguggaugugucuuugccaaaauuggagggagauuuaacaggccccaguguggauguggaggugccugauguugagcuggaguguccugaugcaaaguugaaagggcccaaguuuaagaugccugagaugcacuucaagacccccaagaucuccaugccugaugugaacuuaaacuugaaaggccccaaagucaaaggggauauggaugugucuguucccaagguagaaggugaaaugaaagugccagauguugacaucagagggcccaaaguggacauugaugccccagauguggauguucauggcccagacuggcaccugaagaugccuaagaugaaaaugcccaaguucagcaugccuggcuucaaaggagagggcccagaaguggaugugaacuugcccaaggcugacguugaugucucaggacccaagguggauguugaagucccagaugugagccuugaagguccagaagggaagcugaagggccccaaguuuaagaugccugagaugcacuucaagacccccaagaucuccaugccugauguugauuucaauuuaaagggacccaaaaucaaaggagauguugauguuucugccccaaagcuggagggagaguuaaaagguccagaauuggaugucaaaggucccaaauuagaugcugacaugccagaaguagcuguggaaggcccaaauggcaaguggaaaacuccuaaguucaagaugccagauaugcacuuuaaagcucccaaaaucucuaugccagaccucgaucuacacuugaagagccccaaggcaaaaggagagguggauguagauguucccaaauuggaaggggaccuuaaagggccacauguggaugucagugggccagacauugacauugagggaccagagggcaaauugaaaggcccuaaguucaagaugccugauaugcauuucaaagcccccaauauuucuaugccugauguugaucuaaaucucaaaggacccaaaaucaagggggauguggaugugucugugccugagguagaagguaaacuugaaguaccagauaugaacaucaggggccccaaaguugauguaaaugcccccgauguccaagcuccagacuggcaccugaagaugcccaagaugaaaaugcccaaguucagcaugccuggcuucaaagcagagggcccugaaguagacgucaacuugccuaaggcugacguugacaucucaggacccaagguggacauugaaggcccugauguuaauauugaaggaccagagggaaaguugaaagggccuaaguuaaagaugccagagaugaacaucaaagcccccaagaucuccaugccugacuuugauuugcaucugaaaggucccaaggugaagggcgauguggauguuucucugcccaaaguggaaggugaccucaagggccccgaaguugacaucaaggggcccaaaguggauauuaaugccccagauguggguguucaaggcccagacuggcaccugaagaugcccaaggugaaaaugccaaaguucagcaugccuggcuucaaaggagagggcccagauggggaugugaagcugcccaaggcugacauugaugucucaggacccaaaguggacauugaaggcccugauguuaacauugaaggaccagagggaaaguugaaagggccuaaguucaagaugccagagaugaauaucaaagcccccaagaucuccaugccugauauugacuuaaaccugaaaggacccaaagugaagggugauguggauguuucccuuccuaaaguggaaggugaccucaagggcccagaaguugacaucaagggcccaaaaguggacauugacgcaccugauguugauguucauggcccagacuggcaccuaaagaugcccaagauaaaaaugcccaagaucagcaugccuggcuucaaaggagaagguccagauguggacgugaaccugcccaaggcugacauugaugucucaggaccgaaaguggauguugaaugucccgaugugaauaucgaaggaccugaaggaaaguggaaaaguccaaaguuuaagaugccagagaugcauuuuaagacuccaaagauauccaugccagauauugaccugaaucucacagguccaaaaauaaaaggagauguggauguuacaggcccuaagguagagggagaucugaaagguccugaaguugaccucaaaggccccaaaguggacauugaugucccagauguuaauguucaggguccagacuggcaccugaagaugcccaagaugaaaaugcccaaguucagcaugccuggcuucaaagcagagggcccugaaguggaugugaaccugcccaaggcugacguugaugucucaggccccaaaguggacguugaaggcccugauguuaacauugaaggaccagagggaaaguugaaagggcccaaguucaagaugccagagaugaauaucaaagcccccaagauccccaugccugacuuugauuugcaucugaaaggucccaaggugaagggcgauguggauauuucucugcccaaaguggaaggugaccucaagggcccugaaguugacaucagggguccccaaguggacauugaugucccggaugugggcguucaaggcccagacuggcaccuaaaaaugcccaaagugaaaaugcccaaauucagcaugccuggcuucaaaggagagggcccagauguggaugugaaccugcccaaggcugaccuugaugucucaggacccaagguggacauugauguuccagaugugaauaucgaaggcccagagggaaaguugaaaggucccaaauucaaaaugccugagaugaacaucaaagcccccaagaucuccaugccugacauugaucuuaaccugaaaggucccaaagugaagggugacauggaugugucucugccaaaaguggaaggugacaugaaaguuccugacguggauauuaaaggccccaaaguggauauuaaugccccagauguggauguucaaggcccagacuggcaccugaagaugccuaaaauaaaaaugcccaagaucagcaugccuggcuucaaaggagaagguccagaaguggacgugaaccugcccaaggcugaccuugacgucucaggacccaagguggacguugauguuccagaugugaauauugaagguccagaugcgaaacugaagggcccuaaauucaagaugccagagaugaacaucaaagcuccuaaaauaucaaugccugauuuggaccucaaucuuaaaggcccuaaaaugaaaggagagguggauguuucacuugcaaauguagaaggugauuugaaaggaccugcucuugacauaaaaggcccaaagauagauguagaugcuccagauauugacauucauggcccagaugccaaauuaaaagguccaaaacugaagaugccugacaugcauguaaacaugcccaagaucuccaugccagaaauugacuugaauuugaaaggcucaaagcuuaagggagauguugaugucucugggcccaaguuggaaggugacauuaaagcucccaguuuggauauaaagggcccagaaguggacguuuccgguccuaagcuuaauaucgaaggcaagucaaagaaaucucguuuuaagcuucccaaauuuaauuuuucgggcucuaaaguucagacaccugaaguggaugucaaagguaaaaagccagauauugacauaacagguccaaaaguugauauuaaugcuccugaugucgagguccaaggaaaagugaaaggauccaaguuuaaaaugccuuuccugaguauuucaucucccaaaguuucuaugccugacguggagcuaaauuugaaaagucccaaagucaaaggagacuuagauauugcaggucccaauuuagaaggugacuuuaaaggccccaaaguggauauuaaggcaccagaagucaaucuuaaugcaccugauguggauguucaugguccagacuggaaucugaaaaugcccaagaugaaaaugcccaaauucagugugucuggcuuaaaagcagaagggccagauguagcuguggaucuaccaaaaggagacaucaacauagagggcccaaguaugaacauugagggcccagaucucaauguggaagguccggagggaggcuugaaaggucccaaauucaagaugccugacaugaauaucaaagcucccaagaucuccaugccugacauugacuuaaacuugaaaggccccaaggugaaaggugauguggauauuucucuucccaaacuugaaggggaucugaaagggccagagguugauaucaaaggcccuaaaguggacaucaaugccccagauguggauguucaugguccagacuggcaucugaagaugcccaaagugaaaaugcccaaguucagcaugccuggcuucaaaggagaaggcccugaagucgauguuacccucccuaaagcugacauugacauuucuggucccaauguagacguugauguuccagacgugaauauugaagguccagaugcaaagcugaagggccccaaguucaagaugccugagaugaacaucaaagcccccaagaucuccaugccugacuuugaccugaacuugaagggacccaaaaugaagggugaugugguugugucuuugcccaaaguggaaggugaucuaaaaggcccugagguggacaucaagggccccaaaguggacauugacacuccugacauuaacaucgaaggcucagaggguaaauucaagggacccaaauuuaagauaccagagaugcaccugaaggcucccaaaauaucgaugccugacauugauuuaaaccugaagggccccaaagucaagggcgauguggauguuucucugcccaaaauggaaggugaccucaaggguccugaaguugacaucaagggccccaaaguggacauuaaugcuccagauguugauguucaaggcccagacuggcaccugaagaugcccaaggugaaaaugcccaaguucagcaugccuggcuucaaaggagagggcccagauguggaugugaaccugcccaaggcugaccuugaugucucaggacccaagguggacauugauguuccagaugugaauaucgaaggcccagagggaaaguugaaaggucccaaauucaagaugccugagaugaacaucaaagcccccaagaucuccaugccugacauugaucuuaaccugaaaggacccaaagugaagggugauauggaugugucucugccaaaaguggaaggugacaugcaaguuccugacuuggauauuaaaggccccaaaguggauauuaaugccccagauguggauguucgaggcccagacuggcaccugaagaugccuaagauaaaaaugcccaagaucagcaugccuggcuucaaaggagaagguccagaaguggaugugaaccugcccaaggcugaccuugacgucucaggacccaagguggacguugauguuccagaugugaauauugaagguccagaugcgaaacugaagggcccuaaauucaagaugccagagaugaacaucaaagcccccaagaucuccaugccugacuuugauuugcaucugaaaggcccuaaggugaaaggagauguggauguuucucugccuaagauggaaggugaucuaaaggccccugaaguugacaucaagggccccaaaguggacauugaugccccagauguggauguucauggcccagacuggcaccugaagaugcccaaggugaaaaugcccaaauucagcaugccaggauuuaaaggagagggcccagaaguggauguuaauuugcccaaagcugacauugaugucucaggacccaaaguggacauugacacuccugauauugauauucaugguccagaagggaaacugaagggccccaaauuuaaaaugccugaccugcaccucaaggcaccgaagaucucuaugccugaaguugaccugaaucugaaagguccaaagaugaagggcgacguggacguuucucugcccaaaguggaaggcgaccucaagggcccugaaguugacaucaagggccccaaaguggacauugaugucccagauguggacguucaaggcccagacuggcacuuaaaaaugcccaaagugaaaaugcccaaguucagcaugccuggcuucaaaggagagggcccagauguggaugugaaccugcccaaggcugaccuugacgucucaggacccaagguggacauugauguuccugaugugaauaucgaagguccagaugcgaaacuaaagggcccuaaauucaagaugccugagaugaacaucaaagcccccaagaucuccaugccugacuuugauuugcaucugaaaggucccaaggugaagggugauguggauguuucccuuccuaaaguggaaggugaccucaagggcccagaaguugacaucaagggccccaaaguggacaucgaugccccugauguagauguucauggcccagacuggcaccugaagaugcccaaggugaaaaugcccaaauucagcaugccaggauucaaaggagagggcccagauguggauguuacccuuccuaaggcugacauugagauuucuggccccaaaguggacauugaugccccugaugucaguaucgaagguccagaugcaaaacucaaggguccaaaguucaagaugccagagaugaacaucaaggcccccaaaaucuccaugccugacauugacuuuaacuugaagggucccaaagugaaaggugauguggaugucucucugcccaaaguggaaggugaucucaagggcccugaaauugacauaaaaggccccaguuuggacauugacacaccugaugucaauauugaagguccggaaggaaaauugaaggggcccaaauuuaagaugccugagaugaacaucaaagcucccaaaaucucuaugccugacuuugauuugcaccugaaaggucccaaggugaagggugauguggauguuucacuaccuaagguggaaagugaucugaaagggccagagguagacauugaagguccugaagggaagcucaaaggucccaaguuuaagaugccugauguacauuucaaaagcccacaaaucuccaugagugacauugauuugaauuugaaaggaccuaagauaaaaggagauauggacauuuccguuccuaaacuggagggagaucugaaaggucccaaaguggaugucaaaggcccuaaagugggcauugacacuccugauauugacauucaugguccagaagggaaacugaagggccccaaauuuaaaaugccugacuuacaccucaaggcaccgaagaucucuaugccugaaguugaccugaaucugaaagguccaaaggugaagggcgacauggacauuucucugcccaaaguggaaggcgaccucaagggccccgaaguugacaucagggaccccaaaguggacauugaugucccagauguggacguucaaggcccagacuggcaccuaaaaaugcccaaagugaaaaugcccaaguucagcaugccuggcuucaaaggagagggcccagauguggaugugaaccugcccaaggcugacauugaugucucaggacccaaaguggacguugauguuccugaugugaauaucgaagguccagaugcgaaacuaaagggccccaaguucaagaugccugagaugagcaucaaagcccccaagaucuccaugccugauauugacuuaaaccugaaaggacccaaagugaagggcgauguggauguuacccuuccuaaaguggaaggugaccucaagggcccagaagcugacaucaagggcccaaaaguggacaucaacaccccugauguggauguucauggcccagacuggcaccugaagaugcccaaggugaaaaugcccaaauucagcaugccuggcuucaaaggagaagguccagauguggaugugagccugcccaaggccgacaucgaugucucgggacccaagguggacguugauauuccagaugugaauaucgaagguccagacgcaaaacugaagggccccaaguucaagaugccugaaauaaauaucaaagcucccaagaucuccauaccugauguugaccuggauuugaaaggacccaaaguaaaaggagauuuugaugugucugucccuaagguugaagggacuuugaaaggcccagaaguagaucuuaaagguccacgucuggauuucgaaggcccugaugccaaacucaguggcccaucuuugaagaugccaucgcuggagauaucugcuccuaaaguaacugcuccugauguugauuugcaucucaaggcaccaaaaauuggauuuucagguccgaaguuagaagguggugaaguggaccucaagggacccaaaguugaagcuccaagcuuagauguacacauggacagcccagauauuaacaucgaagggccagauguuaaaauccccaaauuuaagaaacccaaguuuggauuuggggcaaaaagccccaaagcugacaucaagucaccuucacuggaugucacuguuccugaggcagagcugaaccuugagacuccugaaauuaguguugguggcaagggcaagaaaaguaaguuuaaaaugccuaaaauucauaugagugguccuaagauuaaggccaaaaaacagggauuugaccugaauguuccugggggugaaauugaugccagccucaaggcuccggauguagaugucaacaucgcagggccggaugcugcacucaaagucgacgugaaaucgcccaaaaccaagaaaacgauguuuggaaaaauguacuucccagauguagaguuugacauuaaaucaccuaaauuuaaagcugaggccccucucccuagccccaaacuggagggugaacuccaggcaccugaucuggaacuuucuuugccagcgauucacgucgaaggucuugacaucaaggcgaaggcucccaaggucaagaugccagauguggacaucucagugccaaaaauagagggugaccugaaaggccccaaagugcaggcaaacuugggugcaccugacaucaacaucgaaggccuagaugcuaaagucaaaacaccguccuucggcauuucugccccucaagucuccaucccugaugugaauguaaacuugaaaggaccaaagauaaagggugauguccccagcgugggacuggaaggaccagauguagaucugcaagguccagaagcaaaaauuaaguuccccaaguuuuccaugcccaagaucggcaucccaggugugaaaauggagggugggggagccgagguccaugcccagcuacccucucuugaaggagacuugagaggaccagauguuaagcucgaagggcccgauguuucucuaaaggggccaggaguagacuugccuucagugaaccucucuaugccaaaagucucugggccugaccuugaucugaacuugaaaggaccaaguuugaagggagaccuggaugcaucuguucccagcaugaaggugcaugcuccagggcucaaccucaguggugucgguggcaaaaugcaggugggaggagacggugugaaagugccagggaucgaugccacaacaaagcuuaacguuggggcaccagaugugacacugaggggaccaagccugcagggagaucuggcugucucuggugacaucaaaugcccuaaaguauccguaggagcuccugaucuaagcuuggaggcauccgaaggcagcauuaaacuucccaaaaugaagcugccccaauuuggcaucucuacuccgggguccgacuugcacgucaaugccaaggggccacagguuucuggcgaacugaaggggccagguguggaugugaaccugaaagggccucggauuucagcaccgaauguggacuuuaacuuggaaggaccaaaagugaaagggagccuuggggccacuggugagaucaaaggccccacugucggaggaggucuuccaggcauugguguucaaggccuagaaggaaaccuccagaugccuggaauuaaguccucuggaugugaugugaaccugccaggcgugaaugugaaacucccaacugggcagauuucugggccugaaaucaaagguggucugaaagguucagaaguagguuuccauggggcugcuccugauaucagugugaaggggccugccuuuaauauggcaucuccugagucagauuuuggcaucaacuugaagggcccaaaaaucaaaggaggugcggauguuucagggggugucagugccccagacaucagccuuggugaagggcauuugaguguuaaagguuccgggggugaguggaagggaccccaagucuccucugcucucaacuuggacacaucuaaguuugcugggggccuucauuucucaggaccaaagguggaaggaggugugaaaggaggucagauuggacuccaggcuccugggcugagugugucugggccucaaggucacuuggaaaguggaucuggaaaaguaacauucccuaaaaugaagauccccaaauuuaccuucucuggccgugagcugguuggcagagaaauggggguggauguucacuucccuaaagcagaggccagcauccaagcuggugcuggagacggcgagugggaagagucugaagucaaacugaaaaaguccaagaucaaaaugcccaaguuuaauuuuuccaaaccuaaagggaaagguggugucacuggcucaccagaagcaucaauuucuggguccaaaggugaccugaaaaguucaaaggccagccugggcucucuggaaggagaggcagaggccgaagccucuucaccgaaaggcaaauucuccuuauuuaaaaguaagaagccacggcaccgcucaaauucauucagugaugaaagagaguucucuggaccuuccaccccgacggggacgcuggaguuugaagguggggaagugucucuggaaggugggaaaguuaaagggaaacacgggaagcugaaauucgguaccuuugguggauuggggucaaagagcaaaggucauuaugaggugacugggagcgaugaugagacaggcaaguuacaggggaguggggugucccuggccucuaagaagucccgacuguccuccucuucuagcaaugacagugggaauaagguuggcauccagcuucccgagguggagcugucaguuuccacaaagaaagaguagcaggccuuuguauguguguacauauauauauauauaacaaaacaucagccuugggugguguguuccuauauaaacuccaaagggaaacacaccgacugccucagcaaucaugcaaagaccuugccuggcccgguggcaagcgcugaaaaaccgaccgccuguaggcuccuggaacuauacagauagguaaagaguuccaaguucguccagcccaugugcaaagucaacaguauuugccuuaagauuucauauauauauauuuuuuugcauugacugcugagagcuccuguuuacuaagcaagcuuuuguguuuauuauccucauuuuuacugaacauuguuaguuuugggguaauggaaacccacuuuuucauuguaaugacuuugggggcuuuuguuaguaaggguggguggggugauggguugcagacggaggucaggucuuccucuuuccugagacuggaucuguucaaacagcaaacgcccacagauggcccagagguggugguagucaggguguguggguguuuuuaggguucuuuaguguuguuucuuucacccaggggugguggucccagccaguuuggugcugacggugagaggaaauuagaaucuguuugcaaauuguccaacccacccccucaacaugaggggcuuccauuuucuguguuuuguaagggaacuguuuccuucaugccgccauguuccugauauuaguucugauuucuuuuuaacaaauguuaucaugauuaagaaaauuuccagcacuuuaauggccaauuaacugagaauguaagaaaauugaugcuguacaaggcaaauaaagcuguuuauuaaccuugaugucuugugccuuugcauucuguguugcgggggcgugaaaccuggggaagcugcacagccagcugugaguguucagaccggauccaucugguggcauugcuaguuucaucagugacuuuaagacagugaccuucgggagguagugggagaaaaucuuugcuucuugauucucauggugaggcugguugugccauugcugagaaaucaagaagaggcuuggccucgggacccacucaccuacuuugcauccucacauaugaauauacaauucagaauugguucuaaauggguuacagaugugaacaguuaaaaggccuccuggaauuaccgaaagggcucugcuugugaaucaccgcucugccauuuauuccugacauggcugcagguuugcugaguaaccgcuguugcccaggcuggagugcaguggcacaaucuuggcucacugcaaccuccuccuccuggguucaagcgauuuuccugccucagccucccgaguagcugggauuacaggcccuugccucuacgccuggcuaauuuuuauauuuaguagagacgaaguuucaccauguuggccaggcuggucucaaacuccugaccuccagugauccacccgccuuggccucccaaaguacugggauuacaggcaugagccacugcgcccggccagggugcugaucuuguguaaguuaucucugugguucuuucuaguccauuuuagggcuaaacauuauggaaaagucuucugaccaaaguccccuuuugauuuccagcucuguugacaguaugugggggugggggaggagugguucuagucacuggcuccuaauguuggucauugcugggcagagggugaugcuuucuuauacuuggaccaagcuugucccccucgccauuccuuagagaugccccauuucugccaguggaggcagcucugcaccucucuggauccccccagaacagagauaaaauagcucccaccccauccuucccuguuuaguaccagcuugucagugggaucucaugccuucccuagcuucaucuguccucaccguggccagcagagccaguguucuggggguuuuggagcucaaggguggcccauggauuuggaaagagauagguugggagggaggcccuugauacccggcugcguuuuagaugaccgaccuacagcuucuuucgugaguuggacaggaugcuuaaccugcuugaggcucaguuucaucacccuuaaaauugggauagcagcauucauagggccagaguucguccagguauugggguuaugcauugcaugauggcaccacacugaagugugcagcauccaugugacagccagauacauacuuauggagagcacaagaguuggcaugaaauccuagagagacaggcaugagcccaucuucuacagaaacccccugcugcacugggcuacacgcacacuccagccgugagcaugcucagguucaaugaugcacacaacugcacacaucaccgucuguccuaacugggccuggggcuguccccggggugcugcuuucacucaaccaaccacagcucaaaacccaucuccuguuccuuccucaacucugaagccaagaguguggggcaggucagagugugcaugccgcuugagauaaguagcccuggugucuggagggugggguaagugggugacgguggggugagugugcgacaguggggugcacuuguguacacagcuagggaggaaugcccauuaggaugcuggaaaguccucugaggagaacuacccaggcuguccaauaauauaucaauuaaauuuuuuuuuaacuuuaggaagaagugaugaaggcuagugguggcccccaguguccauucaauaaauguuuucugagucccacguggcuagaugugucccagucccacugaucucagauuccucuucugaggaucuccacagagugaaugaugugaugggugugaaaaacuggaaugccuugagcccuggcaauaaacccguggaaaucaugcauguaccagggauggcgaggccagugaucucauugggugggacagucagugggugguggguaggauggagaagggacaaggcaacuagcuguacaaacuugagagucuucuagccaccuucuucucaaugucaggucugggcuggaggcaguggccacagaacaugaacgcugcuucccgcagugaugguuaccacagcagcgacggcaugggaggagacacgggcuuaugugguguguggagggcgcaccccagcucccucgcccugcccaugcaccuuaccccugcccucccucaguuccugauggggugguccaaguuauccccuaaagucuuuuuuuuuuuuuauuuuugagacagagucucgcucuuguugcccaggcuggagugcaauggugugaauuuggcucacugcaaacuccgccucccggguucaagagauucuucugccucagccuccugaguagcugggauuaaaggcgccugccaccauaccuggcuaauuuuuguauuuuuaguagagaugggguuuugccauguuggccaugcuggucucgaacuccugaccucgugaucugccuaccuuggucucccaaaguguugggauuacaggcgugagccauggcgcccggccuauccccuaaagucuugcaggaaccagccuugcaaggucugacacucuaagguccugguuccugcacucgagggugagagcagcgucaggagacugggaaggggcuggacucugugauguucuuucccagaguucagcaaggagcaauugcaaggacugcagucucaaggucagccucgcuuuaggcagugugacuguguguggacagugguguaguuaagggggcaucugggaaaacagaauuauuuugaauuacaccaugggcucacaaauggcagggaauagugaacaguuccuccuuuccuuccuuccucccucccucccuuccuuccuuccucccuugccuucuuccuucccuuccucccucccucccucccucccucccuuccuuccuucuuccuaacaggaucuugcucugucacccaggcuggagugcaguggcacguucucagcucauugcaaccuccaccucucaagcucaaccaccacaccgggcuaauuuuuguauuuuuuguagagacgggguuucaccauguugcccaggcuagucucaaacuccugagcucaaucaaucacucccuccuuggccucccaaagugcugggauuacaagcaugagccaccgcgcuuagcccagggaauaauuuucauaaacucacacucauuucucuaucugucagguucccucucgcaaacuuaguuccauuugaagauaguucaaucagagagaccuaauaaagagacaguuuauggaguagugggcaggggcaaaggaggccacaagggguggugagacccccaggggcaguaggaagcugguacuaucccuggcccugaaggauaugaggaagaagugguguuccugaaguccagcgugcacuggagguagaggaggaauccucaguggggacuauagccauagaggaccagcaucugccagaacugccugccgugugaagcagggaggaacacccugaccccucucuccacuggagggcacgggagcccagguguugcagcugauccaccuccuggggcacagagucgggcagagaagcaggagcaggggucugaagguggagggaacagauagagaauaaccaggacaaggccaggugcaguggcucacgccuguaauccuaacacguugggaggccgaggcagguggauugccugggcucgggaguuugagaccagccugggcaacauggugaaaucccaucucuacuaaaauacaaaauuagcugggcgugguggugcgcaccuguaaucccaguuacuugggaggcugaggcaggagaauugcuugaacccgggagguggagguugcagugaaccaagauugugccacggcacuccagccugggugacagagcaagacuccaucucagaaaagaaacaaacuagcccgguguggcacucgccuguagucccagcuacucaggaggcugaggcaggagaaucacuuaagccugcauuccagccuggcagacaaagcaagacucugucucucguuuuuucuguuugauaaguuugaauuuuuauacaucgagguuucuuaaacuagaauuuaagguaugaucauaaaguaaugcuacaguuuuuucuuaaagaagcacacauaugucccaauggcaauucugcuuucaguggucaccucgggaagcucuacacuuacuucuguaaaaaaucuacugcugggccggacgcgguggcucaugccuauaaucccagcacuuugggaggucgagguggguggaucacuugaggucaggaguuugagaccagccuggccaacauggcgauaccccgucucuacuaaaaaauauauaaaaauuagcuggacgugguggcacaugccuguaauuccagcuacucugguggcugaggcaggagaaucauuugaaccugggagacagaggcugcagugagcugagaucaugcuacugcaguccagccugggggacagagcgagacucgucucaaaacaaacaaacaagcaaaaaaaaaaaaacaaaaaacaagccugguuaauuagguggguggguuguuuggggucaaaagcaaggcgugauuaugugugugacuaacuuuccugugugguugggaaguugucucaaauguuuugagcaaaggcugcacuguugaaauauugcuaugucuccagcaccccaaagcaaaagugcaucacccaugaggacuuugcauguugcuuauauacauguccugcuucagagugccaccuuagcucuuugguauuuugcauuagcugugacauuaaaaaacauuaugugggagaugcagcuaauuguguaccugaaauuucuuuuuuuuuaaaguguauuuauuuugaaugcaaaucuaccgagaaguugcaagaauaauacaaugaauauucauauagcuuucaguuggauucaccaauugcuaacauuuacuuuguuugcuuuaaucucucucugucucucuacauauacauauauauauauaugguuuuuuuguuuguuuguuugggacagaaucucauucuguugcccaggcuggagugaaguggcauacucuuggcucaccacaaccuccaccuccugggcucaagcaauucuccugucucagccucccaaguagcugggauuacagguuugugccaucaugccugccuaauuuuuguauuuuuaguagagacaggguuucaccauguuagccaggcuggacucgaacuccugaccucagguaauccaccugccuuggccucccaaagugcugggauuacaggcaugagccaccgcaccuggcucauauagguguuaucauuacuuuugcugaaucauuugagaguaaauuacagacaucaugauccuuuacccauaaauacuucagcauguaugggcauucuuuuauauaacuccaauagagggcgggcgcaguggcucacgccuguaauuccagcacuuugggaggcugaggcggguggaucuugaggucaggaaguuccagaccagccuggccaacauagugaaaccccaucucuacuaaaaauacaaaaaauuagccgggugugguggcagcuacucaggaggcugaggcaggagaaucucuugaacccgggggagguggagguugcagugagcugagacugugccauugcacuccagccugggcgacagagugagacuccgucucaaacaaacaaacaaacaaacaaacaaacaaaacuccaauacaauaauuaaauucaggaaacaaaacauugacauauuaucuaauauguaguauaucuuuaaauuucaccaguugccccaguaacugucuuuacaguaaugucuuuuuuuguuuguuuugagucagagucuugcucugucugccagguuggaguguaguggugcgaucuuagcucacugcaaccuccaccuccuagguucaggcgauucuccugucuuagccuccugaguggcugggauuacuagcgcccgccaccacaccuggcuaauuuuuguauuuuuuaguagagacgggguuucgccauguuggccaggcuggucuugagcuccuggccucaagggaccugccugccucagccucccaaagugcugggauuugcgaccaugcccggcgacaaugucuuuuuuuccucuuugggguucaauuguugaugaccucacaugauguuuaguugucuuggucucuuucuuucuuucuuuuuuuuuugagacggaguuucacucuugucacccaggcuggagugcaauggugugaucucgacucacugcaaccucugccucccgaguucaagugauucuccugccucagccuccugaauagcugggauuacaggcaccugccaccacacccagcuaauuuuuuguauuuuuaguagagacagggcuggucucgaacuccugaccucaagugauccacccaccuuggccucccaaagugcuggaauuacaggcgugagccaccgugcccggcuguuuauuucuuuaaucuguaauaguuucucaguuuuuuuuuugucaugcauggcacugauauuuuugaagugugugggaccaguuuucuagaaaugucccucaaucuggguuugucugaugauauuuccucaugauuggguucagguuauacauuuuggggcaggaauuccacagaagugauauuggguccuuuuuggugccucgugucaggaggcacaugauggguauguuaauuucaauuccuugguuaaguaggagauugcuaaguuucuccauuguaacguugccaugacuccucauuggaauuaacaaggaaacccaaguuuucaagauaaaaguccaaguuugggcaaguuuaucucacaagcacacuuuaagggguugguggcaugcuuagccuuggcgugaucucgggcugggaguuuugaaaguggaguucuggcuuugagcuuugcagcacagagcagcucucugucuuuccucacgaggacaaagaauuccaugcaugaaugccugccacgggccgggaaugccaugugcuguuuaccagccucugaauugccccguggcgucaggcagccgcuggugcuuccuaaggcugaaggcgcccagcagaggcgcugccaugggccacagcaaauguguagggaacauucugcugaggagggcaguuucauuucccuuuaaaugccucuguuauuuuccaccacacgcuugaggcuuggcccuaauggaaaaacuucccaguaguggggccaaggaugggaaaggguuacgaaugaaaaggccuucucuuuggacagggcguucuaguccacagagugcuuuaucucuugagaucucacacugcguucucagcuccgcccaggcaagcaggcagcucuggcauuugcugacccuaucuuacaaaccagaaaggugaggcucggaaaagcgaagcgauuggucucaacucauagaguugggaagaggugacuuggccaaaaucgauccaagcuuucugauuaaaaaaagaauuuuuuuuuucuucccugugaugucacugccguuucccugaagaagcugggaauuucuuuucugggggaauuuuaggaaauagaggaugccucuugaaauuugcagggacuugaacucggacuuuuuaacauugucgaaaguaguuauuaaaguuauuauggcccagcacaauagcucacuccuguaaucccaaugcuuugggaggccgaggcaggaggaucacuugaggccaggaauucaaggcugcagugagcugugauugugccauugcacuccagucagaaugacagagcgagacccagucucaaaaaacaaauuaaaaaacccccauuauuaugugcaaagccccuuucuucaaugagccuaccauccaguaggggaauaauaauaauaucaguuaucaguucugcuauuuccuagcugcgugaccuugggcaaguuaucaaaccucauugugccucaguuuuuuguuuuuuguuuuuuauuuuuuugagacggagucucugucgcccagucuggagugcaguggugccaucucagcuuacugcaaccucugccuccuggauucuccugccucggcuuccugaguagcugggacuacaggcgugcccaccacgcccagcuaauuuuuguauuuuuaguagagacgggguuuugccauguuggucaggcuggucucaaacuccugaccucaagugaucugcccgccuuggccucccaaagugcugggauuacaggugugagcccgcauccccagcccuguuuuuuaaaucuauaaaacagggaugauaugguucuucucucacagcuuuguugggaggaugauuuaaauuaacauaauguggucagcauauaguaaauacuguguuagcuauucuuauauacucuuaguuugugugaggcauuguguauguauuuuacaugcuuucucucuuuucauuuccacaacaaccacaugagguggguauuauuuuuuucauuuaacagacaaagaaacugaggcucagagaaguuaagcaggauguccaaggucacacagcuagcaaacagcagagucaggauucacacgggggucugugcugacugaaaagcccaugcuuuuaauagcauucugcuugcucugguaccaggaagacuguuaauaacaguguauaacuauuucaagguuuggagaggaguggggggagggaauuccaggcagaaggaccggggaauaaaaguguggaaguggagaugugugcgugggagguuuagcagggucaggccagggagcaagagaagggggacgaacucagaaugaaaccugaaagccaggcagcuuggcugguuucagguccagccaugaaaggaaaaaacugggacauacacccauuugcccauuuuggggaggagggaguaggguuuaggguucaggcucagccuccuggcugcugucagucccucccgaggcucuccugccccgggccacccuggguccuuccucuccugagucuucacucuuccacuauaauaauaaacaagggagaaacuaugaucaaaucaucugaauuguaacgagccccacccacuggucccagaccacccggcccacacagccuggaaggcccccagcccuggcuaagcccauggcguccugcugcccugcagcuaggaaaaugcaggccaggcacaacccucuggccagcuggggcccugaggggcugagccuccugucuggggggagaaccugaaaaugcaagggggcugcagggaggaauuuuggguggaacaaaguugcuccugccccugacaguuuccccuguaucuccucaccugccggcccugcuuggcugcagggcgaggcugauuuuagcccgaagugagaaccugccaacaaucuguggugugaguagaaggaucucagucuuccuggccuccugggugggaugcagcagcucccccgaccccacaaaccccgacacccuuccaaggggaaggaacucgggcguccucaagcucagaccacuggcucuuuuuuuuuuaauauuuauuuauuuacuuauuauuauuuauuuauuuuuagacagggucucgcucuguugcccaggcuggagugcuguggcgugaucauggcucaccacagccuggacauccugggcucaagccauccucccaccucagccuaccgaguagcuggaacuaccggcgugcgccaccaugcccagcuuguuaaccauccccccacccccgccuuuuuuuuuuuuuuuuuuuuuuugguagagacagggggucuugcuauuuugcccaggcugggcuccagcgauccuccugccuuggccugcggaagugccgggauuacagacaugagccaccgcacccggcccggaccgcuugcucuucauuccggagauuauggggagcuggagaagaagaaagcaagcagaaaacuaaggggggaaacgagagaaagagcccgggaugggcagaggcugacaguguggccagggguccugcugggggcggguggagaguagggggaggugugucgggggaggcagcaggggaggagcaaagcccuaggucgagggggagggaagggcggcggcuugcaaugagcggcagggagcguugaagggcguggagcgggaaggaaagaaaaagagggagaggacucacagggagaaaggacagugccaaagggugacuucgaggggacuuuagccccgcucccugucuccauaaaucccuccuggcacuccaaacaaaccuacaaucgaaguaaagcagcgcgcuuucaauagcgaggcaaggucccuugcuccaaccagaaacgggaugauaccuggugaacccccauccagcaagcccggggcccucagaaucaagggcaugagacccuggucucuagagagcaucuguggccacaccccauuggccgaacugucaaucgccaggccauauuugggccucaugacccguugcuaggcagauuuuuauccccugggguugcugugagccaugugcccgcagacuggguuggaggcgugggacacagaggggagcaaagacggggcgagcaagugggaaagaagacccuggggggcugucgggaagcugcugagaccagguauacaccucccaagggguggccacgggaccucaccccuuacccuaguggguccccaaugcccaaacacuggccuuucauugcgcgcuuuccccuuuauccagacuuccuucaaaugacagcuuuguacccugagaaacuaagguccuggagagugucagcgucauauauguuauugcuuuugaaacuuuacauuuaaaaagagagcuuuuagacccugagggaugggucucucacgugguuauuucaggcccaucagcaggccagcuuagggcauuuugaaacggcagagccuuuuagcccauccucacaaacagcgugguaccgccuugcuuucuccucugggagcuccugacauccucuggaugcugggcugcagggggcaggguaggggguggggcaggggcgcuugaccccuauguggaggaguuuuggccuuaagguuccccagccccagccaggugaaaggggaggcuuuugacaaccuugggucuuuccagccaguguuuaccuagguguguggucuccucaagggcgcguggcugccaaccacgccucuguccucugucuucgguggccaggcgguggggagggcuggaaugugagcaggcaggcaagaauaacgccagggcauuuucuauuuguaagauugcaaguucggcucacaacuugaauuucaagugggcccuucagccagauagggaagucagaugagagaguggaggcagccagugcggauugucuaaauuccuagaaaaauuccuagaaaauaaauucuaggaauuuagcugcaggagggaggagccccaggugggauaagcucuggguaaauuugcuggggggccuggcagggaugcuaggcuuuuuguccuucacgcuauuuaaacaucauguuuuuccaaaaauugcgugucucuugaaucauaucuaagacucucuuucuuucucucucucucuuucuuucuuucuuuuucuuucucucucucucucuuucuguuuuugagauagagucuuguucuguugccuagguuggagugcaguggugugaucuuggcucacugcaaccuccaccuccugaguucaagcaauucuccugccucaaccucccuaguagcugggauuacaggugcgcaccaccaugccuggcuaauuuuuguauuuuuaguagagaugggguuucaccauguuggccaggcuggucuggaacuccugaccucaggugauccacccgccucggccucccaaagugcaggcauuacaggcauaagccaccacgcccggccuggaggcagggacuuuaaaagaaguuauuuuuuaaacugagcugcugcccucuuaugaaggaaaaccacucccucuaaguacugauuuuggugacugcucuuaguuugaaguaauuauugugucuaaaaauggaaaaucacauguuacuguuuaucaaaaggaaauaaacaccuuggauuaaucggguucuugccacuggauggugaguccagaccuugccggcaacccagguaaaaaggccacucugcauguucugcaaacacucacuuuuuuuuucuuuuucuuuuuuuuuuuugagauggagucuugcuuuguuguccaggcuggagugcaaugacacggucuuggcucacugcaaccucugccuccuggguucaggugauucuccugccucagccucuugaauagcugagauuacaggcgcccgccaccaugcccggcuaauuuuucuuuuaguagagacaggguuucaccauguuggccaggcuggucucgaacuccuuacccaggauccccccgccuuggccucccaaagugcugggauuacaggcgugagccaccgugcccagcccacuuucguuguuuuacaguuuccgaaggggaaguggucagauccuguguguccgcugaggcuuacuugccaugccugguuauguaaucguggacaaccuuugauugggcuuugcugguggcagaaauaaggacaggaaaaaacaugggagucagggcgugucccccacucacucuacucugacauggauuggacuguugauuguuuuguauuuaugagcauuugcugaacucucacggaauauggagaauuaaaaguuggacagaaaugcuucaguaagccagcgugaacuguacauagguucacacagggaaaaaaaggucuuggagguggcuccgaacacuacaugucucagccuuuucauacuccagccaaugcccagggagcacuugguggucucugcuuuugacuuagcuacugucagccucugcagucucaagccggccucugcagccacacucagcucuucccaguacucuuuuaacauacucuucucuuuccagcaccuggcuuucaugcaggcuuuucuuccucauccuuuggguuucagcucagaggucauuuccuccuggaagccuuccuggauacuccccaucuuccccagcuaucucacgcauucauguugcucuguacuuuuuuguucuuagcacuauucauauuaaaauauuaguggccaauggcuugucugucugccucuugcuccggacugucagcucugugagugagaaguaguaugcuuguccaucauuaugucuccagcacacggccaggcacauggcacguggcagaaacuugauaagccaucuuaucacuaaccgaucacuucauacacuuccccucagcgacuggugcuccaauuuuccuucugucaauuacuguuuaguuucuugaucucucagguuuuagccuguacuuaggguaaaaacaaacaaaaguuaaagaacaaaacaaaauaaacauucucuaauaaacgguugcugaaguuuugcacuuuggcugcuuuccuugagcugcugagugugaauucagcuaaauucugugcccuguuggcuggcaaacuucucaaauugacaccauuccagcccccaggacugcccugcuggggugggaaaggaggcagaggaaaagcuuggagacucugaagucgaggaccugaagcccaagaaaggugggguggcaagaacggcaaaaaggguguugcuuggggcaggaaguugaggaagagggagugaaggagugcucggguguggaagaggagaagacaccccaaaucugcccaguuugguccgaaauggguggcuggcaucugaaacgucucucacugcuuaagucuaggaaguguggcuuuugauuauucuuuuguucuccuucccuuccuuccuagagaauuuuuugaccuggaaagccuggcugggauguggaggguuguguuucccaccugcagcaaugcggggcuggcuuugucuuugcagcgaacugccccaugcccccugccugccccaccgcucucuuugagccugacagacacagcaacaguggcuccguggccagcguccagcgcugcagaaugagacaaagcccuguguauuugcugggcagcacuuggcugugauauauugacaugugagcgcaguagaguauuuguggcaucuggagagcaaagugcucacaucaugcugggguuuggcaagugcauuuauuucucucaggguuugacaaaguucuuuuauuuuauuuuuuugagauggaguuuugcuuugucaucaggcugaagugcaguggcgcgaucucggcucacugcaaccuccaccucccggguucaagcaauuccccugccucagccuccugaguagcugggacuacaaguaugcacuacccugccuggcuaauuuuuuguauuuuaguagagauggaauuucaucacguuggccaggauggucucaaucuccugaccucaugauccacccacuuuggccuccccaaguguugggauuacaggcgugagccaccgugccuggcaggcaaaguucuucuagaauguagaauuugaggcauugagacuggaaaucccuuugaaaggcagggauaaaauuguuuuuuuuuuuuggauggggucucacucugacccccaggcuggaaagcaguggugccaucugccacuccaccuucugggcucaagaaauccucccaccucaaccucccaagugccaccacgccugacuaauuuguuuuguguuuuugauuuuuuuuuguagagaugguguuucacuauguugcccaggcuggucucgaacucuuggguucaagcaauucucccaucucagccucccaaaguguuaggauuacagaugugagccacugugccuggccagaauuguauguuuuaaugugauacaguaugucugagcaauguccacauccaguugucaagggggaaaaaacuugauagugagcauucccagcucaacgcugccuuguucaaaacucagcugacauagaggcuucugcugguucccuguccacacagaguaagcucuucccagccaaaggggagaugaaaggauuauuuacuauguaaaguggugaggcagaaaucucccaguuuguucacuuagcucaaagugggagaaaaaaaaugauguugaggcgguucuauagcucgauuucugguaugaucaacugggagcagcaauuuaaaacccacuuggauuuuuuaagucacuggggagguucggagccacauaccacgcccugugugucaucaucgggcucucugagggacagcacguagguuugggaggaacagguucaaaccugacucugaucguuaacgaagguaguguucuguagcacacaugacucucugggccaaucagauuaccccagccuucuagcaccugugugaacugacauagcugggaagcuggcuaggcugggcucagguggggcagccagguaccuuuauaguaugauuugaaggccucaggugaggcugcccuagccugaaauaucuccccuacuggcuugucaaggaugucugaauuucgcuacuauugagucauuccuuugcguuuacuacgguccucguuuugugagugcagauugaucuggaauacaggauccuuaaccuucccaucuuaauugcguggauacaacuagacuauguuuaaucucuuggguaagccacaaacuaaguuccacuuuuucaugccaggccugucuugaggcauuucaccugcccucuucucuauucuguucagcuuagacaagaagcaagcuggagccagguagucuggugugggggacagaggagcagaggacuggaaagugagggcacccaggagcagcaggcucuccuuccuggcuucuggcuuuccagcacagaaaagcuuggcugagccuuggucuggugucagaugacgccugaagggagaugugaucuccccauuuuggcccagauggagcacaguuagcucuuacauggacuuccuuccacuuacucacuuucccuuuaccagcuauccucuguccuccuacugcugcacucucagccaucaucauucuacguggccucaugccagaagggaagucucauuggcaucccagaggagccaggagcuccuaagccccaccagcacucggccacaccccuuuccccuuuguggcuugguucacagucuccaggagauggaggaguggcuaggagcugcgcagcugccgacagcucaacuugugcggcugguuuuuuguuuuuuugagauggagucuugcucuguugcccaggcuggagugcuguggugcgaucuuggcucacuacaaccuccgccucccggguucaagcgauucucuugccucagucucccgaauagcugagauuacaggcacacgauaccaugcccaguuaauuuuuuuguauuuuuaguagagacuggguuucgccauguuggucaggcuggucucgaacucccgaccucaggugauccacccgccucggccucccaaagugcugggauuacaggcauaagccacugcgccuggcagguuugaacagauacagaggauguuuagugagaggccagucggaugcuaugggucugcacuaaagccuuaaacccuuucuaucuuuuccucuuucccaggccuagaagacauggucagaguucaucuacgucaugccccugccuccgggcauauuuuaucuccccaugcccaugccugucuuccagagaccacucccaccaaaggaagugggagaagcgaggcggaagagaggccauaaaguccgcuggaauauaggcuccaugaaggcagggauuuuuaauauauccccagagucuagaacagugccuggcccacaguagaugcucaauaaauauuuguugaauaaugaaccuccccuuguugaaguaaucacagcugguaaaguacuuucaauccuaaugaauauucuguuggacagguggaaauuuuuagagccaacauuuccaaagaucuauuuauuuuguuuuuuguuuuuauuuuauuuuuuuuagagaagggccuugcucugucacucaggcuggagugcacuggcaugaucacagcucacugcaaccuugaacuccuggacucaagagauccucccaccucagcuuucugaguagcucuuacuaaaggcacagcuuccaugcccagcuaauaaaaaaaaauuucuuuuuuuuuuuuuuuuagagugagucuggguucacuauguugcucacgugcugcucucaaacuucuggccucaagcgauccucccaccuuggccuucuaaagcacugggauuauaggcaugagccacuaugucuggccccaaagauucaauuuuuaauuacaccauauaguguaauuauaauuacacuauauaguguaauuauaauuacauuuaguguaaucuuaguaugccauucauuuuguaaaaaauuaaaacaauacaagagaaauuccccuuguuccaaacacacuugcgugcuccuucuuagugauaaccauuagcuucaucuuggcaugugcccuguagacuuugcucaaugcauuuggacaagucuguauguuaacauagaagccuagaguuuuguggguuagcaacgacacaacaaccacaacaacaaaacccauaaaaccauaaauaagauuggacugugcuguuuugcaguuuccuuuuuccccucuuaacguuuuggagauguuccauguaggugaaaacagaccuaccucguucuuuucauugugaaauauugugcagcauagauauauugcauauuugacaauuccucuauugauggacuuuuaagucauuuccaguguuuacuuuuuuuuuuuuugagaugaagucuccccucugucacccaggcuggagugcaguggcucagucucggcucacugcaaccucugcuucccagguucaagcgauucuccugccucagccuccugaguagcugggauuacaggggcgugccaccacgccuggcaaaauuguuuuguauuuuuacuagagauggaguuucgucauuuuggcccagcuggucuugaacuccucaccucagguuaucugccugccucagccucccgaagugcugggauuacaggugugaaccaccgcgccuggccuauuaccaguuucuaugaucuuguuagaauaaaaauuucagcucucucuuggacaggaaauugugagugauucacacuaguaacauaaucagauaugucguaaugaugcuauuuaaugcuaugucuucuguuacuuaguaacuguuuuacauaaagggcguaaucaugucuccaccuuuuuugauaggaaugguuguguaucacuuuucuccacccauuucaccaugacuuuuagauaugaaaugggagagucuggggccuuggagggccucaggggagugaccucccccuucccuuccuuauccucuguuuucuugaguggcuucaaggaguuguuuggugccauagccugcccuucugccacauccuuuccugccacauaguggucauguccuggaaugacgagaugacaaugccaaucauucagucccaggcugcauggugcacuggccuuuggauuccuccuuugaucagcucagaacacuuuagcaguuguugguuuugaccugugcuuggcuuugaugauaucaggcccaucuucaaaccuuuuccuuguaccucaggaaugauaccgcagucuggauccagccuuaaucuuuucaaggcccacgcaucacucaguauaauauuuuccacagauaaguacauuuuaaaaggaaaagcuuuaagaacacuuuauauuuuauaccauuuaauuccuuggcaauuuucuucucccacccacaccuuaaugucauuugcucuucuauuuuucucaaccucuguuuucuuuucuuucuuucuuuccuuccuuccuucccucccucccuucuuccuuccuuuuccuuccuuucuuccuuccuuccuuucuuucuucuuuuucuuucuuucuuucuuucuugagauggagucucccucccucugcugcucaggcuggagugcagugaugcgaucucggcucacugcaacugccgccucccggguucaagcaauucuccugccucagccuaccgaguagcugggacuacaggcacgcgccaccacgcccggcuaacuuuuguacuuuuaguagagacaggguuucacuauguugaucaggcuggucucgaacuccugaccuugugaucugcccgccucggccucccaaagugcugggauuacaggugugagccaccgcucccggccaaccugcuuucaagauuacaucagagugguggcuguggaagaauuuuucucccugagaauuuucucuaggcauaguucuuuguuacuaacaagauuuuccuucucccugcuugaugauuuccguacaguuuagacucauagaguaucuuaauauuaaucucuagugauugaauugcaacagcaccuaggauggcuagauuucauaauggcuuuuuccugaaguucacuuuucagagggagccuaggacuuuuaaggcagugugacuuguuuuaaugguuucagauuaauuuuguauuuguaucagaaaaccauuuacuuaaugauuugauuguuucauuuucuaaagugaauaguaacugaacucguuuccuacuccuuuauuuaguccagcuacuauagaaucuuuguuuugcuugcuuuuaguaauauuaacguuauuucuuucuuucuucuuuuuuuuuuuuugagacaggaucuggcucugucacccaugcuggagugcaguggcgcaaucuuggcucacugcagccuccgccuccugggaucaagugauccuccugcuacagccuccugaguagcugggauuacaggcauauaccaccaugccuggcuaauuuuucuauuuuuaguagagacgagguuucaucauguuggccaggcuggucucgaacuucuggccucaaauaauucaaccgccuuggcuucccaaaguucugggauuacaggcaugagccacugcgccuggcauauuacugcuauuuuuuuuuuuuuuuuuugagacggagucucgcucuguccccaugcuggagugcaguggcgugaucucggcucacugcaaccucugccucccagguucaagugauucuccuaccucagcuucccaaguagcugggacuacaggugcaugccuucaugcccagcuaauguuuuuuuuuuuguauuuuuagaagagacuggguuucaccacguuggccaggcuggucucgaucuccugaccucguaaucugccugccucggccucccaaagugcugggauuauaggcaugagucacuguccccggccuauuacuguuauuucuaaagcacucuaguuuuggcaaugaauuacaacaggacacugugagguaaucuacauguuuaggugaaagccaugcuuucuauaggauaacuucuuaucuugaauauacuggcaacuuuggcuuggauuuuuuuuccuucuuucauauuuccuaauauaugcuaugaaacaugaauggaugguuuaguguuuagaguguggguuuaugaaccagguaguuuggauucaaaucucagcucugccacuuucuuuuuuuuugcccggguugggggagguggucucacucugucaccuaggcuagagugcaguggugugaucacagcucacuguagccuugacuucccugagaucaggugauugucccaccucagccuccugaguagcugggaccacaggcguguaccaccaugccuggcuacuuuuuuuuuuuuuuuugagauggaguuucauucuuguugcccagauuggagugcaauggcucaaucuuggcucacugcaaccuccgccuucuggguucaagcgauucucgugccucagccuccugaguagcugagauuacaggcgcccgccaucacgccaugcuaauuuuuguauuuuaguagagaccauguuggucaggcuggucuugaacuccugacuucaggugauccaccugcuuuggccuccuaaagugcugggauuauaggcgugagccacugcgcccggcgguccuggcuaauuuuugaauucuuuguggagacaagguuucgccauguugcccaggcugauuuugaacuccugggcucaagccauuugccuaccuuggccucucgaagugcugggauuacaggugugagccauugugccugaccagcucuggcucuuucuagcuguaccaucuagggcaaguuauuuaagcucucuguacuucaguuucuucuuguguaaaacgggguaguaguaguacuugucuccagaguugauguaaggaguugacauaaggguaaaaaucguuuggcaugugguaagcgccaauguguuugccauuauuauucaaucuuuguuucuaaauuaaaaaaaaauuccuuccuucugugguuauuuggacuuauucugaguuucauuuuauaacuagaaacugaacaauugaaauaaaaagaagagucaucacaugcugaauuucucaaccaaacuuuuucugggaaagacaggauuguuuuuguaaaauaauuuauaucugauuauuauuagaauuuuaaaaauuugugaagaaagaagaaucagugagaugggauuaaucuaugugcaguuuuuaagaaccuuggaaauuuucaugccaucgauuguuagagaaaugcaaauaucauucaguugaaagacucuuacaccauucauucauuuauucaccacucauucauucauuuauucaccacucauucauucuuucaucacucaucauucaucuauccaagccacaaacauuuccagaaugccugggacacugcuaagcucucggagacaaagacaaauaauuuauugucucagcaucuagaaaacucuaaugaagaauuugcuucauuauggggaggaaaaauuuaaguggccccaacaguccuccugaaagcucggaacagggaagauaguucaccuguaagaaggaaggaugaauaagaaauuucaccauuuggcccggccaggugggucacaccuguaauccuaacacuuugggagguggagaugggaggaucacuugagcccaggaguucaagaccagccuggucaacauagugggaccccccccaucucuuaaaaaauaaaaaaaaggcugggcacgguggcucacgccuguaauccuagcacuuugggaggccgaggugaguggauaaccugaggucaggaguuugagaccagcuuggccaagauagugaaaccccgucucuacuaaaaauaagcuuagccacacacuuagcuggugugguggcacaugccuauaaucccagcuacuugggaggcugaggcaggagaauugcuugaacccgggaggcagagguugcagugagauugugccacugcacuccagccugggcaacagagcgagagucugucaaaaaaaaaaaaaaaaaagaaagaaagaaagaaaacaggccgagcaugaugucuuacacuuguaaucccagcacuuugugaggcugagguggguggaucaucugaggucaggaguucgagaccagccuggccaacauggugaaacccugucucuacuaaaaauacuaaaaauuagcugggcauggugacacacgccuguaaucccagcuacuugggaggcugaggcaggagaaucccuugaaccugggaggcuggagguuguggugagcugagaucuggccacugcccuccagccugggacacacagugagacucugucucaaaaaaaaaaaaaaaaaagaaaagaaaagaaaacaguagaaagaaaauaaaaaagaaauuuaaucuguuugaaacugaaggucccgauucaauccuuucauguaaccuuuggguuacuauccccuggggaagagcaaucucccuuuuuuuuugagacagggucucacucugucgccccggcuggagugcaguggugugaucauggcucacuguagccuugaccuccuggacucaggcaguccuccugccucagccuccugaguagcugggacuacgguugugugccaccacaccuggcuaauuuuguuuauuuuuuauuuuuuguagaggugggggucucacuauauugcccaggcuggugugggacuccuaggcucaggugauccucuugccucagccucugaaagugcuaggauuacaggugugagccacugcauccugcugggaagaguaauuuccugggaugguguuagacuugggcaaacacaugaaaagaguaacccguugaaaacacugauggcaaccauaguucuccacgaacugguuucaguguugcugccagacggaauccugcuauuggucagggaaucccauggccaggugggcucuccuucuugaugggaacacuccccuuccccacagaugguagcgaccucugauuggagaucuacuguguaaggcaucaggaacucugaguggagcugaaucuagugaucggaaccccugccccgcaguauccagcuuaaugcuguuggagaaaagauacccagagggcaguaaccgaugagugcuguggucccacaauaaaacccuccuuucuuacacauuguuccucaguguucaguuguaccuuaucucucuccuucuguccuugcaaagcccuugaggagaaugacugggucugguggguggaugaaccggagauagcauuguccccuuugugugagauuccccgggcuuucacaaagggcuguccuucagcuuaggccaguugucuucuaaagauucucuguuaucuucucuacagcuagagauuccaggcaaugguggagcuugggcuggguugggguguguuggggggugguagugguaaacguggggucucugguauuuuauacacccauaguaggcauuugaaaagugcucauugauuggaugauuugaugagugaccuggugauaaucuuuauccuuguuagaacacaccacagccaucagcacuggaaugcaaagaccagaacaaacagaaggaagccagcagccaagccggggcaguuucagucuccaccccaaaugcaggugagagaagugauggggacugaaagacggaugaccuugauuaugauaaugauacccuuuaucacagaugggcaugccugccugggcuguggaagccacacguggaaggauauggcucaggaccccaggagcccagccccucuuucuccugggccuggaaauucaaacccuacucuucuuucagcuuugugagaagcccauaggaaaugcacuuacuacagaaggauuacguacuccuucagaaggagucucaagcguuucuucauagggagggcugccguggaauauccacauucuuuuaagacaguaccuauuaaacccagaagccaggguggggcagaaaccaaagacucagaauuaaaggguuggaaucuacuccuaguggaagaucuaccagaguguagaaaaagucuuuuugauccucuaaaggaaagucuuuuucaggccuccuaggagggagaugcccacauggagggugagcuggaggggaagaagugagugacugugggcuauggaaauccugggucauagggagcuacguggaggggucauuggcucagugugggccguagccauguuucuggccuguaccaaaaugaaacuguuuuuuggagguaauugcaaacauuuaagaaucaggagacuggcugggcaugguggcucaugguuguaauccaacacuuugggaggccgaggcaggcggaucacuugaggucaggaguucaagaccagccuagccaacauagugaaacccugucucuacuagaaauauaaaaauuagccggguaugguggcaggcaccuguaaucccagcuacucgggaggcugagacaggagaauugcuugaacccaggaggcagagguugccgugaguugagauugcaccacugcacuccagccugggcgacgacagagugauauuccgucccaaaaaaacaaaacaaaacaauaaacaaaaauauggaauguauggccucucaacauuuugucauguucacugagcccacauucccacauggcaaugucagcuggagaggacugacugccgugucacugggcaaagggagcuccgcuuccuucuauccgcuccuguggacccuccuuccuccaucugagccccauuuucuccucucaccucuuccuugcccagcgcuccacccauagccuggggugaauguccguucagcauauaaacagggacauacuccaccuccuuuaaagaaagccucccagccuggugcgguggcugacgccuguaaucccagcauuuuggaaggcggaggagcaggaggaucacgaggucaggaguucgagaccagccuggccaaaacggugaaacccugucucuaccaaaaauacaaaauuagccgggcgugguggcgcacgccuguaaucccagcuacucaggaggcugaggcagaagaaucgcuuaaacccgggaggcggagguugcagugagcugagaucaggccacugcacucuagccugggugacagagcaagacucugucucaaaaaaaaaaaaaaaaaaaaaagaaaaagaaaagaaagaaagccucccucaagcccgaaccccucuugcuguggugcuauucuuugagagccaacuggaaagcauugccuguuccauuccugucgccucuuccucaucuucccuucacuccaguccccccacuucccguucccaggcuuccacccugccacucaauacugcucuugcugauuccacuucauugauaugagugcccagggaaaucucugggcacuuggugcugugcccucuccuuccaugaaacacccugcccccucugauuggugauaucgccuucauguugacgucuguuugguuaggaugacuuugcccucccuuccuaggcccuuuaugggcuccccucuucccacaaccucgaaaguggcagaauuucccaaggaccugucauggguuuuuguuuuucucacucgggacucucucuccgggcaaccucuuggggcucuguggcucucaggccugcuucucuuccgagcuccagggcugcacaucugggcuccccuccacucccccucucccugucucuccauccccguccuuaccgucucuggucagcucugcuaaccaucuggcuaccacaccagucacccaccuucuuaacauuuccaauguuuuugguuuguauuauuugcuacaaucgccuccuaacugucugccugucuuagcucuuuuccuccauggauagacugagcuuaaauagugguuaguuuaaaauaaaagaaucaaaucauguuacuccccuccuugaaauucuucaguggcugcucauggcucucggggugaaguucacauccuuggcucagcacccaaagaugccauggcucagcucuuggcucagcccgcaccacuucccaugugggcuuuucacuccagcaacacccuagugcugguccccacauccaugaugccggucuaugcuccuaugucuuuuuuuuuuuuuuuugagauggagucucacucugugacccaggcuggaaugcaguggcgugauaucaacucacugcaaccuccaccucccgcguucaagcaauccuccugccucagccuccugaguaauugggauuacaggcaugcaccacaauguccagcuaauuuuuuuguauuuuuaguagagaugagguuucaccauauuggccaggcuggucuugaacuccugaccuugugauccacccgccugggccucccaaagugcugggauuacaggugugagccaccgcgcugggccgcuccugugucuuuauugugcucuuccaaaccccucugcccccugucuuccugggccuuugaaccaccacuccaggcccaccugagccuccaagucugggcucagggccccuucucugugcucucccaugcugcccaggcaucccuguuuuggcuccccuggugcugggccuccacuagacuucacacucaguagggcccaggaggaucuacagcacagucugcauggaauauaaacuagacagaugggcugggcacuguggcucauaccuguaaucccagcacuuugggaggccgagguggguggaucaccugaggccaggagguugagagcagccuggccaacacagcaaaauccugucucuacugaaaauacaaaaaaaaaaaaaaaaaauuagcugggcauggugggcgccuguaaucccagcuaaucaggaggcugaggcaggagaauugcuugaacccagggggcggaggcugcagugaacugggaucgcgccauugcacuccagccugggcaacaggagcgaaacuccgucuuggaaaaaaaaaaaaaagcuagacagaugauggcaagcuccgcuggcuggcuucccagugcuuacaugguggccauuucucuauugcucuuuggggacuggguucuaguguuuguguugccaaaugcagcacuuuuuguuguacacuuuacuucaacauugauuaaauuaaaugucucgggauuucaagggaauugggauuugaccccuuuucucaaaggacuuguacacugggugcauaaugucuguucauucaaugaacguuuauuuacugagcaccuuugcagagccaggcacggaagguggcagaauuaaagcagccagucacagggauucagagaaagucuguggagcuuagaggaacuuccguggcuuuucaucuucucaugccuugguuuaaaguacaggagaaagauuauaguucuccuugccagagacgccucuuuccccugaucauggauguuuccuuagaaaccaacuugcgugucccccacuuucaugggcuuugaagcuggagucuuguguaaacaucacuucacgggcaugugagaaacaagccuuuccuguccccgccgugagccuccagcuuucucuaagucgacuucucaaggggguacugcuguuucuuuuaauaucaaaaaacccguuugaacauuacaugguuuucucacgguaacacuucagucagcugcauacagggucauuuugguaaauaaguggaaaaucagagaaguauugcuggacuugaagacaagucugugcaguugagagcagcagagcuuuugaaucaagacaucaugggagguugaggcaggugaaucgcuugaacccgggagggggagguugcagugagccgagacugcgccaccggcgacagugcgagacuccgucucaaaaaaaaaagacacuuacgcuguguccuaaauguugaaggcgguuuugaggggugaggugcuggagaguugaagcuacaaacagaaaccuauaaacucauuguguuggaugucauacuguccugccuuacgccacauacccucaugguuaggagcucugcucagaaacuggacugccuggguucaaauccugucuuugcuacucuacguuggggcauguuccaguuuuucuuucaucugugagaucaggaugauaacaucccuuagauggugguugugaagauaaagcgaacuauugccugggcagcguuuauaguggugccugacauacaguaagugcuuaauaaacguuagcuguuguaauuauaccccuuuaucagcuucacacuggacuggucaccuaagcugucaccagacgucccgcaccacuggugguccacaauguuucuguucuguuguuucaaaccccuuagcucauuuugcuucucugaccaucuuauuccaguccucuccucuuucacgauguucucuggucuggaauaggcgucuauuuggagucugccgcuccuuacucagugaacccucucucucuauucugaagcccucuuggugggaugggggcagauauuccuguacucacagcuaaccaugggaaaacucuaggguaauuuuucauuugagcuuguguuuauaaaccucuaaaaccucauaggacccuugccagugggcccaucugugaguucuccaucuauguaaagaaaaaaaaaaacuggugguaaaauagacauaacauaaaauugaccauuuuaaccauuuuuagguguacagcucagugguauacaguacaucuacauuacgguggaaccaucuccacugugcagcuccagaacuuucucaucuuccccaauugaaacgcuguagccauucaacacuaauucuccagcccccggcaaccaccaugcucccucccucccucccucccucccuuccuuccuuccuucuuuccuuucuuccuuccuuccuuucuucuuuucuuucuuuuuuuugagacagaguuucggaguuuagcucuuguugcccaggcuggaguaaaauggcacaaucuuggcucaccgcaacguccgccuccuggguucaagcgauucuccugccucagccucccaaguagcugggauuacaggcaugugcuaccccgccugcuaauuuuguauuuuuaguagagaugggguuucuccauguuggucaggcuggucucgaacuccugaccgcaggugauccacccaccucggccucccaaagugcugggauuacaggcgugagccaccaugccuggcugcuacuuucugacuguaugaauuugacuacucuagguaccucauauaaguggaaugacacaguauuuguccucuucugucuagcuuacuucacuuucaggguucaucuauguuauauuuuguguuagaauuucauuucauuucucucucucucuuuuuuuuuuuuuuuuuuugagacaaagucuugcuuugucacccaggcuggagugcaguggugcaaucucggcucacugcaaccuccgccucccagguucaagugauuccccugccucagccuccugaguaguugggacuacagguauaugucacaaugucuggcuaauuuuuuguuauuuuuuagcagagaugaggauuucacuauguuggccaggcuggucuugaauuccugaccucaggugucaccaccugccuuggccucccaaaaugcugagauuacaggcaugagccaccacucccggccuucuguuauucuuuuuuuuuuuuuuuuuuuuugagauggagucuugcuguauugcccaggcuggagugcaguggugcaaucucggcucacuguaaccucugccucccagguuugagcgauucuccugccucagccuccugaguagcugggacuacaggcuccugccaccaugcccagcuaauuuuuuguauuuuuaguagagacgggguuucaccguguuagccaggauggucucgaucuccugaccuugugauccgcccgccucggacucccaaagugcugggauuauaggugugagccaccgcgcccagcaagauugauccuuuuuguuuuguuuuguuuuugacagggucucacucugugacccaagcuggaguauacuguugggauuacgucucacuguagccucaaacuccugggcucaagcacuccucccaccucagccgccccaguacaggcaugcaucaccaugccugacuaauuuuuaaaauuauuuguaaauaggcagggucucacuauggugcccagacuggucuugaauuccuaggcucaaacgauccucccgcuuuggccucucaaagugcugggguuacagaugugagccacugcucccggccaauuaaucuuuuugaaaccuaagucaaaggccaggcacgguggcucacgccuguaaucccagcacuuugggaggccgaggcaggcagaucaccugaggucaggaguucgagaccagccuggccaacauggagaaaccccgucucuacuaaaaauacaaaauuagccgggugugguggcgcgugccuguaaucccagcuacccuggaggcugaggcaagagaaucgccugaacccgggaggcggagguuguggugagcugagaucacgcaauugcacuccagccugggcaacaagagcgaaacucugucucaaaaacaaaacaaaacaaaacagaacaaaacaaaacaaaaccuaagucaaguauugccaugccucacucaugaccuuccguggcuccccaucucacucggaagcaugcuuaagugcucgugguagcguagaggcuuccauaccaccuggcccucacugcucuucagaccccaucuuuuccucccucauggagcucuggccacaggggcuccuugcuguuccuugaucuggcagccaagcuuccaucccaggguuuuuguauuugcugugaacuaugcuuggaauguucuuccccuugacaaagucuuccccuuauaaugucaccucgcaagagaucuucucugacaccuuacauaaaguagcaagcccuccuuccccugaccuauggcgucucucuuguuauuuauuuauuuauuuauucagagacagggucucacucugucacccaggcuguagugugguggcaugaucauagcucacugcagccuccaacucuugggcucaagugauccuccugccucagccuccagaguagcuaagacuaccuaccggugugugcuaccaugcccagcuaauuaaaaaaaaauuuuuuuuguagaaaugggguuucacuacguuuuucagacuggucuugagcucuuggucucaagugauccuccugccucagccucccaaagcauugggauuaugggugugagccauugcacccagccaucccuucuuuugaacacugcucuaugcaugcccuuucuuuuuuuuuuuuuuuuuuuugagauggagucucgcucuguugcccaggcuggagugcaguggugcgaucucggcucacugcaagcuccaccuccuggguucacaccauucuccugccucagccuccggaguagcugggacuacaggcgcccgccaccgcgccuggcuaauuuuuuguaguuuguuuuuuuuuuuuuuugagauggagucuugcucugucgcccaggcuggagugcaguggcacaaucuuggcucacugcaagcucugccucccagguucacgccauucuccugccucagccucuggaguagcugggacuacaggugccagccaccacgccuggcuauuuuuuuuguauuuuuaguagagacaggguuucaccguguuagccaggauggucucgaucuccugaccucaugauccgccugccucggccucccaaagcgcugggauuacaggcgugagccaccgcgccuggcuguaguuuuuuuuuuaguagagacgggguuucaccguguuagccaggauggucucgaucuccugaccucgugauccgcccgccucggccucccagagugcugggauuacaggcgcgagccaccgcgcccggcccgcccuuucuugaucuauguagagaguguuguguagaucauuuuggcacaggacagaauuucagaacuggaugauuuguuagugauccucuguuuccaccaguucucuucaaauuaaagcugaaggaauggaggccagaaaaggcugaguggcccccgacucccguaucauccugagcucugaacugauugauucaugagccugcagcauucuucugguaaagcagaaggccugcagcccacccuaccccgaugcuguugccacguagcgucccuugggcccugggccuucggggucuucugucacucggcugcuguucacuuucaggaggaacagaugcugguggaguuucccaccucugaccaggucacucuccaggcagugcuucuuggugugaaaccaugucguucaaaugauuguccuuuugguguucaaaugaccauccuguggacguuuuugugugucuuuguguuccugauaguuugcccugucuuuuuccuccuaggccucuuaaggguuaaauuauaccaggaggaagcagggccaguucuccugcuuauucugcacauuacgaaugaggaauauuuuacauucaugaauaagcuauugcuuaucgaugcuacgauuacagauaaaauguuccuguuccucuuugcuacacaugaaauugcagugagcaguacaagaugaauuugacagguguggucucuaccaugcuagauggagacauucuggggaaaagaguaugagggagggauggcaugcucagguaacaguaagcacucacccucugaggugcuuucuaugugucgggcauggcguaaaugcuuuaugugaugucauuuauuucauccucacgguagcucucgugaguaggugcaauuauaucccgauuuggcaguggaggaaucugaggcacagaaggauuagguaauuugcccaaagucauugagagaacggaagggcaaagccaguauuugaacccaggggggcuccagaguccuuucuguuaaauacuacauuuuuuuuuuugagacagucucgcucugucacuuaggcuggagugcaguggcgcgaucucagcucacugcaaccuuugccuccugggcucaaaugauucuccugccucagcuuccugaguagcuggaacuacaggcacgcaccaccacgcccggauaaauuuuguauuuuuaguagagaugggguuuccccauguuggccaggauggucucgaacuccgggccucaagugagcaguccgccuugggcucccaaagugcugggauuacagaugugagccacugcacccggccuaaauacaucuugaugaagguuucauggaggaagagagauaugagcugggccuugaaggagagcuccacauguagacaacaugagugacgggccagggauggagugagcauggcugacccagcagggaagagagacugaccucacccgacacagggcaugcauuggggaauggugggggagauggggcaagagggcggagauggaucguaaaaggucuuaacaucaaggcagaggguugaagaacucagacuuuaaagaguauugaagggccaggcgcggugguucacgccuguaaucccagcacuuugggaggccgaggugggucgaucacgaggucaggagaucgagaccacggugaaaccccgucucuacuaaaaauacaaaaaauuagccaggcaugguggugggcacuuguagucccagcuacucaagaggcugaggcaggagaauggcauaaacccgggaggcggagcuugcagugagccaagaucgugucacugcacuccagccuaggagaaagagcgagacucagucucuaaauaaauaaauaaauaaauaaauaaaaaauaaagaguauugaagggugacuugcuagaagcugaggucuagggagguuuuuggguagcaaugguagguuugagggugggagguguggaggcagggacgagacccugaggguccagacaaagauggugcaagggaaauggaagaaaggggaagcccaaggccagguacaguggcucacuccuguagucccagcacucugggaggccgagguggguggauuaccugagaucaggaguucaggaccagccuggccaaaauggugaaacucugucucuacuaaaaaauacaaaaauuagcugggugcaguggugggcaccuguaaucccagcuacucgggagguugagacaggagaacugcuugaacucgggaggcagagguugcagugagccgugacugcgccacugcacuccagucugggcaacaagugcgaaacucugucucaaaaaaacaaaaaaaaaaccaaaaaaaaaaaaaccaaaaaaagaaaagagaagcccauagcaccuuccuucucauccaagucaucuccuggagagggaucagcccaggagcuacaggagcgccucggguuucaucgguuacucacaggaggcagccucugggcuuuugggggaaggucgaggacauuauuuacugaggucuguuuuccuguggauggcuguuccugccuaggcaacgagcauuucuucacgcugcgcauuccaacuuggucagaccagaaggcagcaaauccagguuuuuuuuuuuuuuuuuuuuuuuuaacugcacgcagaauuccuugcauagcagagagcucaggaaggaaggcccuguuuggggacagaggucaggguuucagaguccaggaccacugagaaagagucaggccuuucuuuuuuuucuuuucuuuucuuuucuuuuuuugagauagagucuugcucugucacccaggcuggagugcaauggcgcaaucucggcucacugcaaccuccaccucccggguucaagcgauucuccugcuucaaccucccacguagcugggauuacaggcacccgccaccgugcccggcuaauuuuuguauuuuuuaguagagacgggguuucaccaucuuggccaggcggaucuugaacucccgaccuugugauccacccaccucggccucccaaagugcugggauuacaggcgugagucacugugccuggcaaagucaggccuuucucuguuaaucucagguuugccugauuagccucugaauggauguaccuggagugaacucugucacaagcagaaauuuaauuuaacccuugagauuuauuuccucccaccccuaaaguaucaacugcuaaagggauuuagaaaggauccgaggcaagauuggcagggcugaggguucuguggcugucacuguccaggacagcuggccacuggguccagccugcucccagcagugggcacaggcaggggagcagggcccugaccuuccuggcagguggcaggguccgggugaggcuucccaagcucugccugcuacccuccugcuugaaaucaggggugaggggugugaggcccuccuauaaauccggcagaacccagccagaaggagcacugggaccucaucucccuccccucuggauuccagcuccccggaaugggccaaguuugccuuaacuuuuuauugaagugaaaaacagucaagauaugaauauucccuaaagccacuuuggaauacuuucaagaauaguuucacaguuaaacaggcaaaaggacaagauugcaugcaggaauggaucacccacuuggagagccgguucuggaaagagagcuuugauuucaugccuuaucuguuucgugcgucguggaagaagggaauggaaggcauuugguuggggagauggagaccugcugcuuguaugggguauuccccucugcauggugacagguucuuagggaaacaucuuaauagaaggcuuaugagcagucuggcaaacuucccacccuccuuguacccaagacaaaaauguuggccugacaaaaauauucagguaauuuucuaguauuuuuagcacuucgcagaccccaaacuacccaaguaauggcucucuuaaaaaaaaaaaaggggcugggcaggguagcucacgcccguaaucccaguacuuugggaggcugagguagacggaucaccugaggucaggaguucgagaucagccugaccaacguggagaaacccugucuccauuaaaaauacaaaauuagccagacgugguggugcaugccuguaaucccagcuacucgggaggccgaggcaggaaaaucacuugaaccugggaggcagagguugcagugagccgagaucgugccauuguaccccaaccuggguaacaagagggaaacuccguaucaaaaaaaaaaaaaaaaagaaaaaagaaaaaaaaagaaaagaaagcaaagcucuuagaaaaguuguccuacuaucuuauuacaauaagugcugaaguagacagacucugucaucuuaacugugucaacauuaaugaaaagaaauuagccgagcgcaguggcaugugucuguaguuccagcuacucaggaggcugaggcaggagaaucacuugaauccaggaggcggagguuguagugagcugagauugcgccacuguacuccagccugggagacagagcaagacucuguuuuagaaacaaacaaacaaacaaaaaaaauuagugaaacagugucaucaaaggccuaggagggauuuuuuuaaugguguauuaaugguguacauuuuccucuuuugcucuuuucuuuucucucucuuuuuuuuuuuuuuuuuuuuugaggcagggucucauucugucacccaggcuggagugcagugguaugaucacggcucacugcaggaggaucgaucuccuggguucaagcgauccucgcaccucagucuccugaguagcuaggaccacaggcgugugccaccaugcccagcuaauuuuugucguuguuguuguagagaugaggucuugccguguugccuagguuggucaggaacuccugggcucaagcaaucuccaucuccaagccccaaccuuggccucccaaacugcugggauugcaggagugagccaccggcacccggcacccuguccuguuuucuaggcauugcuaggggcaauaauuugggagaaguaaaggacaagaacaaaaucaaagaagaggcauucuuguaucauugcucuccugaauuuguuggggagcccuggggugagcccugucaggggcuggaggguccagucuuagugugaaaagaccucaggggcucagccccagcuccugcuuagccccugggcccuagcugagaagaagagcgaaugugugugcugaccagaccugaccagaucugcugggugaggcugcgggugguggugagaggccauucuaagaaaccaccuggaauagugggggaggagaugggaggccaggggcucugcucuuaagauagcacugaguccugcggagaggaauuccugggaggauuuugaguccaccugacuucccuuugcucuugguguacaggucccgggcuucaccacccuggccuucuuucgcuuccucaaauguuccagaggccucuguaccuauacacauguuacuccuuggccaggaaggccccccauccccuaagccaauuaucuuccagguuucugcacaaccaucaccaccucuggaaagccuuggcccagggcuugacugggaucccccugcuuuuuauaacuuuuuuuuuuuuuugagauggaguuucacucuuuugccuaggcuggagugcaguggcgcggucucagcucacugcaaccuccgccucccggguucaagugauucuccugccucagccucccuaguagcugggacuacaggcgccggccaccaugccuggcuaauuuuuguuauuuuuaguacagagggguuucaccauguuggccaggcuggucucgaacuccugaccugugaucugcccgccuuggccucccaaagugcugggauuacaggcgugagccacggcacuugcccuauaacuuuuauuuuagguucgggggugcaugugaauguuugcuacauagguacacucaugacacggggcuuguuguacagguuauuucaucacccaggaauuaaguucaguacccaauaguuaucuuuucugcuucucucucuccuccucccacccuccacccucaaguauuggugcaaaaauaauugcggcuucagaccauguauuugaaaucauuauaacuaggcucaaacacaucuuuauuaaccaaaauaggaagcguuacaaucaacacauuuuugcuaaugagaaauaaguuuuuucauuccuguagcauauaaauccaugcuucgggauucgacgaacucuuagaaagcauuuucugcauccugcugguuguggaagcguuuucccugcaaaaaguugucgagaugccugaagaagugguagucaguuggcgagaggucaagugaauauggcagaggaggcaaaacuucguaguacaauucguucaacuuuugaaguguugugugacaugcggucgggcauugucauggagaagaauugggugauuucugcaaccaaugccggcugcaggcauugcaguuuuuggugcaucucaucaauuugcugagcauauaucuuaaauguaaugguuuugccaggauucagaaagcuguaguggaucagacuggcagcagaccaccagugaccaugaccuucuuuugguacaagcuuggcuuugggaagugcuuuggagcuucuuucucuugguccaaccaccggucaucgacaguugucguuuaaaauccacuuuuugucucacgucacaaucugaucgagaaaugguucauuguuguugcguagaauaagagaagacauuucaaaaugauguuuuuuuuuguuuguuuuguuuuaauuuuugcucagcucaugaggcacccacuuauaaagcuuuuucaccuuuccaauuugcuucaaaugcugaacgaccguccaauguccauguugaguucuucgggaacuucucguguagguuuaagagggucuuugauuauuucucucaauuggucauugucaacuucuaauggcuggcgccacgacgcuccucaucuucaaggcucuugucuccuuugcaaaacuuuuuuuugagacggagucuugcucugucgcccaggcaggguggagagcaguggugcaaucucggcucauuacaaccucugccugccagguucaagugauucuccugccucagccuagcaaguagcuggaauuauagccaugcgccaccaugcccagcuaauuuuuguauuuuuaguagagaugggaguuucgccauguuggccaggcugaucucgaacuccugaccucaggugauccggcugccucagccguccggccagaacuuguaccaccacugcacuguaugcucauuagcgguuccugggccgaaugcauugauguugccaguugucucugcugcuuuacaacccauuuugaacuugaauaagaaaauagcuugaauuugcuuuggucuaacauaauuuccauagucuaaaauaaacauaaaauaaacagcaaguaauaagucauuagcaaaaaaacuuaaggcgagaaaugcgccuucaagugauauauagccgggggcgguggcucacaccuguaaucccagcacuuugggagacugaggcgggcggaucaccugaggucaggagcucgagacgagccuggccaacauggugaaaccucgucucuacuaaaaauacaaaaauuagcugggugugauggcgggcgccuguaaucccagcuacuugggaggcuggggcaggagaaucaccugagaccagaaggcagagguuucggugagcugagaucgcgccacugcacucuggccugggugacagagugagacucugucuaaaaaaaaaaaaaaaaaaaaaguauaacauaaccacauuuauuuaagaauauauuccaauaucaaacgcaaauuucaacaaugcaaaagugcaguuacuuuugcaccaacccaauagaccucagugucaguugcucccuucuuuguguuuaugagugcucaucauuuagcucccacuuauaagugagaacaugccauauuugguuuucuguuccuguguuaguuugcugaggauaauggccuccaccuccauccacguucccacaaaagacaggaucuuguucauuuugauggcugcagggguccccccaccuuuuuuuugagacaaagucucgcucuauugccccagguuggagugcaauggugcgaucucggcucacugcaaccucugccucuuggguuugagcaauucuccuguuucagccuccugaguagcugggacuacaggcaccugccacuaugccuggcuaauuuuuguauuuuuaguagagacaggguuucaccuuguuggucagguuggucucgaacuccugaccucaggugauccgcccaccucugccucccaaaguguugggauuacgggcgugagccaccgugcccggcccaggguccccuuuuaagugcccugaugacccucugcaccucgccucugucacugucccugccagugcagcggcuucuccugggucccucuuccucaccagccucugaggucaggauccucccuaccuguugccagauguuccuuuccagcagguagcuuuucagaggccugaaggugggagaaggaagacaccccacugucuucaagcaccaggauguugggacauuguuugcucacucuccuauuuccaggacccagcacggggugcucaguguauguccgcaaacugacuaaauguccagcucacuuuugucaaccagcugucagucccuggcucuuuauauuccuuaucucaugugacucucacaagauccuugugaggaaggccucguguccauucgcagguggggaaauugaggcugcagaguuuuggcaacuuggccgagcuuacgcagcuaagaagcggcagcaauucucaguucuuccacuuaaggugcauaagaaucacuggggagcugguuaaagauguagguuucugagggccgggugugguggcugaugccuguaaucccagcacuuugggaggcugagggcagaucacgaggucagcaguucgaggaccagccugacuaacguggugaaaccccgucucuacuaaauauauaaaaauuagcugggcgugguggcaugcaccuguaaucccagcuacucaggaggcugaggcaggagaaucacuugaaccugggagguggagguugcagugagccaagaucgugccacugcacuccagccugggcaacagagcgagacucuguuucaaaaaaaaaaaaaaagauguagguuucugggcccccucccaagauuucugauuugucauugcauuucuaauuuuuaaauuauuuuauuuauaaauuauuacuauuauuuuugauugacauauuugauauauguauacaauguacagugauuaaaucaagcucauuaacaugucugucaccucacuuaccuauuuuuuuuuuuugagacaggguaucacucugucauccaggcuggaguguagugguuugaucauggcucacugcagccucaaccuccaagccuccagugauccuccuaccuuagccucccgaguagcugagacuacaggcacacaucaccauguccagcuaauuuuguuuauuuuuuuuguagaggugggggucucaccauguuguccaggcuggucuggaacuccugggcucaagcaauccuccagccucagccuccuaaagugcugggauuauagcgugaccugagccugguuccuaucauuguuuuauacagcuuuuuuuuuuuugagacggagucuugcucugucgcccaggcuggagugcagugacacaaacuuggcucacugcaagcucugccucccagguucacgccagucuccugucucagccuccugaguaacugggacuacaggcgccugccaccacgcccgacuaauuguuuuuguauuuuuaggagagacgggguuucaccuuggucucgaucuccugaccuugugguccacccgccuuggccucccaaagugcugggauuacaggcgugagccaccgcacccagccuuuuuuuuuuuuuuuuuuuuuuuuuagauggagucucgaccuuuugcccaagcuggagugcaauggcaugaucucggcucacugcaaccucugaguucaagcgauucuccugccucagccccucaaguagcugggauuacaggugcccgccaccaugcccggcuaauuuuuuugugucuuuaguagagacaggguuucaccauguugaccaggcuggucucgaacuccugaccuugugauccacccgcuuuggcuucccaaacuguugggauuacagacaugagccaccgcaccuggccuuuuuuuuuuuuuuuuuuuuuuuuuuuuuugagauggagucuugcucuguugcccaggguggaguauaguggugugaacuuggcucacugcaaccucugccuccuggguucaagugauucuugugccucagccucccgaguagcuggguuacaggcaugcaccacuguuucggcuaauuuuuguauuuuuaguagagacaaguuuucacuauguuggccaggcuggucuugaccuccugaccucaagcgauccacccgccuuggccucucaaauugcugggauuacaggcaugagucacugcaccuagcccuacuuuguuucgugaauuuuacuacugcagguaccucagauaaguggaguuauacagcauuugucuuuuugugucuggcuuauuucacugucacaguauuuuaagcaaagggcccugguaguucucauguaggagucuggaccauucuuugagaauuuauaggagaggaugguggcagggggugggggcugugcuguccuggcacaggguuugaggguugacuucauagggauggugagggcuggaugaugacucaucagugagugugggcugagaggcgggaaggaggagauuuggguaagggugacaguggggccuugggauuggggugguuucuggcaggcauugcugagggcugggguguugacaaaagccuaagaacucagaguggaaggacaguagaagaacaguugugaggacuggcccaugcagggagggucagugagccaugggucagaggggaaggcaaggagcugauaaaggaaggccagcaguggggagggucugggucaggugggugucuggcugugcggucuacagagggugagaggagucgggugagagccacagaggucaauccaaguggaggccggggcugggcccacucuaggucuagaggcagguggugugacggcaugggaagucagugaaggcaaggaggccagagaugugggaaagggggccugugggcacagggaaggacugauacggagccagcccucugccucaacaagggggcugugcgugcuuccuccugaggaggacccgggucaugggcagccuccuggcuccaaggggagaugacccagacccuggggcgaguggucguagcagcccuuaagucacccagggauugggcagaugggccuuccucuaucucuccaccccucucccuguccaucucaccucucccuuucuucauuugugcucuucuugcuuuucucagaucccuuucucucugccauucucuuucuccuaacugccagugugcggggcugaggggugccuguggguacccgcaucccggccagucucccacacccaggccucagggcauguccggcuucaccugccaugggcugccuggcccccaagcaggccuuuacugggcucugaaccucaccuuccccauuugcaacauguacagugauagugcagguugagcaucccuaauccaaaaauccgaaauccaaaaugucccaaaacccaaacuuuuuugagugcugacaugaugccacaaauggaaaauuccacaccugaccucaugugacaggucacagucaaaauucuguuuaaugcacaaaauuauuuaaaacauuguauaaaauuggucaggcaugguggcuuaugccuguaaucccagcacuuugggaggcugaggugggcggaucaccugaggucaggaguucaagaccagccuggccaacauggcgaaacuccgucucuacuaaaaauacaaaaauuagccuggcgugccuucugcccacuggaugccaguggaagcccccccuaguugcgacaaccaaagccccccuaguagccucaacauccugcaacauacaggacggccucccacagcaaagaauccuuuggcccaaaaugucaaaggcgucacuauuaagaaacucugcuccaggguagcuuggacuguguuugcagucagaaaaagacuccucugaggugugccaccuccccaugggccaucaucccugcagcuggaugcaggaggcugaagcucuugccugacaaaaguuucuccccaaagccuucuuucguauugguauaaauaaaaucugacguucuuucagcuugcagggguugaccccagguggaugaggcaucugaguuguccagcagggacggucaggucucgggggacuggaacaggcccagcaucuuguauuauuuaguucuucuauugaaguucagcagcuggguaagcacuggauuauugugaacaauguggcuguuuagaaguuuugguuuuuuuuuuucccugaaagaaaaaagaggugacagauggagguuggugggagaugaugaucugguggaagucaucauugaaauugauguugcccaccugggaugaucacugucggacucuuuaaucagcacccaagccccacucuguggcugcauuaaugagcaucuggaugauggguuuuaaacucagcuuuuuguuuuuuguuuuuuguuuuuugagacagucucucacugucgcccaggcuggagugcaguggcgcgaucucggcucacugcaaucuccgccucccggguucaagcgauucuccugucucagccucccgaguagcuaggacuauaggcgugugucaccacgcccagcuaauuuuuuuuuuuuugagacagagucuugcugucacccaggcuggagugcagugguacaaucuuagcucacugcaaccuccaccucccggguucaagcgauucucuugccucaaccuccugaguagcugggauuacaggcgcaugccaccaugccuggcuaauuuuuguauuuuuaguagagacagaguuucaccauguuggucaggcuggucucaaacuccugaccuugugaucugcccaccucagcuucccaaagugcugggauuacaggcgugagccacugcaccuggccacacacggcuaauuuuuguauuuuuaguagagaugggguuucacuauguuggccaggauggucucgaucucuugacuuugugauccgcccaccuuggccucccaaagugcugggauuacgggcgugagcacugcacguggccaacuuuugugguuuugauagcuaggggccagagcucuaguuaugagaguuauucucuaaacccuaugagguuuuucaugugauuuuugguuuaugauugaguacacacauugaugaacugugcuuuuuguuuuuccuaucuuguccacuuugugaacucaaucaguuucacagguuacuuucucuguuucugacaccucucccccugguggaauuaccuauugcuauaucuggucaaaagacaaaaauuacacguaggccccacguaguggcucacaccuauaaucccagcacuuugggagguugaggugggcagaucacgugaggccaggaguucaagaccagccuggccaacacagugaaaccccaucucuacuaaaaauacaaaaaaauuuaucuggguguaguggcaaauaccuguaauuccagcuacuagggaggcugaggcacgacaauugcuugaaccugggaggcggagguuacagugagcugacauugcauaacugcacuccagccugggugauggagugagacucugucucgaacaaacaaacaaacaaacaaaaauuacaacauguuuaguuaguuaaagauccuaauuggggcuggacgcaguaguucacgccuguaaucccagcacuuugggaggcugaggcagguggaucacuugaggacaggaauucaagaccagccuggccaacauggugaaacauccucuuuacuaaaaauauaaaaauuagaugggugugguggcaugcaccuguaguccuagguacucuggaggcugaggcaguaggaucucuugaauccaggaggcagaguuugcaguaagccaagaccacaccacugcacuccagccugggcaacagaacaagacuccgacucaaaaaaagaaaaaggaaaucaggagaucccaauugggccgggcuaaguggcucacaccaagcuaggaggcagaggugggaggaucgcuugagaccugccugggcaaaauagugagaccucguucuccauauacacaaaaaagaacaaaccaauuggcuguuauuugcaguucuagaaucaugcagugucuuauucuacaaaaugaaaugaauguuccaagaagcugagcagaggagguuaacuuuaaagacagaaaagagcugaggaaagcagaaacagagaacaaaaagcagaugggucgucucagaguuacuguccuuauaaaggguuuaauuuuuuuguuuguuuuaagcuagagauggggucucacuauguugcccaggcuggugugcagugacucuucacaggcacagucccacuacugaucagcaugggaaguuugaccuccuuguaaaggcuaaagcagaggacacuuccuuaucaugcuggcugaaacuggccuuuuugaggauucggcuguuaucccucuuucuccugauuucucagaaggucagaugaacaguuuuggcuuggugguguggaacuugagcaugaauaauuccauuuugguuugaucuguugggccuagggcaggagcucaguccaaaccaauggccuccuauaauuuuauuuagcaaccuguacacacaugcccauacauuaugcaccccaacccuagcucuuacuguagucugucucugugaauaaaauccccauauauauauauauuuuuuuuuuuuuucuuuuuuuugggagacagagucucgcuuugucacccaggcuggagugcaauggggccaucucagcucacugcaaccuccaccucccagguucaagcgauucuccugccucaaccucccaaguagcuaggacuacaggcgcgugccaucacaccuggcuaaguuuuuguauuuuaguagagacggagucuugccauguugccuaggcagucucaaacuccugaccucaagugauaacgcccauuucggccucccaaagugcuaggauuacaggcaugagccacugugcccagccaaaucaccauguaauuaauauaacuaauaucaucaucccucaauggaagaagauucuagaggacagggaccuuguguuguuuacucaucuuugagcccuugaccccggcacugugucugaccugagauaaggcuucaggaaguacuuugugagcugaacugaacuucaaagaagugaaugauaugcagccauuugucugagaaaaugacauuuugggccacugaauauauacugaagagauguguugcugaaaguuuuaguaggguguugggaguugccugagagugucccucucuuuuuuccaaaccaaucacagcuaagaugauuuccuuggugucaaaaggcuugacuguuucaagaggcauuuuguuguuguuguuugagacggagucucacucuguugcccaggcuggagggcaguggugugaucuuggcucacugcaaccuccgccucccggguucaagcaauucuccugccucagucucccgaguagcgggaauuacaggcgcgcgcuaccaugcccggcuaauguuuguauuuucaguagagaugagauuuccccauguugaccaggcuggucucaaacuccugaccucaggugauccgucugccucggccucccaaagugcugggauuacaggcgugagccacugcgccaagccucaagagggauuuuuggaaugcuaggcgagguagagacuacagacaccaagaauuuaaggcauuuauaggguauacuuucuaaugugaucacugcaaaaguuugaauuguagaauuuguuuucuuuuaaagaaguacaauuauauuacuuucaaggauauacuauuuuucuaaguuuuuuuuuuuuuuuuuaagacaggaucucacuuugucacccacacuggagugcagcgucaugaacaugguuuacuauagccuuugccucucugccuccugggcucaagugauccucccaccucagccccucaaguagcugggacuacaggcaugcgccuccaggccuggcuaaguuuuggauauaauuuaaauguauugaaauaagcugcaaggaaugaucuaggcuuugcauaaccaaguaaaccaggucuuuuaaaagagauacuuagggaucauaaugaguauacaaauaauuaacagguauguuguuuauaaacaguuuauuauucuacauaguuaaaaugcuuccuuaucuuaguuauguuguuaauuugcauuguagccuauguuuaaaugaucacaaauucucuaucaggggaauguuugcauuaauaagguuuuacuucacugaucuaacaaauauuuacuggauaucuaucauaucccaggccugggagauagcagugauuaaguaaguucuugucuuccugaaauaaacuagugaggcaagaugcgaugauggcuggcagaagaaacagcuugaaugcacagcugauggaaauugcugauaaauuagauauguaggaggcaggggugagagacaaaucaaggaugacuucuaaguuuuuggacuugacagcuggcuaaauggccuugucauuuacugaguugggagaaaugagaagagagucugguaaaaaaaaaaaaaaaaaaaaaaucaaaacuuuacuuuuggauacguuaaguuugggauccuuaacagacagccaagaagagaggccagguguguagcuggcuauauacaacucugguguucaggggagcaguacaagcuagagauauaauuaaaaacaaaaauuuuuuuuuugagacagagucuugcucuguugcccaggcuggagugcgguggcgugaucucggcucacugcaaccuccaacucccggguucaagugauucuccugccucagccuccugacuagcugggacuacaggugugugccaccauucuuagcuaauuuuuguauuuuuaguagagacgggauuucgccauguuggccaggcugaucucgaacuccuggccuugagugauccacucgccucggccucccaaagugcugggauuacagguaugagccaccacacccggcccaggcuagagauauaaauugaggguuguauuaguuucuuuugguugcuauaauuaucacaaacugaguggcuuugaacaacagccacuuauuguucuggaggcuauugucuuccaguucuggaggacagaagcccaaaauuacagugcuagcagggucauguucccucugaaagguucuagggaagaauccuccuuugccucuuucuagcugcuggugcucagaauccuugguguuucuuggcuuagagcagcauaacuccaauuucugcccccaucuccauguggcugccuuuaucugugucucuguguuuccucuuauaaggacaccagucauuagaucagggcugacucuaauucaauaugaccucaugguaaaauuuuuuuaauuuuaauuuuaauuuuuauuuauuuauuuauuuauuuugagacggagucucacucuguuacccaagcuggagugcaauggcacgaucuuggcucacugcaaccuccgccuccuggguucaagugauucuccugccucaaccuccugaguagcugggauuacaggcgccugccacaacgcccagcuaauuuuuguauuuuuaguagagacgggguuucaccauguuggucaggcuggucucaaacuccugaccucaugauccacccaccucggccucccaaagugcugggauuacaggcgugagccaccaugcccagcgaccgcacgguaaaauuugaucacaucugcaaagaccguguuuccaaauaagauuccauucacagguacuggggguuaggaguucaacauaucuuucgagggggggacagaacucuauccaccgcaagggccaucaguguguaggugauauuuacagccaagagacugcuuggcaccaacugggagaggauggaguaagaacagagaggaccaagggcugagacuuggggcucuccaacaucugggaucuaggaaaaggaaaaggaagaggaugcagcaaaggaaacgggaggaacagcaagugugagaggaggaaagccaggaggaugugggaucuagaggaaagcucuucaaaagggguucccgacugugucuguccaggagcuguuuguuacugcuccacaaggaaacaccuuauagaaacugagaccagguguucugcaacuuuuacagcaaccugacgcugccagaucacccaagcguguacuucuuuuucuuuuuuugagucaaggucucccucugucgcccaggcuggagugcaguggcaccaucacagcucacuguagccucgaccuccugggcucaagggauccaccuaccucagccucucaaauagcugggacuacagguacaugccaccauacuuggcuaauuuuuuuuuuuuuugagacggaaucuuggucuguugcccagacuggaguacaguggcacgaucucaacucacugcaaccuccgccuccuggguucaagugauucuccugccucagccuccugaguagcugggacuacaggugcguggcaccacgcccggcuaauuuuuguauuuuuaguagagacaggauuucgccauguuggucaggcuggucucaaacuccugaccucaggugauccacccgcuucagccucccaaagugcugggauuacaggcgugagccaggugcccagcugaaaauccaauuuuaaaauagcaaguucaggcugggugcgguggcuccugccuguaaccccagcacuuugggaggcugaggcaggaggcucacucuagcccaggaguuugagaccagccggaucaacauaguaagagucugucucuacaccgccccgcccccaaaaaagaaaaagauuagcagauuagcagauuagcaggguaugguggcccguuccugugguuucugcuacuugggaggcugaggagagaggaucacuugggccagggugguugaggcugcaaugaugacacaggaagauccuauuaaaaaaaaaacucaucgggcacgguagcucaagccuguaaucccagcacuuugggaggcugaggcgggcggaucacgagaucaggagauugagaccauccuggccaacauggugaagccccaucucuacuaaaaauacaaaaaaaaaaauuagccgggcgugguggcgggcgccuguaauuccagcuacuugggagacugaggcaggagaauuguuugaaccugggaggcggagguugcagugagccgagaucguaccauugcacuccagccugggggauagagcaagacucugucucccaaaaaaacaaaaacaaaaacaaaacccaaaacaaaccaaccaaccaaccaaacaaacaaaaaaacaaccaaaaccaaaaacccagcaaguuccauaccccaggaacccccucaguuccaggcaaaccaggacagucggucacccugucagcagaacaggccugacagcacgcacagugggauguagggaaauggaaguguugauggagggaagaugagcuagcucuugaucauggcuuaauuuuucuuggugcacaaggcaaaaucaugaacugaaagcaagacgggagggaggcuggaggcuggaggcuggaggcuggaggauggaggagaggagcggagcagucaucuugaaaaagggacaggcgaauuugcuaagaaaugcagcagcauuuccgggcagugcuggguggcaacuugagaucuguggucacaaauuuaaagugacgccaguuugcgugagugugggguguguacucucugcaaagagccaaacugccagcauccuguuauaaucaacuuauuggaacagaagacacugcuuguuguccuggaauaugguuaaaauggauacauuguuagaaacacauuccuggucuguaggacuggcagauggagauagcagaagccaacucuuuuuuuuuuuuuuuuuuuuuugagacugagucuggcucugucgcccaggcuggagugcaggggcacgaucucgccucacugcaaccucugcuuccuggguucaagugauucuccugccucagccucccgaguagcugggauuacaggcaccacgcccggcuaauuuuuguauuuuuaguagagacgggguuucuccauguugaccaggcuggucucaaacuccugaccucaggugacuggccugccucagccucccaaagugcugggaucauaggcgugagccaccgcacccggccugaagccaacucuucugaaacuaaauuaacaaagcuccuccauccucaucuauuucuucuacuaagggcuauuaacaaugacauccagaccagucacauugucgaaacccuuuguaaccagauaaucaacugucacuccuucugcccauuuucugggcgauuuuagauaacugauccuuaagauuaggugauucaagaaguagcaacguguguggauuuagcguuagaagaucuggauuaaguuaucuaucuaccguuuaucaaccaggugccccuucaaagcucaucuaaccuguaaaacuuaguuucgucauaaaaauguggcuaaaaccaccugugcuuggcugcuuuugaggguguaaggacuucauaaaauauguaaaucaaguguccuguggcaaaggaacguugccuguugcuguaauuauccacagccugguucugggacagucuucaguaguuuccaguucuguagcuuucacaaauagagacagaaaacugcugauccacuggguguggccgcugagcuuugaauaacugucagugcuaaagagggcugaggcaggaccagagaguugagaugagaugggagggcggaggucagguggcggaggcccagcggguggagggugggcguugggguggggggacuguggugagagagggaaaguugggaagguaagacgcugacaagaggaguuccaggugccagcaggcucuagggugccaccuuaaaaaugagauugcugaaauaaugugccuugugcuguguuuuaaaaugcaggggccaagaggccauuuuagaaggacuucuauuuaaaaguuuaaaugcccaucucauaaagguuucaccuucagcuauucaggaaauucuucccuauaaaaugacucauuuauuccccaaggauuccacauggccaugguauuuuuuuccugggccaaccacaaagacaucaguuccuggaagauuguucccauuuugccgugaacuauccuguggaagguuguuuuuuuuuuuuuuuuugagaugucguuucgcucuguugcccaggcuggagugcaauggcgccaucucggcucaccgcaaccuccgccucccggguucaagugauucuccugccucagccucccgaguagcugggauuacaggcauacaccaccauacacagcuacucuucauauuuuuaguagagaugggguuucaguaugcuggccaggcugguuauggagguaauauuuuugaauucucaauuauggagaauuuaaaauccuuuuuaggaauuacuucuaaaauccuuaggcuuggcccuucucuaacuauugacucugacaaauggaaauguuuuaugaucucuagauugauuaaauuuagauuucuucuuaauuuacuuaaaaaggcaacuugggccgggcgcaguggcucacgccuguaaucccagcacuuugggaggccgaggugggcagaucacaaggucaagagaucgagaccauccugggcaacauggugaaaccccaucuguacuaaaaauacaaaaauuagcugggugugguggcacaugccugucaucccagcuacuugggaggcuggggcaggagaaucacuugaaccugggagguggagguugcagugagcugagauggugccauugcauuccagcuuggugacagggugagacucugucucaaaaaaaaaaaaaaaaaaaaaggggaauuuggccgggcgugguggcccacgccuguaaucccaacacuuugggaggccgaggcgggcggaucacgaggucaggagauugagaccauccuggcuaacacagugaaacccugucucuacuaaaauacaaaaaaaaaaaaaaaaaaaaaauuagccaggccugguggcaggcgccuguagucgcagcuacucgggaggcugaggcaggagaauggcgugaacccgggaggcggagcuugcagugagccgagaucggccacugcacuccagccugggugacagagcgagacucugagacgccaucucaaaaauaaaaaggcuacuugaagucccacucuaccacaugacagccaccucgucuccaggauaccugagaccacuuuaucucuggguccuaggggucuuuuguucuuuuuccuggaucucagcaguugauuccaccauccuuaucugucugcuuuccaaaacucacggcuugcucuccuucucuucugucacaaucugcucaagaaagguauuuuucccucuuuaaucauuuuuguaaagauaucacaaaauuaaaaauuuuaaucaauuauuucauacaacccaaaagcuguuugaaagugaaaagugaaggucaccccagccgcccccugcuacuaucaagucacgccaacugggccugauguccacacugccucuuggggagcucccccaggcugaaggcuuccaauuuugucuguggaucagggucuccaguccaucuccuggugcucucauccucccuuccuguggacauggucaugaaagucucucaucucagaugcagcgugucuccggaucugguuuuuguuuguuuguuuauuuuugagacaugguuucacucugucacccaggcuggagugcaguggugugaucuuggcucacugcaaccucugccuccccaguucaagcgagucucgugccucagccucccgaguagcugggauuacaggcgugugccaccacgcccagcucuuuuuuuuuuuuuuuucuuugagacggaguuuugcucuuguugcccaggcuggagugcaauggugcgaucucagcucaccacuaccuccgccuccuggguucaagcgauucuccugccucagccucccgaauagcuaugcccagcuaauuuuuguauuauuaguagagauaagguuucaccauguagacaaggcuggccuugaacuccugaccucaggugauccgcccgccuccgccucccaaagugcugggauuacaggugugagccaccaugucuggccaagaguuguuggugguacacacgucuaaagccacuauggacagacccuaaaugaccuguaagagggauuuccuauaugucgucuugggaaagauauuugaccucugugugucucaguuucuucaucugugacaugcaggagauuaggggaccaugaugccuuaaggcucuuuuguuuugacuauucuacgcaucuggccuccuucucaaugaauauuucugggcuuuuuccugcuccugucauuuucugcccagcagaggggcuuguguggagguguggaggucaggagaggggcauucaucucugggcuggcuggcugugugccucuccaucacugggcccuucuggacuuuaguuuucucuucugagaaaugaggggccagggcugugugagcuccaggagagugucugguccugacaucccaugauuuucaugacuuccucguccccagggaugacccucugaugcugaaggaacagucagcuuaggguaagugauggcugcuuucaguguagacugaagguuuugggcaggggagaggcuggagaagcaggauccauuuccagugcccugagucaguucccuguggucugauuugauuuuuucaugugaaguguugugaaaucucaaaauaucacccauguccacauucaacugugaguacauuuguggugcauuccacuaccaaguaugagugcuuuggggacccucuuaccugugagcuugggaaccccugcuccuugcccuuguguggggaguuuggagaggugcuggggugaccagccaucccaguuugcccuguaaacuguccugcuuuuagcaccccaagaggcucaucccaggaaaucccucaguccaaaccaagacagguggcaauccuaccuaguuccacaccagggccuggccagcuuucuuagugggacaggccacaguuaaacauagaauccagcagagcaguggacuuugaaacagcugggguacuuggggcaaauuccuaggucccacccuagagugucugauucaguaaaucuggagcagggaccaggaauucacauugaauaagcccuccaggugagucuggugcaggugguucaggaucuacaccuugaggaaacagaaccagcuccuguccuugggagcaguggaggaaacagagcuagcuccuguccacaagagguuuauaacacaggcagaagaagccagguagggaacuaaugaacccugacacagagugaaaugaaagcuauaaugaguacuggccaauuuuucugcccuccucccacccuccaaaguaauuuaguacuuacaaagcuuggcuuuguugauuauaaggggugacuuggcauuuuccagcagaagaguuguagggagggugaguuaguugcagaaagugacuguccacuccagcuuacaccagacucucccgucucagaaccguggugcacucuguacuguauccuguggccccucuggugaggggaucaagugggaccgucccuaaggcccacugaagcucugaccuucugacguggggaugaagaagugguccuguucuuauucuugguggacagcuaucaguucuguugcuuaugaacuaaguauuuucuuucucucuuuuuaaaaaaauuucagcuuuucaggcccagugcaguggcucacgccuauaaucccagcacuuugggaggccaaggcggguggaucaugaggucaggaguuugagaccagccuggucaacauggugaaacccugucucuacuaaaaauacaaaaaaaaaaauuagacaggcauguugccgggcaccuguaaucccagcuacucgggaggcugaggcaggagaaucgcuggaaaccgggagguggagguugcagugagcugagaucgcgccacugcgcuccagccugcgcaacaagaguaagacuccaucucaaaaaaaaaaaaaaaaaaaaaauucagcuucucuuuuagauacagagguacaugcguaggauugucacauggguauauuggacccaaguggugagcauaguaccaccaguagguaguuuucggcccauguccccauuccucccuccucucucugguggugacaguaucucuuguucccauguuuaugucuaugugugcucagcauuuagcucccacuuauaagugagaaaugugguauuuggcuuucuguuuucauguuaauuugcugaacuaagccuuuucguuccuuuuuuuuuguuuuugagauggagucuugcucugucacccagacuggagugugguggcuugaucuuggcucacugcaaccuccgccucuggguucaagcuauuccccugccucagccuccugaguagcugggauuacaggcuuguggcaccaugcccagcuaauuuucauauuuuguuuugucuuuuuuuuuuuuugaaaaggagucucggucugucacccaggcuggagugcaguggcaacaucucgacucacuucaaccucugccucccggguucaagcgauucuccugccucagccuuccgaguagcugggacuacaggugugugccaccacgccuggcuaauuuuuuuguacuuuuagcagagaugggguuuuaccauguuagccaggauagucuugaucuccugaccucaugauccaccugccucagccucccaaagugccgggauuacaccgugcccggcauacuuuuuguauuuuuaguagaggguauucuuuuguauauuuaguagaagauuucgccauguuggcuaggcuagucuugaacuccugaccucaggugauccucccgccucggccucccaaagugcugggauuacaggcauaagccaccgugcccauccugaacuaagacuuuucuaaggugaaucaaugagcuagaguccuuagggcacuucauuacugagaugauuugaagaguuccugaggucaggugacugcagguaaagggcuuguuuguucccugggcucauuccugcugacaaaggacaaagagcuggaggcaucccuaggagaagaaaggaaaggaaugaugacucucugaaccaccugcuccagacucagccguaggcgguggcagggguggggcuuauaagugugaaauccuagucucugauccagaucuacuaagugaucuacaggccuucagaggaggcagggcucugcugugggacaugaaguugaugggcucguggggugacaugccaccacugagauucuagggagaccagccuugaauggcagccuggagcuauggggccaagccucacaccuggccagggaguguccaccagggucaaacuggucugagagccaacccagccaacuggguugaaaucucagucauguaucugcugggugcucuugggcaaguuauuaaccucucugagugucaguuucccccuuuguaaaaugggguaauaauguucccuauguugucaguagauugaaugaaauaagcgugcaaacugccuaaagcauaaagaccgccuagcacagugcuugaccuguacuaagguuaaccuuuauuaucauuaucagccacagaaaguggcaaaggccaaugaugagggcuguauuuuuugcucaggcugcuguaacauaaauaauacagucugaguggcuucaacaacauauacuuauuuugucaccauucuggaggcuggaaguccaagaucaaggugucugcaggguuagcuucccgagaggccucucucggcuugcagaugcugucuuuucccugcguccucacaugcuuuugccucugugcuuguguaccccuggugucucuuugugugucugacuuuccucuuuuguuuuuuuuggagacaguuucgcucuuguugcccagccuggagugcaguggcgugaucuuggcucacugcaacuuacgccucccagguucaagugauucuccugccucagccucucaaguagcugggauuacaggcacccgccaccacagcuaguuaauuuuguauaguuuuuuuuuuuuuggggggauggagauuugcucguuacccaggcuggagugcaauggugcgaucuuggcucacugcaaccuccgccucccagguucaagcgauucuccugccucagccucccuaguagcugggauuacaagugcccgccaccaugcccagcuaauuuuucuuuugagauggaguuucgcucuuguugcccagguuggagugcaauggcgccaucucagcucaccgcaacuuccaccucccagguucaagugauucuccugccucagccuccugaguagcugggauuauaggcaugcgccaccacuccuggcuaauuuuguauuuuuaguagagacaggguuucuccauguuggccaggcuggucucaaacugccgaccucaggagauccgcccgccuugaccucccaaugugcugggauuacaggcgugagccaccacgcccggccacauuucuuaaggaauguggcuugggaggaauaaaaugaaaggcaaaaugggggagccagcacugcgcugccagucagcccagccuucaugggaucaggagacucucuuaagggggccaauuccuuuaaguguccugaagccauuucaggccuucuagcggagcuaguuggugcauuuccuuaagaaauguggccgggugcgguggcucaugccuguaaucccagcacuuugggaggcugaggcagguggaucaccugaggucaggaguuggacaccagccugaccaauguggcaaaacccugucucuacuaaaaauacaaaaauuagucaagcaugguggcguacgucuguaaucccaacuacuggggaggcuaaggcaggagaaucgcuugaacccacggggcggagguugcagugaaugagcugagauuaugccacuucacuccagccugggcaaaagagcaaaacuccaucucaaaaaaaaaaaaaaaauaaauaaauaaaaagaaaugcaaaucugagccuucaguggagaucacuuaaggaagguguggguucucaacuucuuggagccguuugaggaggggcuggagcagacaugggggcaggcauuucaguucccugcauaucccaugacgaguguggggagaucacucauuaaaugccucucacuccuuucucccucuucuuccucuucuccucccccucccacucuucuccccaucgcccuggcagaucuaucccugugaacccugaaaggcuggggguuucugggcuugacaucuccuuaccccauaauuuuggcuaaaggagcggguccccaggguggcauccugcgaaaauauugcuggaaugagggucagaaguuccagcucucauuaugaaacauuucaguuccuucaccuucuuauucacauuuuguguuguuauuuagauugguuuuucauaacuucuugaagaugggagggauucuuaguucuuuucuuuucuuuucuuuuuuuuuuuuuuuugagauggagucucgcucugucgcccaagcuggaguucaguggcaggaucucggcucacugcaagcuccgccucccggguucacgccauucuccugccucggccucccggguagcugggacuacaggcgcccgccaccacgcccggcuaauuuuuuguauuuucaguagagaccggguuucaccauguuagccaggauggucuagaucuccugaccucgugauccgcccgccuccgccucccaaagugcugggauuauaggcaugagccaccguacccagccaauuuucuuucuuuuuuuuuuuuuugagacagagauucgcucuguugcccaggcugcagugcaguggcgccaucucggcucacugcaaccuccgccucccggguucaacagauucuccugccucagccuccagaguagcugggauuacaggcacaugccaccaugccuggcuaauuuuuguauuuuuaguagagacgggguuucaccauguuggucaggcuguuccuugugauccgccugccucgaccucccaaagugcuggaauuacaggcgugagccaccgcgcccggccagaugggaaggauucuuuucaaauucuugggcagcuuugggaaguaauuuagaauuucugacugugcacacggcagcauguguugacacaauccucuuguugagauguguuccuagaacauagcccgcuaaauucagaccuagaauucaaacucuaccuuugacuuccagaggcuccucaagucacccaccccuuuugguggacugagacagccuugaaugcucuugcagcucuuacagacaccagacuggagccuucuugcaaggcaguggugcagugccaaguucagguccuggguucgaauccugguucugcuguugacuagcugggucuccugggguguuucuaagccucaguuuccuuaucucugaguugucauguuccugacacacaguaaguacccaauaaauuauagcuaaauuauuauucuuauuauuguuaccacucauuugacuuccacaauccaaauggggcugaaugucaugguuucuccuugaaccaggaugagguggaagagauuacccuugagcugaagucgucaucagggaagcugaugacgaguuaggcaagagcaguaaugauuagcuuuaaggcauugaugaugaaagaucagucugcauugugggauaaagcagacacauuccuuccgacgugccauggaggugaugguguccauuccuccguuaaugaaguauauagaugggggugggguuuggaggugggaugcuccugggacauacgacuuuguuuugggcagcagauggguguaggguggucauauuauucuugcaaaauuugcugaaacaccuuuuuuguugaaacagagucucgcucuguugcccacuggagugcaguggcuugaucuugguuuacugcaacuuccaccuccuggguucaagcgauucuugugccuuagcuucuuaaguggcugggacuacaggugcgugccaccacgacuggcuaauuuuuuaauuuuuaguaaagagaagguuucaccguguuggccaggcuggucuccaacuccugaccucaagugaucugcccgccuuggccucccaaaguguugggauuacaggugcgguaagccaccgcgcccggccugaaacaccuuuuaccaucucaccugucccauugugugagcccaggaagagcucagacucagggugcagagguugcugaagaugccugcugucaucaaucugggucaucccuaagcaugagaagacuuagauaaaggccaagauaaaaauauggcaugaacaugaaggcuugaaugaggccgucccugggugacugcucugacaacuccuuccuauucugccuccaaucacccauccguccacacaaccaauaauagcagcucguaagaaaccacaggaauccaacagaccucucagcccuugaccuguggaaucacagcauagacccucucugcagacaaugcaauggaauaggcugaguagcacgaguuccagagcgggacggccugcauccaguucuggcuuucucacugacugggugcacuuccuuagccucaguuucccucuugcugcaaauggagauaguaagccauguacaucacaguauuucuauaaggauaacaugagauuacaaauguaaacugccugacauaaaggaaguacuuaacaaauguaucuguuauugucauuacucucuuuggggugggauuugugcccugccaggcaggcuucuuaagauuaguuugcaggcugggugcgguggcucacgccuguaaucccagcacuuugggaggccgaggcagguggaucacgaggucaggagaucgagaccauccuggcuaacacggugaaacccaguuucuacuaaaaaaaaaaauacaaaaauuagccaggcuugguggcgggugccuguaaucccagauacucgggaggcugaggcaggagaauggcgugaaccugggaggcggagcuugcagugaggcgagauccugccacugaacuccagcuugggugacagagcaagacucuguccaaaaaaaaaaaaaaaaaauuaguuugcuaguuguuacgagcucugaagugccaucuauccuaugagauuaauuuuuuuuuuuuuuuuuuugagacggagucucgcucugucacccaggcuggagugcaauggugcaaucucagcuaagugcaaccuccaccuucugguucaagcaauucuccugccucagccuccugaguagcugggauuacaggcucacgccacuaugccuggaugauuuuuguauuucuaguagagacgggguuuuaucauguuguccaggcuggucuugaacuccugaccucaaguuaucugcccgccuuggccucccaaaaugcugggauuacagacaugagccaucgcgccuggccaauuuuuuuuuuagauggaagauuuuuuaucuuugagauaauccuauuaagcaaccauuucaaacaauuacuggcagccauccugccaggcugucagcugggaagggccuagaguggacauagggcgagugucugagaaugaggaggguccuggaugggaagcggggcuggaggagggccuuucucugacccgacauuuugcucuggucuuggguuccuaaacacauuauguuguugguuuucuuuaaacugaagucuuguuacaaggauugcuuugaagccaggaggcggaaguugcagugagcugagauuguaccacugcacucuagccugagugacagacugagacucgguaucaaaaaaaaaaaaaaagauuccaggaagaaccaacaucugagccugcccccugccuagcuuugggucagugacaucaucuccauguaccaaagaugggucuccgucucaucucuucuccucccgccuuggccucccaaagugccgcgauuacaggcgugagccaccacguccagccucuuccuggaaucuugaacugagcuugccacccaccuucucugcucguuaaaaauguaacaaccuuuuaauauuucugccaucagcaccuauugucuggugcugugcuagaugcccagaacgcaaaggcgagagaggcgucccagucugaaaguccaaugggccuagggcuauuggcuguugacugcucugcugaugacuuccucucucugguggagaagcucaaggaggguauugcaggcaagggagacggugggagcagaggcuuggaggucugacggugcauggcacuugcaggaaauggugagggacacggcacagcuggagcuguaguuugcaugggcuggcugauggugaagucuuaugucugggggcagggagcugcuggagauuuuuaaauuuuaaauucucuauuauuuauuuuaaaauagaggccaagggugguggcucacaccuuuaaucccaguacuuuggggggccaaggcaguuggaucaucugaggucaggagcuugagaccagccuggccaacauggugaaacccuaucucuacuaaaaauacaaauaaauaaacaacaacaacaacaacaaauacaaaaaaaauagccgggcgugguggugggugccuguaaucucagcuacuugggaggcugaggcaggagaauugcuugaacccaggaggcagagguugccgugugccgugagaucacaccauugcacugcagccuggaugacaagagugaaacucugucucaauaaaauaaauaaaguaaauaaauaaaauaaauaaaauaaaauaaaauaauaaaauaaaauaaaauaaaacaaaagaaaacaaaauaaaauaaaaaacagggucucgcuaugcugcccaggcuggucuugaacuccugggcccaagcgauccaccuaccucagccucccaaagcacugggauuacagaugugaaccacugcgcucugccuccacuggagauuuucacgcaggaaaaagacacgaguugacuuuuguuuuaaucauaaucauauucacagcaauuauaccuuucaguauugagcauuuucuuugugcuaggcaucagcuaagauacuuuaucgugagucaacucauugaaucccacauuacagaugaggcuaggagaguucaccaagcccagucacauaguggagccgggacgaaccaccacauuggaagaguucaauaaacguuagucauuguuauuuuugccaguauuuguuuucacgagcguccccuggcaugccagguguugggugguagcuuuagcuuugaaacugccuggguuggugccagugagcuggacuaauaaagccauuucaucagacuagggugaagaauagggugcacuaccagccucugccccugcucuccccgguugcugugguuauaagcugggcaccugguucucucuuggucgcuggccccucuccagcucaggccugggugacccugaucccgccugguguugccccacagcuggcucucugagguugccuccugccucccucucugguuucagcuuuucuacagcugagcagggggcagaccccacagguggcagggugcaggugagcuggagagaccaaggccagauaguuaugaaaagucuccaggggaggcaaggugaaggcuggaagggccccagccagggaacggaaggagagagcauagcugucagaaauacacuggauuuagacuugauagccuguggcaaacucacaccaugagaagagagagcaagaagugaaaaauaaacgcuacuuguagcucaaaugaccugauggcucugcguggugagccuuacccauucccagaacuuuauuauuauuauuauuaucuuugagacagagucucgcucugucacccaggcuggagugcaguggcgcagucucggcucacuucagccucugccuccgggguucacaccauucuccugccucagccucccgaguagcugagacuacaugugcccaccaccacgccuggcuaauuuuuguauuuuuaauagaaaugggguuucacuguguuagccaggauggucucuaucuccugaccuugugauccgcccaccucggccucccaaagugcugggauuauaggcgugagccacugugcccggccuucccagaacuuuaaauaccaucuguagguugacaauucccaacuccuugggcuccagccuugaacacugagcugccccuuucuucuucacuuggaugucucucaagcauuucaagcucagcauuucccaaauggaacucaaaguggagcuccaaaaugauuugccucccccaccccugaaccugcuucuccaucucaacaaauaguaucagcccgccugccuucaaacuagaaaacuugaguguuauccucaaugccucccucuuccucagcccucacauccccuugucagcaaguccuauaauuuccacauuggaaagacaucacaaagguggccaccucucuccaucucuaccgccaccacugcagguaguguggcgagucaccaccaucucaccuggacggcugugaguccgcaugguccaugaucuuuccucuuccauccagcuccacauuucagccacagggaucuuuuaguaacacacauuugauugugaauccucauauccgaugacuuccagccacacucagcauaacaaccaccaucuuccuguggcuuacaagguucuacgccagaucccagcuucaccugauguccccucuccucaucacucuugucccucuagccucacuggcuuccuuuugguccccacacgccaugucuuuccuuccucaggucuucauccaggguucaccaucgucgccacuguugggaaugcucguccuugccuuugcguggcuggcuccuucccauucuucaaacuucaagcuaaauguccccucucaggucacugcccacgaccugagagggcuccacaggcccucucagcauccucuuuagccagucauuucauucagagcauacacugaucacaacuuggaauuuuuuaguuguucaucuuauuuauuguuucucucccccacuagagugucaacucuaccauaccuauuggaacauagaaggugcugacagguauucacugaguugacaaacagguagaugaugagggcaugaacuucagagguccacgggggcagagggccaggagaacacugagauucaagaggugggcagaggggcugucaagcggacuugauaaggagggacagagggaggaggcaguaaccgagggaggagggcuaugucagcuugggaggcuuuucacuguggguaacagcaaaguuguccaggugauuagaugaaaggguugauuuuucucacagucuggguguucagcagcaaagcucugugucagugucaccgaggcccucuugccuuucuccuagccuugggcauuacauccucacaugaugcguucaaaggcaggagauagcaacagcguggaacagacguucuccucaugccucuuuuauuggugggaugugggguggugaugauggagggaucguccccagaagauuccugcuaaucucccccuagaucccacugggcagaaggacacaugcuugcuuuggaccaggggcugugccugucuuggugaaaucaaaaaaucucuuuccuguccuugaacaaacaggauucuuccagccaaggggagggaaaugccuuuugaguaaggagggaauagcgcuugccauuagcacauuucauaaggaagaguuuuucugcuggguuaauugaugcagggaggucgagugggaugggugcugagaaguagccccuagaugugacacuuaguggacuauguguggcccuugagagggcuguuuccauagaacggcugggcuugauugcacauuuuggcaggggagggggugcuuaggaauuacugggagaaguuuaggagauuaagggggacuaccaggaagccuaguguugaagguaagaggagagguggcaccaucacugggugcaggaggcagacauagggagaucuuuucaguuugggggagacuugauguuuauaggcugagcaaaaggagcuggugagagagaggguaaagauuuugaagcaagaugggauaauggauccccacguccugaaggaggcauggagguggcaucgagugcccaggagguggugguugucacuggaucaagcaggaaggcuuuucugagaagauucuggugccuuuugagacaggagggcaggaagguggaugacaaaacaugaagaugcccggccaggacagaucccccucauuuuccuuugugugacagugggcucauuuagagauugaauccaugaccuucaccucuccugcaucuuuguuuuaaucaucugauauaauagacucuuuagaaaaccccaguccacaucugcgugguugugcccugggaagucccgggacaaagcucacuccuuggguuuucuuguuuggacgaacggaaccacccaguauauagucauggguguggcuauuaugggaugcaauccagagggagcaggucacuuaacaaacagcacagagccaccagauccugcagagucagguggggagccagguggagggggagagcccugagcugggaagagaggacuugaguuucagguuccagguucagguccuggucaagcacuuacaggcuaggcuucuuuggcgcccuccgagccugugaccucaucugcagagggguggguuggcagcucuucuucucccuucccugcccauaguuauaaaaugugcugacuccuuguaggaaauuaaugaaaugccuuccugccccuccugcaucccucccuggggagccugccccugcucuguaccacccagaauaggaugauauuuuuguuuugguuugcuuguuuguuuguuuugagacagugucuugcucuguugcccaggcuggagugcaguggugugaucuugcaaccuccgccuccuggguucaagugauucuccugccucagccuccugaguaguugggacuacaggcacccgcuaccacgcccagcuaacuuuguauuuuuaguagagacaggauuucacuauguuggccagguuggucgggaacuccuaaccucaggugauuuggcugccucagccucccaaagugcuggaauuauaggcaugaaccacugcgcccggacuguuuuuugguguuuugagacagggucuugcucuguugcccaggcuggagugcagagguacaaucgugggucacuauagccuugaccuuccgugcucaagugauccuccccauucagccucccaaagugcugggauuacaggccugagccacugugccuggccaggauguuguuuuucuucaccauuaccccuguucucucacuucuggcaucuuuccuccuuuguuuuggggaaugauggcauggggcccagggaguaggauugggagccaaaccuuucuccuuuauuuauucaaaucguagcuauggaugcagcaaaaagcaaacagaaguuugacuagauauaugagcucaguauuccacaacauuuaaagcugguguguacuuacguaggaggcuuaaaacauaacauuagguuaaaaugaauaauagccccaacagaaaaaaaaauagugcauucuaaagaaguucuuagcgggaauguucagaagcuugguugguuugauugacaauagcucuguaugucuccuucucgguagcuccuuaaugcagaucucuguugcucccugacuucuccacugggucacguguggccaggugucaugagcauaauaucccuaucaucgcugucuggcagggugagaguucagaaggagucauauuugcuuuuaggucacccucuuuauuuauccagcacgugggguaggacugugaccgaaggagggcuccaugcacgucuccuguguuguuggaggagguaguguugguaaugggcgaggaacagagucguuuggucccagcaaagcugcuuccaucagaucgguccugccccuuggcugggcugccuggacuucacuucaucaucucuaaaaugagauuaaagauuguuucucccucaugggaaggcuccgggauucagugagcuuaugccuguuuaggaaagugucuggcacagggucacugcccuugugccaucacaucugcccagaugaaaucagguaaucagcugacgcacccggagugcccaucgcgcaugcgugcugugccccaugggaaaggggcgucagaugugacucugcccucaaggaauccgcaucuagcaggagaaagaaaaccggacacuuuggagauaaauagagagcuagaaggccagcgggacccccgcuuccccacggcgcggacauccuggagggcgagcagcugccgggcggggcacgcugucagccaacccugccuaaucuccuggcagacagagcugagagaaagcagaaucugguauucauugugcgguuguuucuaauuuccuucugcuuucgagauccucuucuaagggagaacaaugcccugaaugauggggcacaagcuuccuuggcugggcacccacccagcuguggcagaggccgggcacucacagggccggugguguuugauucuggccucugagaagcuccuccgacaguggguuuugguggcugguuugagucccagcccauagaacaaguccccccaggcucacuuaugaguauuaucuuuaaaauuucccuaucugccaaagaagaacgccuuuuguguuaucgccaggguuguuacgaggccggguggguggagggggcacugaaccucagaacucucuguaggauccacaucuggagccaagaggccgcucugugccaccacacuccccggaguguccaucgugcauuggagggggacgguguuggccucaagugcugcccucgcagcucccguucacagaccaugacugagaggacucucagcagaggacccuggggugacauuucuacugcuggugccucauaaggcuggccaggggcaggaggcccagggcugaguccaaggaauggggugggguuuccucauuccuugcugucuucauacuuggccuucuauuuguagauuucaguaauuuaucagccuuucuagguuccucuuucaucaccagaagcagaaugaaccuaacaugagaaacccacaugcauaaagggcugagagaggcugaggggcauuugaugaugacuuucaagucuauggggcuguaucgaggaagaugcuauggcaguggcaggugagagggugagugaggggcugcacagccccaagaggcccuggcaggguuagcugucuucaagaugagcaagacccagccgggcgcgguggcucaagccuguaauccuagaacuuggggaggccgaggcaggcagaucaccugagguugggaguucgagaccagccugaccaacauggagaaaccccaucucuacuaaaaauacaaaauaagccaggcgugguggugcaugccuguaauccuagcuacucaggaggcugaggcaggagaaucgcuugaacccuggaggcggagguugcggugagcugagaucgcaccauugcacuccagccugggcaauaacagcgaaacucugucucaaaaaaaaaaaaaaggccgggugcaguggcucacaccuguaaucccagcacuuugggaggccgaggcagguggaucaugaagccaggaguucgagacaagccuggccaauauggugaaaccccaucacuacuaaaaaauacaaaaauuagccgggagugaagugguggcaugugccuguagucccagcuacuugggaggcugaggcaggagaaucgcugcaaucugggaggcggagguugcagugagccaagaucacgccaccgcacuccagccugggugacagagcgagacucugucucaaaaaaaaaagaaagaugugcaagacucgagccaggucucccaggcuuaggucacccaggugcauccucauccacaugccauucucacuacaauuuguuuaauauuuuccuuuuuuuuuugagauggagucuugcucugucuugcccaggcuggagugcaguggcacaaucucggcuuacugcaaccucugccuccugggucaagcaauucuccugucucagccucccaaguagcugggacuacaggugugcgccaccacacccgguuaauuuuguauucuuaguacagauggguuucgccauguuggccaggcuggucuggaacuccugaccucaggugauccgccugccuuggccucucaaagugcugggauuacacgcgugagccacugcaccugggcaaauauuuuucucuaaauagauuuauugauuauuuauuuuugagauaggaucucacucugucacccaggcuggagugcaguggcacaaucacggcucaccacagccuugacuucccggccucaggugauccuccugucucagucuccuaaguagcugggacuacaggcacauaccaccaugccuggcuaauuuuuguauuuuucauagagauaggauuuugccaugcugcccaagauggucuugaacuccugggcucaagcaaucugcccgcuucagccucccacaaagcgcugggauuacaggugugagcugcugugcccggcccuaaagagauuuauuuugaaaaccuuaaucauuuaauuaaaaagaaacauuuaugucacuacuguaaaugaaacccagcauuuugcugacagacauugaaauaaguacagacggaacuguuaaaacuacucauucugucccuuugauauaaucuugaacaccacccauugcuuuguauaaggucucaguguauaaaucuuucuguaugauggcagcuccaugugugucugauggagauguugcaggggagcuugauguugucaaggaguagggugauuugcgccgacuugugaccccaccaaagaugcugggggugacagcccugcugccugaccaagggcuugcuggccccauauuagcaucucuaacaggggaggacgacaguggcugcuucagagggcucggugagggugaacugagcuccuggaggauuuauuuauuuauguauuuauuuauuuuugaggcuaggcucgguggcacaugccuguaaucccagcauuuugggaggccgagguggguggauuacuugaggucgggaauuugaaaccagccuggccaacauggugaaaccccaucucuacugaaaauacaaaaguuagcugggcgugauggcaugcucuuguaaucccagcuacucgggaggcuaaggcaggagaauugcuugaacccaggagguuuagguugcagugagccaagaucgugccacugcacuccagccuggguggcagagugagacaccaucucaaacaaaaauaaaauaauauaaaauauaaaauaaaauauuuauuuuugagacagguucugacucugucacguagguuggagggcaguggcuccaucacaggucacugcagccucuacuuccugggcucaagugauccuccugccucagccuccugaguagcugggaucacagguguacacgguaccaugccaggcuaauuuuaaaaauuuucuguagaggccggacgugguggcucacaccuguaaucccagcacuuugggaggccaaggugggcagaucacuugaggucaggaguucgagacuagccuggccaacaugaugaacccucaucucuacuaaaaauacaaaaauuuagccgggcgugguggcacacacuuguaaucccagcuacucaggagacugaggcaggagaauugcuugaacucaggaggcggagguugcagugagcugagaugaugccacugcacuccagccugggcaacagagugaaacucuugucucaaaaaaaaaaaaaauuauacagacggguaucucuauguuguccaggcuagucuugaacuccugagcucaagagauccaccugucuucgccucacaaagugcugggauuacaggcaugagccacugugcccagccacccuauaguauuuauaaaguguuuagaaauagugucuggcacauaguaagcacuuagcagaugugaacccccacuauaacuugggagauuuuggcugagggcccucaacuguccuggggaucugccuuuguggagacggggcugggauggacgcugccaggcucccucuggcucucugcagaucucuguuguucccugacuucuccauuuggucagguguggccaggcagcauaagcaucauuuccccccugauuauaggguuaaacuaagaagugaucaugacaggcgucaucaugaaauauccccacugcaaucgguggccaucucuguccacuagaggcucagaaacgggcucccagggauggacacuggcgugcacuccugggggcuugugggaucugugucugccguucccucuggccagccacggguuguuucuggaauggggcucguggcugggagggaggaaggagcugugggaagcaaucccagguuccuuggugggauuggaaacucugccucaagcccuggaauuuugacuuccuguuuggccuggcacuuguucccuaacauuuucggcucugacacauccucucccucccccucucagugucguuuccucaucguaaaaugaggggguugcacuagaucauaucuaaggccccugugagcuugagaaagccacgauucuaccucccggccacccccucacuuuucccucagggcccuugauuggcagugaguggagaggugggaagaaggagagaaaucgcaauagcugugcaucaggccacacgcaggauggccccguggcaaggaacuguccaguccaaaaugugaauagugccaagguggagaaacccuguuuuagggaaggaaagacagaagagaggagagacuuaaaagacaaaugcggccgggcacaguggcucacgccuacaauccuagcacugugggaggcggaggcgggcggaucacuggaggucaggagaucgagaccagccuggcuaacauggcaaaaccucaucuccacuaaaaauacaagaauuagucaggugugguggugggugccuauagucccaccuacucgggaggcugaggcaggaaaaucacuugaacccgggaggcggagguugcagugagcugagaucgcgccacuacacuccagccuggaugcuagugugagacuccaucucaaaaaaaaaaaaaaaaaaaaucacacaaaaauccaaaacaaaccaaaaagaaagacagaugcacacaugcacuacaaauaauaaaugguuagacaaaugauaaugaaaaggaacauuuagggauaaacaaaaugcauaggaaaaggguuuaugaaggagauuggacaaaguugccaggauaggaaggauguguuugcaaaguggccauagcugggcugggucgaguuuaaggugcuagcccuagaguacuaaccagcauucacuuuacagaugagaaaaauagggaaacugcccaggcgcgguggcucacgccuguaaucccagcacuuugggaggccgaggugggcggaucacaaggucaggaguucgagaccauccugacuaaaacagcgaaaccccgugucuacuaaaaauacaaaaaaaauuagcuaggcgugguggcgggcgcuuguaaucccagcuacucgggaggcugaggcaggagaauggcaugaacccggguggucagagcuugcagugagcggagaucacgccauugcacuccagccugggugacagagcgagacuccaucucaaaaaaaaaaaaaaaaaaaaaauagggaaacugagagggauggguguccaucccucuccuuccugguucacuuuggaagaugccaccucuguuaagggccgcuccugugggauuucagcaaugcagccaggucagcagugguaccuguugaugcuacacagcaaccuuaggauggcaggcugcauaguccaaaggcccaggaagucauuaucauaugagcauucucaugugagccggucaugauuaguuuuucuaugagaccuuugcuccucauugaaauaacaacaaaucaguugucuccacgccagaggaagauaccacauaaagcaagacuaaaaggagcagagaacagagaaggucuuccuggccuuagggaugggcaaacauuucuaaaacagaaugcaaacagcacuaaccacagaagaaaaaucgaugaauuggacuuuaucaaaauuaaauccucucuucauccaagggcaccauuaaaaaaaugaaaaggcaagccucagaccuggagaagauauauaucugcaauacauaugucugauaaaguauucguuucuaaaauauuugaaguacugcagaucaauaagaaaacuaaaaaugacccaauuaaaaaaaugagaaaaagaggccaggugcgauggcucaugccuguaaucucagcacugugggaggccgaggcagguggaucaccugucaggaguucgagaccagccugauaaacacggugaaacccugucucuacuaaaaauacaaaaauuagcuggacgugguggcaggcaccuguaaucccagcuacucgggaguccgaggcaggagaauugcuugaacccgggaggcagaguugcagugagccgagaucacaccacugcacuccagccugggagacagaacaaaacucagucucaggaaaaaaaaaaaaaaaaagagagaaagaaaaagacuugaccaggcacuaacaaaagaggauacccagauggccaaauacacugugaaaaggugcucaacaucauuauucaucagaaaaugcaaaugcgcugggaaauuagcugagccugguggcacaagccuguagucccaguuauuugggagacugaggugggaggaucauuugagccuaggaguuugaggcugcagugagcuaugaucaugccacugcacucuggccuuggugacagaaugcaaaagaaaaaaaaagaacaacauagacacacaaaacucccacaaaaagauacuacuacacacccaccauaauagcuaaaaugaaaagacugacaauaccaaguguugcugagaauauggaacaacuagaacuauugcauauugcuguggggaguguggaagagguacagccacugggaacauuguuuggcagauuauauuaaagcuauagauaugccugcuguacaacccagaaauucuacuccuaaguauuuggguaagggauuugggcugggcguggugguucacaccuguaaucccagcacuuugggaggccaagguggguggauaaccugaggucaggaguucgagaccagccuugccaauauggugaaaccccgucucuacuaaaaauacaaaaaaaauuagcugaguguggcagaugagugccuguaauccuagguacucaggaggcugaggcaggagaaucacuugaacccaggaggcagauguugcaguggcugagauugcaccauugcacuccagccuggcagacagagugagacuccgucucaaaacaaaacaaaacaaagcugagggguuugagugccuaugcugacaauaauguauguacaaaaauguucaaagaaguuucuccaaaccugaaacaccccaaauucccaucaacagaagauuggagaaauaaauuggugaucuauucauauaagaguacuaugcaaugaugaaaagauuauaugcucugauuccauuaauauaugguucagaaagaggcaaagcugaucuauaaugagucaaaucaugauucugucugguggggauauggauugggagggugcaugagggaacguuuuggggugcuggaaauauuccuuauguggccuggaguggugguuauagaaaugccuauuuaugaaaaugauuaucaagcuguccauugugugcuuuauguacucugaugaauguauguuauacuucuuuuuuuuuuuuugagacagagucuugcucagucacccaggcuggagugcaguggcgcgaucuuggcucacugcaagcuccgccuccuggguucacgccauucuccugccucaguuucccgaguagcugggacuacaggcgcccgccaccaugcccggcuaauuuuuuuuuguauuuuugguagagacuggguuucaccguguuagccaggauggucucgaucuccugaccucgugauccacccaccuuggccucccaaagugcugggauuacaggcgugagccacugcgcccggccuauacuuuuuuuuuuuuuuuaaugaaaagaaaugcagauuuucauguccaagagaaguaauaacaauaauaauuuauggagcacccaauaugugccugguugcuuuauagagauuauuugccuuaaucuauccaaaccaccugucaaaaugauauucuuuucuuguuagagaggaggaaacugaagcuuagagagggacaauagcuugucugaguaucacagcugguaagugugggaguuagacuugaaugccauauucugcacuguugccacuuggcuugggauguugagagugaaucuugguacagcaucaaagcucucuguguugccugcuacucccccggagcaucagauguugcagacaccauucuuuaaagagaacuucauugugugaaccccaaguucccccaccuucuucaaaacaaaaacaugaauugggaagcccagccccuuuaugaacccuuuccaugaauuuguuccaaucaggaaaagagccugcaacuuccuccccacccuguucauccuaacuguucuguguugugaauucgcugagaaugaaaggggaugggcuagagcugucaauacugugagccaggcuugaacuccagcucugcuccuuuuaaacagugaggcucuuggguaguuauuuaacuucucaaagccuuuguuuccuggucugugaaaagugacagugguacuucccuucuagucucacugugagaguuaaaugcggucauauguaagaagugcucagcucagcgacagguucauagcaagugugcaauaaaagguaguguagaaaugucaaaacuggcugggugcggccagccugcaaucccagcacuuugggaggucaaggcaggaggauugcuugaguccaggaguucaaggccagccugagcaauauaguaagaccccaucucuuaaaaagauaaauaaauaggccgggugcgguggcucaagccuguaaucccagcacuuugggaggccgaggugggcggaucacgaggucaggagaucgagaccauccugucuaacacggugaaaccccgucuguacuaaaaauacaaaaaaauuagccgggcgaggugacgggcgccuguaguccccagcuacucgggaggcugaggcaggagaauggcgggaaccccggggggcggagccugcagugagccaagaucgcgccacugcauuccagccugggcaacagcgagacuccgucucaaaaagaaaaaaaaaagauaaauaaauaaauaaagcuuucacuuuccuggugccuaauuccuuccaagccucuuaaagaggcuuagcaccuuugcccucuaaauaauucaacacacauuuggaagaaagaaguuaugugaaugguuucuucacaaaguguaacauauagugaauaaauggggcagaauugcaggacuucagcaaggaaaggggggcauuuugaacuagaguggucagauggugguauuauuuggcugagucuucaaaaauggguaggauuuagucacagagagaagaccaggaaggucauucucaauuagggggagggcaggagguaguuuuuaggagccaagguaaaguuugggaagggugagcaggugauuuugguuggugcuugaaacuuguguagggacuaguagaagauaaaguaggaaaggaggccugguuccagaugaggucccauuaagaaagcuggcuuuuuuuuuuuuuuuuuuuuuugagacagggucuugccauguuguccaggcugaagugcagugacaggaucuuggaucacugugcaaccucugccucccggauucaagugauucuucugccuuaguuuccugaguagcugggauuacagugugugccaccacacccggcuaauuuuuguauuucuuuuuaguagaggcaggguuucaccauguuggucagccuggucuugaacuccugaccuuaggagguccgccugccucggccucccaaagugcugggauuacaggcgugagccacugcgccuggcccgaaagcuggauuuguuucuguuggaaaaggaguugcugaacuuucuugagcgcaggagguguaagaugaagccuggggcaugcaggcccacgugggaggugagagagaccaggccaggaggcccaugagaggacaaccugcgcauucaugggaguccgauggggaugaguugggugugacucggggaggaggcacugggcugggacagaagauguaguaguuaggcucugggagacgacagggagggaaggugaagggccaugaagucucaaagccaguugcuuggguucaugaagcagaaaggguucaugaagaggaaagggaagagagaaagucaguuuggagaugauaaugaaagggauuucuuaauggcugaggcuggagguggcagcuguuuucacgguuccuaccuuccucuguuauuugaauguucuugggaacacacuguccucuucuggucucgggcuuguauggggggcaccaaaaggacagacucgggcuuuaugcaagcuuccuuuccacccuugccgcacagaaaccacacagagggaggcguggcaagaccaaaagagacccaacagcaggauccuuuccaaaucuaucccuuccagaggcaagcauuuguuuggaugcccuagcaaggaguggggggaccuucuuucaguuggugcaaaguuaacgaaccaucuucugauuuuauggagagaugcaaauaguguguugaauauaaaucucuuuguuguuguuuuacaggacuguagaagcggccaggaagaaaaccacccccucuuaagguuguuuuugugaccguucuuuggagcauuguucuaaaaaugggaaauuacauauugcugugccaagggcaacaaacaccugcaguuaaaggaauaccuuccgcgaggcggcuuuucggagcaugcauguuuauagcuccagccaggccagaccgagggcugcugcauaagcccugcuuggugcauuucuuuacuugcaaggggacagagugugggcuuagguuugggacuagagggggcuuuggcaacuauggugcucaggugauuauccuucgcucguuuauccaauaaacauuuaucaagcaucuguucuugugu

SEQ ID NO: 18743 - RNA, 5003 nt, Homo sapiens
ugauguuugaaauucaaguaacuuuauuuaaauucaaaaacaauucuuaaaacugcauuuagagucaagacccuuuuguauuauaaaaaucacaaguauuucuaagagacaaaaauacuucuagguuaacuagaccagaucugacuuuggacuuuauucuuuaaacaaauugcagagaauagagaaaaaaauagguuauuuacagaaaacaauaucuacauauguacuuagagguacaaauuuggugacagaaaagacuucaguauaugcuggcaucuuagaagcaguucucaaagagcuuaguuuuauuuucuugaauuuuaagaaugccuaagauccuucuucauccucgaucuugggagccaaguaguauuuuaagugucccauauccgcaauuuuauacucuacaacugaaagacaggaagaugguuaauuacugaggaguauguaucacauaugacuaccuacaaaacaagguucaaauuuauuaucuuaccaagggguacaucugcagacauacugagugucaccguugaagagaguggaguggcuuuuguaaagaaguucagguaccucagugcaaaaguuaguugaacugguucauucaucucuaugguaaccuacaaaacaaaagauucaucauugaaaaacaucaagaaaguugcaaucuauuagcucauuauauauuuauaaaaacccacaaacacuuguauuggucacuuuggagggagcuaugaaaauuuugaagacugauacauaaagcaaaagacucgauuaucuagcuugucuuuccuauagcuauaauuuagauaaccaaauuauauaauaugggaaagcuuuucuuuauggaaguuuuucuaauaagcagccaauaagugaauaaaacguauuaauuucagcucugcaaacucuaauuaaugacuuaauggaucuagacaaugacuauuauagcugcuaacauugcaaacacauccagacacccugugccuccuacuagaggcacacaccaccaccuauauucuugcucucucacccccgaaacaaaacacccugaauaucaaggcuccagggcuauagcuaccagucuguaggacacacaggguagaggaauuuauguauacacaggaaugcaaucagcaaaauccaaacucuggaaaacuuaauaaaugaucuaauuucuucaacaaauagauuguaauggaagggggaaaaugaaauuaggggaaaccaggcuagguguguuggcacacaccuguagucccggcuacuugggaaacugaggcaggaggaucacuuaagcccuggaguuugaggcuguagugaaccgacugcaccaccgcacuccagccuggguggacagagcaagacccugucucaaaaacaaagaaaaacagaaaaagaaaaaaacgagguuggcaggaguggaaaugugauucaggaaacagauaaagaaucagcuccuagacuuuauuaauuuaaaaaaaaaccuuucaacugaauuuuaccuuuauuuaaacuaaauguugacuacccauucaagggacaagagagcaauauauaguauuuauuguaagcuuauaauaugccacacacagcauaugcuaagcucuuuaaugcuaccguauuuaauccuaacaagguuaugagguuaggaccuuuguccuugauuuacaaaguuuuaauuuaugcccagguuagcgaguuuuuuuuguuuguuuaagauggaaucuugcucugucacccaggcuggaggggaguggcaugaucugggcucacugcaaccuccgccuccucgguucaagucauucucccaucucagcauuccaaguagcugggauuacaggugugcgccaccacacccggcuaauuuuuauauuuuuaguagagaugggguuuugccauguucuuucuauuuugguuaaacaagggcucucuagguacucucaaaguugcauggagucugcuuucuagccuuagugagaagucuccuuccuguuuaaccuuugauuccuacagccugugacuuuggcuaaauugucacuuaagguugcucagccugcuucuccaccuuuaaaaugggcuaccaauuggacccacaacauguaagcuaauauuaggauuacauaagugcuccaaacagguagacuuuuacuccuaaccauauccuucuauugagcugcuguccuaugcucaauuauuugguaagagaguaaguaucuccagaaagcuaaagguuauacgccuaacuucccaauccuacccuuaagagccgguguggacuugauccauaaaccacuguucugugguauguacacgugcugaauuuguauucccuucuugcaaauauaauucuaaauuggaugacacuuauaaaucauucgcagauuucaacaguaucucaauuuucagaaauuacuugggauccaauucugucuacuuuuaauuuuagcaauuaaccuaauaagcaguauuauaauucucuucaaacuauuuucuuuuuacuuaaaaacuacuuacagcuuccuccucuuuaucgacauuacuugucugugacaauuuaauguuuccauuuccaaguucuccacuugcagaaaauuucacuccgucuuuugcacaggaaauuacaacagcaucuccaauauggcugagaucucggcauauacgugcaaauucaccagaaggcaucuuuacuacacagcuguacuccuguuccuauuaagaacaaaaauuuuccaaaaguuaauuguuagaaauuuaaugauuuggcacccucacuuucuuaaaaggcaacaccuaaacaacucagaaucaauauuuucugauuacuuuaaaauaugacuugcguaauuucuuaacaaacuccacucaaaaaaauaaauggcuauuaaaugcaccauccagggaacaagagccuccuccuccucauccuccagggauaaaguaagagaacauuagaguauggcacagaaaucaugauggcgcaagcaggccuaacuacuuucuaaaagaaagcaagagaauauauuaggcauuuucaacauucaaacauuucuucucuccuuugguguuuauaaaccuaaccuggauaaauuucuuccaagucagcuuuaaaauccacuuaauaaaaagcaagcauucuagaaggaaacaaauuuuaaaagagguucauggaaguuaaugcaaauagacaacuggcaguaaacaauaaauuuaaccugugaguuuuagacuuguggugaacaacuauccaaauacuaaaaucucucuuugaaacaugcaccaguagauauauuucuagaaaaaguuguuaugaaguaggcuuaaauuauauuaacauaucuugacggaggaggaucacuugaggccaggaguuccagaccagccugggcaagacugcccccacgcccacacacaaaaaugaaaaaauuagccagguguggugggacaggcccguaguccuuccuagccacuuaggagacuaaggcaagaggacugcuugagcccaggaaucccagguuagagagagcuauauggcacuacugcacuccagccugggcaacagagccaagacccugucuguaaaaauaaacaaacauucuaugacauaacuaucgugccuguguacagcacucucuacaaugagaaacugauacucacuggaauuccaaguuguucaacaucuaaauccaucaacuucauuucauagucugaaacuuucuccuggucuaccaaaagaaagcagaugcuuuugagaaauacugacacagaguuuugauuuucuguagcuucgugacucgguaaaaagguacgacuuacuuggugcuucaaauacuagcgccaagguauccgcguuaucuucggcccuuaguguaaugauaucuucauugccggcgcauuuuaguauuuuggacauacuagaagacaggagacacaugcuuuaaaaucaacgccgucugcugaagggcuguauuucgaacgcgguuagaagggguuaccacucucacccaucaggccgucucagaacugguggaggguaagcggacugcuggaggaugccauuauuaaugcagacguuuugggacgcaucuggcaguauuuauacuaaaauaccaccagcagugucccuucuggauagaaacaaucuccugccacuaaguaggaugacaggcugccacauuucucgcaagggcauuauaaagcauuuaaagucaaccgcgacugagccgggaggaucgcuugagcccagaaguuggagaccagcccgggcaacacaccgagaccgucucagaaacaagaaagccacagcuaaagcguccauucaaggccaacaggauuuagugagcaaagagcccuggaacaguguuccuggcacugcggaaaaacccuugauuuucccgccaccacccgcuuugugacuuuggcgcgaaaaagcagguucgcgcagcagccagcgcgggcuuuuccgaaccgcgcgcucagcugggccccaccccacugcguggcaggccaaugagaaggcgcggauggcccacgccagccaaugagggcuaggcucgaaagcgcucccgccaagcaccggaggugcaggcgggccggggccggcuucccggggccgcgaggcucaccuggugagguucacgcccauggccagguugcggucgcagcgguaggugucgaagcccucagaccgcagggugagcugcaccaaagagacgugggacgaguccaugcucugcagguuuacaccgcuggagcuaauaucccagcaggccucguugaugagguccuugagugccuccaacaccuucuugaggauggagcccuggaccaggcgcgccucgaacaugguggcggaguggcaacaacgccgcuacaggcaggcgggaaggaggaaagucuagcugguuucggcuucaggagccucagagcgagcgggcgaacgucgcgacgaccggcugagaccuagaaagacaacgaccacucugcuacgccugcaaccguuu

SEQ ID NO: 18744 - RNA, 28454 nt, Homo sapiens
ccacugguggcccaagacacacagcuacagggcugggacugaggcgcccagucuucaugguaucaacagcaggcuugaaggaauauacuuuauuaaucuaccucccaaacgcuaaaaugccaaagacuaaaaugcuaacauucagcuaaauuaaaacaacuauuuacagagcacugucugcaggccauguggggcugggcccauuucuuccccacccacccacccagcccauccuccaaacaggccuggggccaccugccaccugcagcagaaacacccagcacagaggacguuuauauacaccuggccaagcccuccacaauggcaugccaagaaggagggcaacagaccaagacagagaccgacagacagacagauagacauggacaggaggcgaggcugccaagaaggccgcaggccagccucagugcuucuucaggcuguaggccaggcugcuggggacccuggcgcccugcaggggcggugaguuccagacagcagagcuggugcgcuugugauagcggggcuugcucuucuugaagauauccuccaaguccagugggagaaugguuccaaagagcuccagaagguucggugggugguaguacuggugaaugauagccuggcugagcggggugccugcaggagaccacagaccagacacugccuuggggcucuccaugaaccuccccaucccuugcccaccacagagcccugucacccucuccaaccucccuacagagagcucugucacccucuucagcccugccccugccuguaccaccaucaaacccagagaacgcccuugugucacauccuuccaaccuuccucuggcagcuuaaccuuacaaaguccuugagagcucgcaugagccaggcacuccuugaaccugucccgaccaccaccugggaggcagguucuguauucucccauucagcagauuugcccaaaggcauacagcuaauaauggcagagccuguguuugaagacaagcccaguuccagagcuuaagcauaggaugccauccuugaccaccuuggccagcugcuucucacagaccccacaggcccuggugcagugcugagggggccucugggcaguggaugugggaaggcacaguccugacaacggggcugaggaagacccaggggaucaggaggccagacaugcaccagcacuugcucagcaccaggugcggcucuaagggccagccgugagcucacucaugucacucucaacagaacuccucagcugggucuugucuucaccccccuuucacggaugaggaaacuauuuaaguaagcuguucaaagucaccuccgauuagauggcuuugcaagcgagcuggcuccugcucacugccaucucccaaaugacuugacacuaguaguuaagaggcuuaaagcacaugccaguuacuguaggguucagaugaggugaaacucacaaaaacaaguuucuguagugugccuaccagcuaugggauuccaggcccuucccucuggggcgucugcaccccucccugacuuccggcucagcaaccacugcaaggcacccaugguacccacgggccccauccacucuggcagcacccacuucuagcaccuacccugcucacucaagcuggccuugcacucaggccugagacauugcagucacgcucacccacauucugguuuaaugcuggggccuguaaacuccaggucagauccugcucaagugccucaugcacuccucaaggacuuuccugccuccccgagcuggcuggaagccccaggcuccagcuugguguucugccuaaacccuuccccauucuagcucugccucugccccagguggcuuacuuagguccaagucucuucagcccugcuggaugggacucuaaggaagggccuaguccaagucaggacacccagcagcauaugccaugcccaagcccagcacaauuucauauauuuguugagaacaaaggaacccaaccucauaggucugguccucaggaaagcacaaugaccacagggugccccacacuccccagggcacaugcauacccaaggcuagagccucgaacugccaacugaagcacacggcagccucccaacaccgcagcagccaacccacuacuuccagggcccucaaggugaggaccagggagggccugagucucccagggagcugugggcuuugcuuaccucgggcccagguggggaugggcuuccggggaugggccucaucaucgguggagucgucgcuauucagauccaucccguaguuaucuggguugaucuugggaggggcccugugcccuugcggagucaucugauaugagguacaagcuggagacugcaaaaacaaacguggccgucaguucccuccauggcauucccaucucucaccaccgaggagugcuggggcacugcucaccuccuccuauuucacaggagaaacaaaaggugcaggaucacuuuuucuuuuuuuuugagacagaaucucacugucgcccaggcuggagugcaguggugugaucucggcucacugcaaccuccgccucccagguucaagagauucucaugccucagcuuucccaaguagcuggauuacaggugugcaccaccacacccggccaauuuuuuguauguuuaguagagacuggguuucacuauguugaccaggcuggucucgaacuccugaccucaaguaaucuguccccuuggccucccaauaugcugggauuacaggcgagaaccacugcaccaggccuacuuuuuaauuuuaaaaagucacagaacacacacgacucuguaucuccuuuuuugaugcuaagguguauugcaaacuuucuuccaggucagugugucuagaauccuccugggaaccacuaaggagacuccaggauuugcaacguaaccauccaucauugacagauaccauacuaacuuccaaguuuuccacaucuuaacaaugcugcaaugaaaacauuguuuuguuugguaacagcagugaagugaaaauagaucaaaugcucaucaagaggagccggcugaauuccagcacaauuaagguacacagccaucaaaacuaagaaauugaccuguguugaaauagacagaugucuauaauauacuaagugaaaaaaaaccauggggguugggggccuggaaaucaagccaccaaaugguaugugcccauuuuaaauauguauguguaugggugaaagagagagagagagagagaggauaucuguguguguguuaaaaggguuacauaaguaaaaaucuagaaggauauacaacgcgcuuaguagaguuuuccugagggucccuuuuuuuaaaacuguauacucuucuauaaaguuuaguuccuuuuuaucccccaccucaacaaauucuacuuuuagaauaacaaagaauauaaaaagaaguaaaaacaauugggccaaguguaucuguccuuuuccuuaggggccuaacacagccugugccucuagcuacugggaagagaauagagugggccccuccaccugagagccucuccacuggggcccagguggcaccugcacguccacagucacauucagggccuugcuggccccugcugccuccuuggcuuucuucucuugcuccuccugcagcugccgcucagccagacgcugcugcucuuccuggaacccagguggcaaugggguguuagggagcugugcaggugcccuucccuccccuccccuucccuccgcuccauucuccucccuuucccuccccucccuaggcagccccugcugcaggaguccagacccgcccacagcucagggcagaccccaggggagcccgcaacccagcuccccucaccuucuucuucuucuccuccaguucccucugcagcugcuccuucugcagccgcagggccuucucccgcuccugcagcucccugaggacccagcaagagccuguuaggacaggaaguggaggcccagcccaagcccuguucccaucccugcuggggaaaccaggcccagccaguaggacacaccuuagaaagugggauugcugaaugggcaaccagcuuagagccaagagcugcgcuuuugccccggggcuagaagugugcacaccugagggugcagggaacacaagcuggagcccaacauuuggcccccacuuuuccuuguaacuugggucucugagccucauaacacuuuuauacaauggagaccauaacacauuuccuccagggucaacaugagaaucaaaugggauaauccacaauaccccuuuuuauccuaaccuucagggcagacacuggcuccaagcaugaacaagaggcuguggaugaguucuggagucaccuccacaacacacuggcucaugacuuugaacaugucauuuaaccucucuggaccuguuucccccugugugaaguggagcugauggcucccaugccaccaugggcuucaacugaggacuaaacaaggaaacagguguaaagcaugcagcucggguacccaccaaagcugccgacacuaugacuaucacaccgccacccucaaagcccccugcucugcccagcacccugcacauuagcuacacccuacgccuucucgccuucccagacucugcccagaggaccaaggacagcuuuguccccaucaagcagcccugacucagugcagcccccuggcugugacucuucacuuaucugauaaaccugaagccacccacgaagauggacacggaaaaaacgugcugcccgguguuucccaggagguagagcgggagagggaacagcuacggggccugcaugucucacacacacgggccuugugcucuacuucugugcacacagacacaggaucccauguaucuccugaccaacagugaguguggcuuuuccuccuuggcaaccccacgacucucagaacaaccaggcacaggguaggccagggacaaaugccuguaaaacuaaacauggaacucuugucuauuguacagagaccacugcaucugcacagcuggaaaaucccagggcuccuggguccacgguucccaaggcaggggaacagucugaaaauaucgguaggggguaaucugaguuaucguccucaccaggggagaugcauuuaguggggacaggggccaaggaugccaaacauccugcaauguaacacaaagaucuuuccugcccaaaaugcccaugguggcccugcugagaaauaucagcucauccucugagcaccacacuccugacaguuacaaaaagacaccuaagaggucagcacaugcagcuggaggcagaaccaagccaagcccuaagcaagcccaccuaucacuccuuggaucucccauagccaaugggcaguguauucaggugggccucuggguuuggugccaaggaaagcaccugcaaaccgucacaugcagguggggcuguguccaggcaagguucacaccgucucucuuccacacacauggaaggcaggcaggcgggccagcaggucccucaccucucggccuggagccgcuccugcucccgccgacgcuccugcucugccagcugucgcuccugcucgcgccgcuccugcucccgccgcuccugcucgcgccgcuccugcucgcgccgcuccugcucccgccgcuccugcucccgcugcucugccagccgcuuagccucggccgccuuccgcagccgcuccugcuccucuuccuucuucuucugcagcagcucuuggugccgccgcucuuccuccuccugaaacagagagcaaggucaggugcugcggccaggcccaggccagagaggcaggacagcagcccuacucccccgaagcccaggugccccucauaucagccaccaccacggacaacccaggaauggcgccgugggacaucccgagcaaggcucugccagaaccaccagcagcagccugaaaaggcaucuugugacagcugcugcugcuguagauuuagcagaaaggaaccucggagccaaacucgcuagcuaugaaacaacgggcaagcauuuaaacccucuggccuguuuccucgucuauaaaauggagacugcaguuauuccuacacuucaugggguugcuggguugauacgcacaacacacagcagggccuagcacacaguaaauaacugaccuuggugacuagucacauaaccccuaaugguggauuugccuucucuagaguccuaagacuggcugggaagaggugggcccuuacucuuauaggcagaacagucaggggguggaccauaacagcaauuguauagaacucuuagcaggcaucagacacuacugagcauuuuacagacauuaacacauuuaacccucacugcuacuugaagacauggaagcagagaggucaagcagccuguagaaagucacacagcuaauaaauggcagagcugagauaggcagucuggcuccaaguacaagcacuuaacccucaaauuacugcugcuacaggagaggcagauucuggucaccauccccgcccuggagacuucugggaaaccuccuucuuagcaugaagcaacaagauggucugggucaaccccacaagguggggugcacccaguagggccccauggugcugagacagcgcccaccccgcccaccuccucccugaggcccaccugugcucgcaccugcugcagccaccugagccuacgugccuccucuuccugcuuccugcgugcuuccaccuccuccaucuucuuggccgccgccuuuuucuuggccuucuccucugccagccgcuccuccuuggccugcagagcccacccacacaugcccauuggagcacccacauucaauccugcagaguggagcccagaacugugugugacaggccccaccugccccugcacaccuggcuuguucccaccacccagggagaggacaccagaagccgguccugccugagugucagaccccacucacaaagggcugccagggaaacccagagcugaguggacuccagggcccauggggcagacaggagauggguacagggguacagugacaaaucugcaauuuccugagggguccaguccuaacccuuggcccaaguccugaauugccugggccuccacagcccaggcucccaccuucucagucuucucgucgaucugagcaaacuucugcucaaucugcuucuucuucuccuccuucaucugcuccacccgcucgcgggccugcagcaccuugcggaggcguuccucacgcuuccugcggggcauaggauagucauggggagccccaccaaggcugggaugggccacaguccaggaagccaggccacuuacagcuucaccuccuccagccgccgccgcuuguccuccuccaccuucugccugcgcagcugcucggccuccuccuuccgccgcagauucuccaggcgcugccgcuccuucuccugggguggcggggagcgagggagaugggacaugagcaaggacgaccccccacccagccccaaaagcugcccacaguccccagcagccugcagccacguggguggcagcaucagaaugcuucuuaggcagagguauccccaacguggccccaacagcacccaagccaaggcccgcagcucccgccuuuccucccaggagcacucagcuaccucgcaagggccugagccacagugcccuccauugagcccugccaaguuuugggcaacacaaaagucaggcuccaaauaggauuuaugugcuaaugacaacuacauaaacugugcauugaaaaagaaaaugaaggaugagcuuggaagggugaggagcagaaaggcagcucucccaaucauggugaauguucuaguaaggggguggugcagaugcaagguuuaacuuacuacugucaugcuuuauaauauccauacuauauguauacauauauucuauuguguauaucaacuauuucauaauaguugaaaaaaauaaaaggaaauauugacaaaugcuaacagucuagugagauggauuagggaugguauuaauuuucuuuuauuuuccaaacuuccugugacauggcuaugcacuuuuuuuucuuuuuuuuuuuuuguguggagacagagucugcucugucacccaggcuggagugcaauggcgcgaucucggcucacugcacccuccaccucccagguucaagcaauucucgugccucagccucgcgaguagcuggagcuacaggcaugugccaccacacccagcuaauuuuuguauuucuaguagaggugggguuucacuauguuggccaggcuggugcugaacuccugaccucaagggauccgccugccuuggccuuccaaagugcuaggauuacaggugugagcuaccacacccagcuggcuauguucauuuuuaaggcaacuuuaaaaaaguacuaguuggcugaaaagcugauugaugcuggcacccccuccugggcagacacagaaagucccaggggcacagccacagcaaugggcagccagcagggaugggcaggggcucuaagcccucccuggccaaggacaaggcuagugcuuuccccuugaacagucuggggcuggguggaggcugggacccagagggaagccccacacccaucaccccaaccuggcucccaguagacucccaccuuuaggcacaguguccaauagcuucccccucuuccuguacugguuacuaucgauuucuccuuggcuucugagccuaacuggaggagcacucucgccuagaaaucuggcuccaagguaauaccauccucccaaagacggagagaaggggucccgggaacggguaagauggaguggacauacuccaccucucucucccacugaaugcagcuacaaaaccuggacagaaugcaaggagcggcuacuugaggccucugaaaacuaaagaggagcaggcagauagggaagaagaccagacuuggaagcaccagccaaccagcagugaguucuccauuguuuuucuccagccuaacucaacacagccuggaacuccaaaggagucacuggggcacggacagaaagaauuccaggacaagcccucuaguccugacucaagcagcagaaagggaguaucuaaugcucagagaaggcagaaaucccauuuuuguuuguucucuuuucuucuuugccuugugccccagcccacaagcaguccuauggcaaccaggggcagcagcaguugaagaaaagcugccaagucaaaauucgagggaggagcugugaucccaaaagugugggccaaacccuguguguugcucuucugucugucccccugccaggcgacccuggacagagaaagcugccaagucaaaacucagaggaggagcugugaucccaaaaguguggccaaauccuauguguuguucuuucccugucccccuggcagguggcccuggacacagucguagaagcacacaaagcagaacaagguaacugaagccccagcuuccuggcuggaggacagaaaagggagccccagaggagaucgggaaaaugaugcugcagguuauugacgaacgcccaggcucagcucuaagcugcagaugcuaggaucugauccuaauuaccacaccgaaggcugagaacuaaacuaacagaccaccugccaagucccaggcugacugcugacuggcacacacccgggaaaaguccaaacagcacugccaucuucaaaaucgggacuaacauuggaaccagaguccacagaaggcagaugggaaccugcagccuaaaccuaaccaggucaauugcuacuaaauugcaaugcugagaaaauaucaacauuguccauagauuuaaacaagacccagagacucauagcagaauguucaggaugcaguccaaaaugacuccguagcccccuggucuccuaacuauggacuguccccacccacuagaugcuuugugcagggaccugggauccccaaagcaggaaaggggaccacuuccuggucuucucuaucacccugugagaccugcagggcucuaaucggcacaggugguaaggccacuggaagguauacugucagucacccucuccaacaagaggggaacaggccuccaugcggagaagccagcucagggcccaccuggccagcugcugggaagccccucucaccugccgaggcccucaacuggaggcagaagcccucccggcugucacaggugucccuguguggcugcagaggacccuucagaaggcuugcaggaacuaaaggaaugaggugucuguggccuuggcaaauggcacagggagcuggggcugcaggcuaagcauguccccaucugaggguccuugcucagggccugccuggcucggcucagcucugaggugucugagaagagaacagcuucugcgacuuguuucuagacgcuaccacccacuguucuacugucacccagcacagcaagacccagcacuuccaccucaguucagacccacacuugcgcucccccaucaccccacugccucaaggcuacugcucaggucugugaaccaauaaaucucaguagcucuggggaccacagacaaccugucuguucucuucaaagacccacagacccugacggggccuggugcaggggaggagggagggaagguggcuguggagaacacaucaagcuguagcccuggugaaaagccacacccccuugcuuccuccuaagagcagagucaagggcagggagggcagagaaggacgcuggggcccagaacugcugggcgccuccagccagugcaccccucaccgucccacucucuuccuaaggcuccccucccgcuuacaauguuagugcaucuacaggugcugucagcuacgcagggaaggggcuacagcgggugagugcuagguggggcgagguuaccgacaggaaaaggcuuuacuuacgacgaagcugcacuguggaggagacaagggaaaaggcaagaguuaaugccaggccggggagcauccugccgggcaggccacaugcccagcugugccagcaagccugcguggggccugcccuccugccagcagcacccccaccgccucuccugucacccaacccucaccccagugguggagguguccacaaguaccucucaccuuaacuacacagauccccagggcucacauugagccggccaagccuccaggcuguaguccagagcccacaaggucaagugcaggacagugcccucagaggucaagacagccgguggccacagaggcuucaaccggccccuaacagugccaggccacacuugccuccgcccaggcucacacuacucccaguaucuuacaggacagacuggaccuucagccacacugcccagcucccacaaagcccggccugggcacaggccccucaccuugggguccaugcgcaggggaguguugcgcuuaauaaaggacuucaugacgcugcguggggcugaggucggggucaugagcaucugguuccucugcacugugugcagaaagguccggaggggccguaccaccugcagacgaggaccagggucagaagugggcaggcggggcaggguacugaagggggucagggcuccaggagagggcaggugccuggcucaccuugcuggcugggcagggugaggaaggggucuugcuccuggggggcugcagcuccucauccuccaggugcugcuccucguccagcucacucacggccugcuuguagcugcgcuuccuccugccaaggcgcgggcggcggcaucacagggcagcccgccacagcccagccacaccccaucaaaagucaccccggugaacaauaccgggcccaggccacaggccucuagacugaaagaggcugcagagccuaagcaacccucugcugcccacucagaggaagggaggugaacaguccaaggucacauggccaggagaccacacuaagacggggucaacaaucgggucgcccuauucccagguuugcgcucauccacagcauggagcugccuccuugguuaagucacaacaccaggccacaccccagcagagaggcucugaagccccugagcacacauccaccuucccugagcaaggacacaaggccacauccuccagggcccucagaguuaccuacacaccccuucccggaugcaaaccuggcacucugcgguggcucucuggguccaucugcuugguccgucuuggccucugugaagacagcaauuucagcaaggcugcagaaacgauggcggcggcagggugggaauggggguguagggggaagggguccuugggcagcagccuuggcagugggcaaggcucccuuccuggcagcuccgggguggccaaacgcagacauaucagccuuaacccugacuagccuugaggaaucuacaagcacuuugggaggccaaggugggcggauccuugaggucaggaguucagcaccagccuggccaacauagugaaacccggccucuacuaaaaauacaaaucuacagaugccagggccuggcuacccccagcucacgaacaccuccccgcgagugccuggcucuaugauaggcaaggcagggcgggacgguccugucgaggcggcagccccagacgugccccacccaccucugacacgaagaacaguguguggacgccuuguagaagcaggagcuccaagccccuugcacagcuucuaaauuccaccccuccugggccaugcagcugguguggcccugacagcaggagggggcagcucccgcugcagggucaacauggaggguguagggucaguauuguuuuguuucacugcuaggagaaggugcaccuuacuccaaaaguuccucacagcagcccuuggggcugcagggcuggcaugaccauugucccugaccacgucguaaagaggaggaggccguguucaagaucucacagcuacagugcacuuuccaccagagagaggcacccuucucagggagaugugagcaggacccugggacacucccaaacccacugcucuccagcccucuuuagacaaggauggacauacaaaggucagaaaggagcuggcgggggaggcaaagcaggaggccaggugggguguucaauccccagcccacagcucuucccacuggccccuggagucaaggucaaggccuugaccuggccucuucauauccauaccccgaugcagccccuuccucugcuuccugucccaaccagccacagccccccaugcugcacucagugacagcuccagcccaacggugggaggugaagucuacagacucaaaagggaucucugcacccccagguuuaauuucucuuuagccuacuggcccagaaaauggggcuuccuuauccccagagagaaggucaggccgaggccgccaaggcccgcuguggcuccgggcacugcacacggcaggucaggaagccucaccuugcugcccugcagaggguguuuccgggcugcuggcugcaggcuucggguugggugugcuguuggcaaucuccgugucauuguggggccacgaguuauuuccauuguucucagggaccuguggaaagaaccaaggcuuuaggggucuugaccuggaacccaaggcccaggauggccguagugcagagcgggagccccagaggugaguccucccuuccccaggcagccgucuuaccucuggcucagcugccgccacaggcucagccuccucgggggguuccuucugcucagaacugaaaacagaagagggacucugaggggacugcccagcuaguccaagcccucccccuagggagucccucuaccauuccagggauggggacccaagaggucaacacaaggugcccuggccagggccacgaacccacagcccccuguaggauaggaggauggcagcucccggcaauggcuccauggacagacgagggaugucagcuucagaauguggcuucaucucccuggcaccccaccacagagcugucucaggaugugagcccuguccucagcuccgccuccaccucuugggcccaggugagcugcaucucuuuuguggucuguucucuauucaccauggggcuggcaaggccagcaggucugcccugucacccuguuuccccgucccaagaacaaacccucugcucugcagcaaggagggagggggcugguuuuagugauggcaggacacggccuccaggaaaaggagucuguguccuggcccgaagcagcacuggguguaauccuggagcacuccuauccuaccccagccaguuugaauguagcucuuccuggcagccccgccucacccccaaccucuggagcccacgccccagggucaggucuagccaggcaaccagcaacgcugacgggugcugcaaggagaccagguggccaacacccacaucacucacugccuggucagacagggaaaacggggcagcuccugggcggucaaggcucaguggggaagacucagcccaggaauugcuuccagcccuggugcucaccuuggcucccuguccugguaugcccugccuaccuccgaagcccuggaacugaacucacccaacuuucuggggcaccucaacauucaggagccucuccagguaacugugaccugagggggaaaagaaaggcacaaaagaucucaucagagaccacacaggucccacucuaagggguccaggggaccggguuccagcaagggccuggccacugcucccaucacuagccguggagcccccaccaugcccaggacccuccccucagcacucauacuaguguccuuaucggagcugcuggcuucauguccccggcugcuucccagauggucuucccaugcccaucugagagcacggcugggcaccuucacugggcugggaauaucucgagaagagggacaauguuugcugcagcuccaggccccaaacucccagcauggggcccaacacaaagcagcuuauucugucaacaaauauucaucaagugucuacaguguacugggaccugggccaggccccaggaccccaauggugagcaaaacagaaccaccaucuggucuagauaacaaucaucaaauaguccuaucaacaacaccagcaugggcaaugguggaacagagcagagaaauuuuuuuucuuuuuuuugagacggagucuugcucuguugcccaggcugguguguaguggaacaaucucagcucacugcaaccacugccuccuggguucaagcgacuuccggcuaauuuuuguauuuuuaauagagacaggguuucaccauguuggccagucuggucucgaacuccugaccucaagugauccacccgccucggccucccaaagugcugggauuacaggcgugagccacugcgccugguccagagcagagaauuuuaaaagccuaugauggggggaccugagcuggccuggaggaguuuacaaaggaggaggauguccaggccagugguucucagcuugcauccucugacccuuggacguccuugagacccaugggggauccacgaggucguaacuaaucaugauacuaaaauuaugauacuaaaauguuacuuucccuuucacuauguugacauuugcccugauggcacaaaagcaaugaggaacuagcugcugaagccucagccccagucaaggccagagcaucaaacacuauccucggaccacacacucacgggaaggagagauguccaguuucacugaggaauguccuugaugaagguguaaaaaguacuaauuuuuuuucuuuuuuugagacagacucucacucugucacucaggcugaaugcaguggcgcaaucucagcucacugcaaccuccaccucauggguucaagggauucuggugccucagccucccaaguagcuggaauuacaggcauguaccaucacacccagcuaauuuuuuauauuuuuaguagagauaggguuucgcuauguuggccaggcuggucuugaacucguccucaagugaaccaccugccucagccucccaaagugcugggauuacaggcgugagccacugcgccugcaaaaguccuaauuuuacuaaaucuaaacucaaguacaugccauucuacucuucugugugcugaggugggaagugugcacaaugccuguugcugcaaacccaacucucugugaaaagcgcucgucucuaagcugccagcugcacuagccacuuuuucaccugaaccacuauuauuaauuaaaagaacgacugacaaugguuauucagucuuggguaucuggaagacauuuuuucacaagucaaugaagugaauccaucacaaaaauaaaacaccacgugcugacaauaauuuaaaaauugggccaaggccgggugcgguggcucacgccuguaaucccagcacuuugggaggccgaggcgggcggaucacuaggucaggagaucgagaccacggugaaaccccgucucuaguagaaauacaaaaaauuagccgggcguaguggugggcgccuguagucccagcuacucgggaggcugaggcaggagaauggcgugaacccgggaggcggagcuugcagugagcugagauugugccacugcacuccagccugggcaacagagcaagacuccaucucaaaaagaaaaaaaaaauugagccaaaacgaauccaagaguagaauuuugaaaagcgcguauccaccaccagcagggucacagcauccuaauaucuaaggacuuuucugaugaggucagaaaacaaaugugcuuuuuuaggauauuauauaaugaagggugucaacacuuggaagacgugcauaacuuggugaaacaauauuuucgaaaugaucgauguaugugguuaugaaaucagacacaucuaaaagauccauucaaaguguggccaguugugguggcucacgccuguaaucccagcacuuugggaagccgaggcagacggaugauuugaggucaggaguuugagaccagccuggcaacauggugaaaccccgucucuacugaaaagacaaaaauuauccgggcgucggugggcaccuguaaucccagcuacucgggaggcugaggcaagagaaucacuugaaccgggaggcagagguugcagugagcugagaucgcaccacugcacuccagccugggcgacagagugagauuucaucucaaaaacaaaacaaaacaaaaaaaaacaaaacaaagugcaagguagacccguguggaaucagcaacaugguuucagauuccacaccacaacaaaccuuuaagaacuaccacuucuugcgcugguccugauaacaaagaauaugcauaauuaucugaaaaagcuaugaagauacuccucccuuucccaacuacacgucuaugugaggccagauguucuuuagcuacuuuuuuuuuuugagacagagucucacuguaucacccaggcuggagugaaguggcgugaauucagcucacuguaaccuccaccucccgguuucaagcaauccuccugccucagcuuccugaguagcugggacuacaggcacgugccaccacgcccagauaauuuuuuguauuuucaguagagacaggguuucaccauguuggccaagacagucucaaucucuuaaccucaugaucugcccaccucggccucccaaugugcugggauuacaggugugagccaccucgcccguccaguucuucaguuacuuuaacccaaacaacacaaugcaacaacagaucaaacgcagaauguggcuuauuuaaagucauacaauaaagagauuugcaaaauguagaauaaugccagugucuucaguacauuuuuguuuuggaaaaguuauuuuuucauaaaaagucuuaauguaaacaggugauaggcuugguacuugcauuuuauaauguuaaaauauuaaacaauauuuuuaaaucuuuaaaguacuaaauauucauauaaaaauauuaauauuuaaaauacuuuuaaacuccucaguuuuaauuuuuaauacaguaacgaucaauagauauaaccucauaaucaaagcuuuuuuuuuuuuuuuuuuaacagagucucacucugucuggagugcaguggcacaaucucagcucagugcagccucgaccuccuggguucaagcaauccucccaccucagccuccugaguagcugggacuacaggcacaugccaccauaccuggcuaauuuuuuccauuuugguagagauagggucuggccauguuguccaggcugucaaaagcuuuuugaggcugaggcuuaaucauuaaaaacaggaagcccaggucccucacccucagcacucacccugguauccucaccacagcugcuagcuuuauguccccggcuucuuccuagcugggagcaugccuguucccagugccacuggucuagggagaaggagggccaaggccaugaggcaggaaaaaaagaggcuuuuuuggggaacagagagaagguagcugagcuggcgcauccugagccaugggggcuuggucagaguucaggcugggagguggccagcgggagguuggggugcacagggucucaggaaaagagggaagacagcaggccaggcacagagaagggaagccaggacccuuccuggguauagcagccagguuuggggagguggugggagcagcugcagcgccgggcugacagucauggguggugaugacccccauuuaagggguuuauacccagaagauacauccuccucaucuccccaugcugugucaucccagcucacgugcucccugaugaagacgcccaugugacuacauggcucucccaccagcacaagcauucucuggaaugcuaagugccaucugcacgacauucaggccucagagcuggucuggugguagggaaguggccuaagcacuggcagagggauggaaggacuguucuccaaugcagagguggcucgaacgccccaagguggaguccugaggcagugggccugucccuuccuauccacuucagaacugcugcccgaugggccccgcaggcacgugcgcaccaggccaggaggcaggggauuccugcugacacacagcaguuccacgccccggggccacacucuggcuuccagaagcccccuccacccacgcugacugcuggcuuuuuuuccuaucucauuuuuccauuccucuggugcagguguuuccuucccaucccgaauuuaauuuuugggaaauuaaauuuguuaauuucccaaaaauuaacaaauugaacucaaauccuugugucaagggcugcucguggggaacacccaaaccaagaccccaccuuggagcugcccgagagccucucccagagccugguaucaggaagacccccaggaagccuccuccccugucaccgccccacucccugacacccuugcagcuccucacuaggggucggccuugucgcacccaaacugagcaucagccauuggugaguuuucucaaauaagauguacugaguauccacuacacucaagcacuaagaugaguuaucuauucacauucaaagcaaguguuaucaccauuucacagaaaagcugagguugagagaaggggugugcccaaggucacccagggucugugugacuccagauccuagauccuguauccuccucucucuccuccacccccucaagaggagagaugaugcugggcugggagucagacagacccagguaacaugcaccagucaaaucagaagcccauucaugggcagggaaaggguagacagagagggaagagugauggaagggcaugagagcugcagaucuggaugucugcuccaaaggucuccagagauucucugcaacccugccuggcccucccucuacaggcccaggcucaccugcccccgcuugaagccccuucccaagaucagauccaggccugagaaaaucuccaaaacagaucagaaccauuuagauccuucugagaauccagaaauagacaguguggcagacugcacaucugcacacgccccagaguaugucaccccaaacccuggagcaggcccguccccaggcagugugacucaggcagagagaaagcugccaaggugaggugcccuccccugccugacaggcccugcccugcggccuugcacaaagccucuucugcaagcaccugacuuucuggacagaaugaaacacacagcgcucaagccccagcuucccgauuuacagacuccauggccuccuuaagccucaguuuccuccucuguaaagugaaaaauuccucacaagcuaacaaugcugcuguaaggaccaaaugaaauaaccuuucauuuuauaaaucuuaaagugccaggcagaugccagcuacuauuuaacaugcguugagauaaaaccugggcugggcgcaguagcucacacuuguaaucccggcacuuugggaggcuaaggcgggugaaucacuugaggucaggaguucgaaaccagccuggccaacauggugaaaccccaucucuacuaaaaaacaaaaacacaaaaauuagccuggugugauggcgggcgcuuguaaucccugcuacucgggagacugaggcaggagaauugcuugaaccugagaugcaugcagagguugcagugagccgagaucgugccauugcacuccagccugggcaacagagcgagacucuguaucaaaaaaaaaaaaagauaaauccuggccuauccucgccaccaauccgcugcuuugcccguccucugccugcauccuuacagcagccuccuaucuggucucccuguuucccucacuuucccaucaucaagccacuucuuuugcuucaguggggucaaguucaagcucuugugugagcaugagccccagacacccaucacuuguugcuuuaggcaucagggucuucguacaagcuguucccucugccaauaacacauauccccgcauuuuuuuuccacucagcaaaagcgcagccauccuucagaacccucccagcucagauucaccuccucaugcagccagccugccccuccagacaccugcuccagugggcaauggcccccuaagcugagaucugagagagcagcuaacauuaccgaguccuuccuauaugccaggcacccuucuaaacucccuguguggggugaccaaagaaaaccucacaacgacccuuugaagugacgcgauuagccccaguugacaggcaaggaguggaggcccgugaaguuuccaggaccugccccaggcugcagggugggugaauggcugaguuggcacucagacccaggccggccagcuccagagucagcuugguucccccuccuggcucccaucagaugcccagucaucugaucuccccgaaggagccugcugccauaauucccuccuccagaucaaacacagugucgccaauaggcggcgcgcaaacccggugaauuuaaguggccucugcagcauaggguugggaggaaugagcuggcccugcggaagaggcccaggcuccagccucaacauggccaguaaccacagccacacaguggccgaccuucccgaagcucaguuuccucacuuguaaagcaaguagguugggucagaccugcaccauccaacguggaagccacuagcuacauguaacuauuuaaaucuaaaagaaguagaaugcaauacaauuuaaaauucaguuccucaaucacacuagccacauuuugaggacacaaucgccagaugaggccagcuagcggccaccaucccaggacagcacagauguguaacaucuaccucacugcagaaagcucucuggacagcuccuugcuagaugaucccucagaaagccuccaucugagccuggcaccaaggaccacccgccacugccaagcccccagacucacagaugaugcggccagaggcagcuggcucuucggcagucuucuuggcaagccuucugcucgcccugcggacaacacuuuccuguuuggccaccagagaguacuucugggcuaagacuuggggacucggggaagacggggcgaucgggcugugccgcaccgauugagaguccgugcgagagcccgugggcguggagaaguuauccggcaggaugggagccagcacccgcucccgccauggagaaucuggaaaggcuggcgagucccgugggccaggggagaccugcgcaauccugagcuuagacgcagaccgccccgucccgaccccuugacccuugggguccugggguguagccaucagggagcucacugugauggacuccaguauccuggccuucgacuucuuagguguugauuccucaucugaugucgggaugcccugggagguuggagcuguggcugaagcuggagucggggacagagugcggggcagaggcucgguggacaugagcugggugacaugcugcucagcauucuggcgcucacugaugccgaucuccaccacaggcaccagcuggcacugggugugguuauccucgggcuucuuagucagcaucgugggagacucaggggugggugaagaaggugcagccaaugccaugguagccgcggcagcugcagccgcagcacgggucacacgccgcaggacggagccguucuccccgaccacuguagccagcuucucuacacuguccuugcugcggaggcgucgggagcucagcuggcugcuccgagacuuucugcgggauaaccuggcaggggcagcagggcagaggcugagacgggcagcaggacaggguggcacccagucucuccaagagccaccagcuuggauagaguaugauaagagaaggugaaggcaaaagaucuggguuccaggccagauucugccaccucuagccaugaggccccaggccauucuugucugagccgcagucuuccuaacuguaaauuggggaucaugccacaguccgcacagaacuggcuaggaagauuauauucauccaaaccuccggcugacugaaguuacaccacaccgagccccugcugaaagccuuacacacgcucugccuuaauccagagcacgcccuugagaggcagagaccacuauccccauuuuagggaugaggaacggaggcucagagaggcagaaauucaauucaaagccguacugcucugcuaaggggcagagcugggguucacacccaagccuaaccccaagacccagccucuuucccuagcacucugcagccccaaucauuccugagggggacuaaaacaagcaugacaauaugacggcugggacaaggcacguggucuacaccccuggucacacucaccuaacagaaggauggcuucucuuucucaucccaccuacggaaaucuuucccauucuccagggcccagaucaaacacacccacccccaacacacagccacagauuuggacuccagggucuugggucaagcuauaguucccuguggcaucccaaccccucucagcauggcccacgcaguacccgcggugguacccaccaccccuccuacaggcugcuacuuccaaaucaacaccuucagaaucaaacucccagauggcaccaagccuccgcagagcccacugcucagcucacucucccccaaccccuccuaccuucuccugaugggaucucuguuuucauccugaacauaagaaauccgucucuucuuccgucgguucuucugagaagguguuuugggcaucagcucuggcucuuugcugaauucucuguuuggcacaaggagggugucacucgaggcugccugggaaccacugguccccucucccacccagccuggccccugcccauuuccuggcagcgacaggucaagcugggguguccagcaccaagugagcucuccaaggccaugugcaagucaccugcgggcacucagggcuuccuccuggagacacggcagggaagcaagcucccaggcgcacguccauugccacauacccugagaggcccagccagcaacgauggcgaauaggcaagggacuggaucucuccugcugccucuucccaugacacuaggucaggcccccagcacacugcacacacaguauacagcagggagcccugacaggcugucuguuuugccagguaggcggggacgaggggcuguuguguccccaagaccaaagcagcccagacaggcccugguguucccagccucucacugugcccgucuucaccuggugaacaugcgcucggccuccucuuggauuuccucaagccacaccaaguccuuauuauccauguugcagagaaacuccaugagcuucuggucacauagcuccagcaggugaaugggcccuggggccgucguccccaugguggcucugucuggugaaggcagggacaagaggcacaaguuaggggcccaggguaggggucuggggcuuucuccaagcugcaauacccaccugacccacaaccaccacaaacacccagugcccgaaccagggccccucucugcucacagccacuccccagagcugcagaauuccaaacacucauccccuagccucaucucuacaaagagaagcccuucuacucacacucuucaaauaccucccuguccccacccccccgccagcaugacuguccccauaaguccacaguucccaaccaauucugacauugacaguccuccuuauaaauggccuuuucugggcuuaagaugacagggcacugccaucugucuuccuggccaccccagggccccucacucccugcccaaacacaguccugcucucgcucuccaguaggcccucaucuuacuacucaugguuaagugagggcuaagacacagccacccugcacuacauacaagcugacuccagacaucaggccaaagaacaucaaacccaacugccucuuuaagaggccagugagcagaagagauucuguguuccaaaggaaugagugagaaaguagugauccagagauaugcccucaaggggccucccacaacccucucccuugagcugaaaugcccuccaaauggagcauaaauagaacaagaagggaacaguaagcaauaucuugcuuuuaagaaaacuugccuacaagcauugagcaagagaaaacacaaaaacaguuuuuucucacuuucuuauaaaacuagcagcucagguauccuccuuaaaacuugauaaccagccgggugcagugguucacacccguaaucccagcacuuugggaggccgaggcagguagaucacaugaggucaggaguucaaaaccagccuggccaauguggugaaaccccaacucuacuagaaauacaauuagcuggucaugguggugugcgccuguaaucccagcuacuugggaggcugagccuggagaaucacuugaacuaaggaaguggagguugcagugagccaagaucacaccauugcaccccagccugggcaucgcagcgagacugucucaaaaaaaaaaaaacaaaacaaaaaacuugauagccauuacaaaaacuucaagcaaggaagaaguacaaucagcccuccauaucugugaguuccacauccauggaugcaaucaaccaccaguggaaaauauuugaaaaagagcugcaucuguacugaacauguauagacucuuuucccuugucauuauucccuaauaauacaguauaacaacuacuugcauagcuuuuacaucauauuagguguuauaaauaauauagagauauaaaguauacaggaggauguguguagguuauaugcaaauacuaugucauuuuauaucagggacuugaacaucuguggauuuugguauccaaaggagguccuggaaccaauccccugaggauuccaagagacaaccauauucuacuacaucacaacaggggcucauuaaauaucccaacaggugaaugagugaaagaacaaaugaaugggugguggucauaagccauaacaacaaacugcaugccucaagucaauggcagugauccaccauccugacuuaccucuuuaaaaccaagaacuggccgggcacgguggcucacgccuguaaucccagcacuuuagaaggccgaagugggcagaucacgaggucaggaguucaagaccagccuggccaacguggugaaacccagucucuacuaaagauacaaaaaaauuagcugugugugguggugcacgccuauaaucccagcuacucaggaggcugacgcaggagaaucgcuugaaccuaggaggcagaggcugcaaugagccaagaucacaccacugcacuccagcccaggcaacagagggagacucuaucucaaaaaaaaaaaaaccaugcacaacucagccucccaccuacaauggaaggucuuguaaggaagggauaaauugcugaccccuugaucccucacagggcguagcaccaggucagguuucagucucaugggacuuccucaggcuugauucaaggacacaguagucuuuguuccucaacaagcucugcccugcgucuggaacauugucucacauuuuguauggcucacuccucauggcuuggaucucagauccucaggaaaaccugaaaaccaaucuaaaguagccccagccaugaucccauucauugauuguaauucucugcagagcacuugcgugcuuguuuaccuguugcuuacugccugucccugcccacuaaacaauugcucucugagggcaaaccccugucugucuugcucaucguugaaugcccagagcacagcagugccuggcaacaaggacuauuuguuaaaugaauuaauccacccaucaacucuacaccuagaaauaaacauccuauaggugcucaucccaccacacaaagggcaccaaauaaacuuaaucugcacagguuagaacugaccaacacauguucaaaaccccuguucccagaugccaagggcagcaauaaucagggcagggccaaaugggcaggaucguacaggcuuugggcugaaaccucggcucugcagccagccaaucaugggcaagcccuuuucacugucaucccucaccuuccccuaacccuucugcacccagaccacagcccuggcaaagcgcaggaccucaggccagaaaagagaaaacuguuuaaggaagccaaagguuugcagagaaaagcaacaacuggcuaacuuuuuaaaaaguauuuguucaaaugggcaacguggaugagagcuucuuucacaaaguccaugaaagcaauuggacuucuuucacggggagguuugcuucuagcagaccuuagcgcaacgauuuaaaaaggguuaccguaaguuaaaacagaggugacccugaaaaagaaggaaucaguguaccaagaaucaggcuccuggaagagcagcaaaaaucucuucuucaacccauguaagcaccugcacacagauaaagagcacucaacaccucaccgaggaagacacucuccagucuuccuccucuccaacacuucuuccacaccauacaccagacugaaggccccaucguccuccucuaugacuccuguccuuuucagggugcuguaaguugggcgccuaccacaccucugugcagaaagcgcauagcagcugcucccauuuacugagucauacuccaugcccgagucagacaucaucucauuuaauucucaccacaaccuugaggauacgcaugggcagaugaggaaauugaggcaaagagaagucaaaaucagccgguaaaucaggggcauaaauagaaccgugcccuuaaccacgggcuauaccgccuuuaaaccgugcccuuaaccacuggcuauaccgccuucuagauaucaacuucugaaaggcaggugcccagucuuggcucugggcaaccccgcgagcaacccauguuagcugaaugagacugaaccgcugacagcgaacaggcuuggggagugacaaggggcggcccagccuccggaaauggucaguuuaaaaugcugcucagcugggggcgggggcguugagagagggguuuaacugcacagaaaugccaucuggcaucauuccgccaaacaaccggguugguuucgggcuuccugcgcguccaagucaacacuaauccucacaggcacaaggugccaagcagccgggagcggagggaacggggcuaugcucuaggaagcugagggccuagguggaaagggugggaggcaucucgggcccgagaaccaaggcaggcgaccucgccacuuggaagaggugacccucauaugcccagguagccaggggcugggguggggagucacgacccugguccggagucgacagggacggagcagaggaccggggaaaaaaucgcgaaccaccccccaauccccacgcccacgcgcacucacucgacugcgccacguccccugaaggcugcuccgauccaaguccggugguaucccuagguaaggccccgcuugcccagacccacuuggcuccgggccuucgggacucaccgcacgggaggagcaaccaggcggcgcagcgcgggcgaaaacuaugauuuucaaaacugaaggcucagccaauccucggcaaguuuguccgggcgguugcaaaauuuua

SEQ ID NO: 18745 - RNA, 5433 nt, Homo sapiens
caagaccucaaagacaacaccuggguaccaaauuucuuuauuugaaggaaugguacaaaucaaagaacuuaaguggauguuuugguacaacuuauagaaaagguaaaggaaaccccaacaugcaugcacugccuuggugaccagggaagucaccccacggcuauggggaaauuagcccgaggcuuagcuuucauuaucacugucucccagggugugcuugucaaagagauauuccgccaagccagauucgggcgcucccaucuugcgcaaguuggucacguggucacccaauucuuugauggcuuucaccugcucauucagguaaugugucucaaugaagucacacaacugcaaaacaauggggaagacaguuagugggcagcuuucccaaucccuaaggcaaaugauuuccuccauuuauuuccugggguuccaauacucacaugggggucauuuuugucaguggccaguuugugcaguuccaguagugacugauucacauuuuuuuccaaauguaaugcacacuccauugcauucagcccgcucucccagucaucacagucugguuucugaaugagaauagguuaaugcaucucuaccaacuaaccuagaagucagcaagcccaucaucucuaaccaccacguuuuggcaaaagggacauuacuauuugccuaauuuaguuuagaugguaagccuaaaaaagcacaaaaggcaaaagcccaguguaucaucacuuuauaagggcaauugcuaguuuaagugauuucugauacccgaacacugccagaugaugaaguaugacaccccuaggaucuuuuguucaccuugauauccugaaggaagauucggccaccucguugguucugcagcuucaucaguuucucagcauguucccucuccucaugagauuggugaagaaaguauuuggcaaaguucuucaaagccacaucaucgcggucaaaguaguaagacugaaaggggaacacugaauguguuauacuagggauccccagagacagguagcugugacgaucuacagggaggcaagauggucucgucagccuaggcuuccuuucucaaagcacagcaugaaggaaucagugccuaaggagacuggggggcagaugagcuacuggauugaacccaagaguaauguuucuauucuaaaauagaaaacugaaacuugauccuugaaacuuaacuucaaggaaccuuuaggauauuaugggcauugccuggggcaaugucuuaaggaucuguauuacugcacagaaaacuuacagccagugucagaauucauugucugaugagagggcgcuggaguacugacccugcacuuaguccuuuucuccucccugcuccuguauuaaccauguuaaagcaugguuaaaacugagcucaggagucugccagcuguaccacauauuuauuuauaaaauuaaaaaccccugcugggugcgguggcucagccuguaaucccagcacuuugggaggccgaggcaggcggaucacgaggucagcagaucgagaccauccuggucaacauggugaaaccccgucucuacuaaaaauaaaaaaaaauagcugggcgugguggcgugcgccuguaauuccagcuacucaggagccugagguaagagaaucacuugaacccaggaggcggaggcugcagugagccgagaucgcgccacugcacuccagccugggcgacagagcgagacucugucucucacacacacacacaaauuaaaaacccccaugcaagguggcaaauguggacaguauguugauguaaacauacuuuuauaauaguuauaucacaaaaauuugauuuucaguuuuagacauuugauguagucaaguguuugugaaaggcagugacagucacagaaauacaggccuguuuucaaauccauuuggaacacauuuauucuugggauaguuuggacaaucacaaggcaauucuaaggaagacucccacgacacugccuaagaccaagauuugggaaaacugauuccacugaucacugaaaaauuucuugcccaguaacugucgguggacuuuauccaagaacuggggguucaauuaguaggccaaacuccacaccucuuacaguaagauacauaaaagauaaauuagguccccuaggcgcaaggucaggugacacuucggugacugcagaaggggcgauuccuagagauaugcuucaaagcaagugggacuuagagauaagcagagccgagagguggauacggcugcucgagagggaucuacccacaagauaagccaccucccgccagcccccaagguuugcuauucgacaccguuacccagcagcuccgccacacacaggcggacgggagcuggauaccuaagcaaaaaacgcuggcauuuagggccaaaugccggaggcagaggaaaagaugggaaagcaaaacuccaccuuccuaaccgcaggauugaucacacaggcuggcagucuugcaaccccaggauuucaggacaccaaggucuccuuaaaaaagaagggugugcagaggcggcccuggccuaggagggagcauucucaggguacagccgagaagaaccagcugccccgacuuucugcgccagagaaguccucggaaaccucgagcagccuccauuuuccagaagggcgcagggaggcgggagagcccgcggguggccacacccccggcccgccccagcgcgcgccccgggaaccgcgcccggcccccgccaccgcuuaggcccgcccgcgcucaccauggacagguaaacguaggaggcguagagcuccagguugaucuggcgguugauggcggccucugaguccuggugguaguucuggcgcaccugcgagguggacgcggucgucauggcggcgacuaaggagaggcggcggcggcggcgguggcugcgcggcgcuggagcggcggcgggggccuuggggcaguccgagggugcggugaagaggugacggagggcuggcuaugggcggccggccgggguggggaacgagcgccggguuccguccaagcacuguugaagcaggaaaccccgacgacucucggcgaagaacgucuggcccugcgggucgcuuguggucucuuauagccgcgucggcgucaggcccgccccggccaaucagcgccgcccgccccgagcccgcuccuuccggugggcgcgggaccccgccccugcugugggggaggggcggccgcuggaggcccucgcgcgcucuggcggagcucgggagcggggaccgguagccgacugccucugggacagcgguggcgucucugugcccguuuaguggaguuggagggaagcugcgaggaggcgcaggaaguccaccucagaaccccccccccggucuaggggcgcccgggcguuggaaccggcgggggaagggugcgggggcgcauggggugauccugauucggcucccauuuucccgaacgggcacccugaggcuccuggcccggggcaugguguuagaaaucauagcugcggagaagcccuugugacaccuugcugcagauugggaagcugcagaugauugggaagguggaagguggagacgcgguccuuagguggucgagcgcauuuucucuuccucagaguccaggaaggagcgcgauggagaaguggggcgcacggcggguuucggguccgccccugcccuuccgacuccuccgaccacgucugccuuuggcugaaagcaaauauggcuccgugugcgguuucugcaacaaaggcugggcgggccggguuucccuagggauggggaccgccuccccggggagucgugggggugagccaccggggccuccgagagaaucgcuggugucgcuucgcacccaagggacacaucucggguuagaaaggagaaacgacguggaucuaaaggcgaagcccaugcugaggacuuuucaaaauggccucuuaucggccccacucacaggagcuucaggcuucgguggcccuguaggacaacccuggggugucauuggagagaagcugacgggguuaauggcgggugacaggugaaagagaccccggagggguggggccgguguguguggcuaagcugagucccaggcacaggguggaugugaauuuauggguggcagagcuagagcuaggcccugcccuuaccuagguccuggcuucgagguccacuguucugucgcgucuuuugacgcaucgguggaagaacugaauuucaggaugcucacaaaccugcagcuggaagcuagacuuccaaaccuuaguuuaaaaaagcaacucuacugaaauacuaaaauaaauugccgacggaauuagggugauuucuuguucacgguuucauuuaaaaaugcaccuauguuauuuacaggaaaaacguuuuaguggugcuagagcuacaagaauaagguaaacagaaggaugcugcuagaccaggaguaccuuacccagucugggauaggaggaggucggggaagcccucccuaagcaagacacgugagcugaguuugaagaaaaaguuaaaaggaaggugaagugcgggagagaaacagggaagggaauuuggagcagagugaacagcauaugcaaagguguggaaauguggaaaugcauggccuguuaaagcugccuuaagaaaauauguugccuggggcugggcgcgguggcucaugccuguaaucccagcauuuugggaggccgaggcgggcggaucacuugaggucggaguuggagaucagccuggcuaacuaacauggcuaaacccuucucuacugaaaauacaaaaauuagccgggcgugguggcaugcgccuguaauccuagcuauucuggaggcugaggcaggagaaucgcuugaaccugggaggcggagguugcagugagccgagaucgcgccuuugcacuccagccuggaagacaaaacaaaacuccgucucaaaaaaaaaaaaaaaaaagaaagaaagaaagaauguuggccuggaaaguacaguuuauguugggggaugcugguuaggguggagaauaggggcaagaucgggcaggguuguguuccauaaaaagagguuaaacuugauccuagagacagcauagagacaccucauuagcuuuguuuuuagaaaccuuacacugggaaucucuuaggauaagaguauagcaaagucaccauauauaggauccaaagcuuuccuuuauaacaguaaccaccaguuagaaaauauggggaaaaaagaauggaaaaaaaaauguuuuucacuuacauugacaacaaaagcuuaaaguaccuuggaauaaaguuaacaagaaauauauagaaaaaacuauaaaugcuuacugcuggacaaaaaauucaaaaagccuagcauaaaugaagagguaccauauucccaaauggucggucaaucuucauucuguaaagaugucag

SEQ ID NO: 18746 - RNA, 720 nt, Homo sapiens
ggccgcuggaggcccucgcgcgcucuggcggagcucgggagcggggaccgguagccgacugccucugggacagcgguggcgucucugugcccguuuaguggaguuggagggaagcugcgaggaggcgcaggaaguccaccucagaaccccccccccggucuaggggcgcccgggcguuggaaccggcgggggaagggugcgggggcgcauggggugauccugauucggcucccauuuucccgaacgggcacccugaggcuccuggcccggggcaugguguuagaaaucauagcugcggagaagcccuugugacaccuugcugcagauugggaagcugcagaugauugggaagguggaagguggagacgcgguccuuagguggucgagcgcauuuucucuuccucagaguccaggaaggagcgcgauggagaaguggggcgcacggcggguuucggguccgccccugcccuuccgacuccuccgaccacgucugccuuuggcugaaagcaaauauggcuccgugugcgguuucugcaacaaaggcugggcgggccggguuucccuagggauggggaccgccuccccggggagucgugggggugagccaccggggccuccgagagaaucgcuggugucgcuucgcacccaagggacacaucucggguuagaaaggagaaacgacguggaucuaaaggcgaagcccaugcugaggacuuuuca

SEQ ID NO: 18747 - RNA, 18087 nt, Homo sapiens
aggccauagcauucugugucuggcacccccgcgcaucuccccagcucugcccugcugccccaagagauggcucucugcuggggagcucgagagcuuggaaucugcugcagucaaaguuucuuccaugcggccaggcacaguggcucaugccugcaauccuagcacuuugggaggccgaggcgggugaauuacuugaggucaggaguucaagaccaaccuggccaacauggugaaaccccaucucuacuaaaaauacaauacuuagccggaaaucacuugaacccaggaggcagauguugcagugagccaagaucaugccacugcacuccagccuggguaacaaagcgagacuccgucucaaaaaaaaaaaaaaaguaucuuucaugcaggccccauccuuuggaccucccuucaaccccaagagagaccacuacccuagcagguaagacucuaccucucagaaacugaccuuuacuguagagcugauagugggaaagggcucaggauccaaaaucaaaagaccuagauccuagucucaagccauuuauagcugugugaccuuggacaaggcaggccuugagcuucaguguccuccuuuguaaaauguggauaaacaugcgauacugaaucauccuucaggaauagcucuaugacuuuccguagguuguuccccugauguguaaugcucuuccauucuucucagcuccaugaacuccuacucaugcuucaagacccaaccgaaaugccccauugucuguaaaaauuucccugaccucugugcacuuggcacagaucuuaggccuugccauucuguguuagaguuguuauuuaaguguuuccaaauuuuuugacuaugaauacguacaggcaggaaucagauuaggcucaguucuggaaggagaaaugguuuggcgaauauuuucuuugcggaacggaaagcagaagagggcgaccuugacuggguugggugccaucucugcaggggucaauccugggacucuuguuccaggcauggcuugggucaaucagcacucaugacuuugcugugugccugagccgugccuggcuaacuggggacauuuucauagcugagacccaguaggagagaccaugacuugugccagggugugccugucucagcucuggggcagggccaggagcagcugcucaugggaugucucuggggacaugcuggggccucugggaggggaagggagacuggccaugcacugucuaugguccuggugguacuccugggauauugccaaggagccugcgguucagggaacagggaggagggacucuagugucuccaacucccucucauggcucuauggcugcuggucggggucagggagaugaagcagugccagcuccguggucugcacugauccugaccagugaaccaggcuuccccagccagagccagcuagucaagcacgcucucuaguggccaccacagggaaggcaagaacuugucuccacaaaggcaggauuuucauuuauuccuucagagaguacagaaugagcaucaauguuccaggcauggugccaggcauguguguuaacuuuaguuaaaacauacuuauuggccgaguguggcggcucacuccuguaaucccaccacuuugggaggccuaggugggaggacugcuugaacuuagagcucaauaccagccuggguaauguagugagacccuaucucuauaaaaaaaaaaaaaauagcugggugugguggugugcgucuguagucccagcgacuugggaggcugagaugggaggauugcuugagccugggaaguggagguugcaaugagccaaaaucacacccauugcacuccagccugggugaccuugucucaaaaauauaguuauauauuuacuuauauauuuauauguauaaauauauguguacauacaaauauauuuguaauauuauagacauauuaauacauauuuacauauguuaauauauaaauauauauaauauauauuuaucaucuucuaaauggaaagcucuugaguuucaggauguguugguugggaagggaauacaggauagggaaauaauccauuaagcaaugacucagcacaggccauaaaaucagaaucaccuggagaacuugaacaaucccaacaccugggguccauccagaccaaucaaaucagaauucguaggggucaggcacaggcaccagugguuuggagaguugacggacacaugucccauccaucauucucauucggcugccaagguaggcaucguugucccauuuugcauaugaggagacugaggcugaagugaaccugcuucuuuccccauaucaguugaggacagcgauggggcagcggggaggcaguaaauacuccuacaaggcugccucuaaagagagucuuauaauaacaacagcuuuauuguuugccaugauuagaaaaguauucaaggucauugcgaaauaguguuuuuuuuucuaggcagauaauuauauaaaggcaaaaauggugugugggggugggggacaaggggagggagagcauuaggacaaauaccuaaugcacgcaaggcuuaaaaccuagaugauggguugacaggugcagcaaaccaccauggcacacguauaccuauguaacaaaccugcacaucauguauaccuauguaacaaaccuguacauucugcacacguaucccagaacuuaaagugaaaaaaaaagugguguguagaaaaaucaccugcaaucucagcauaguuaacgcuuaguacauuucagagagagagggugacaggaaagggaggaugagaguggguuuaagacacaaggucauauuauaaaaucagggcuucuggaaguuuagucccaaaaccacacaucucauaauccccugcagugcuugauuaaaaugcaacaucccuaaggccacagacucagacucuggagaaagauccagaaaacugcccguuuaauaaacauuugggcgauucuuacggccucuaaagaccaagaaccacugcugccuagagcucugcucucuucauugaacaauacaagaggaguguguagguagacacccaccacuuccaacagcuuaggagagcccuugaguauggauugauguauuaaaauuuauugaaucacaugcugagauuuucaccagcugcccguggggaucugggcauuuauucccauauugcacuggcuggcuggaagccagcagcauaaacuccagggcuguucugucaacccccaccagacucaccccccuccaccagccccggcaggcuucuccuuccaucucucugaagcaacuuacugaugggcccugccagccaaucacagccagaauaacguaugaugucaccagcagccaaucagagcuccucgucagcauaugcagaauucugucauuuuacuagggugaugaaauucccaagcaacaccauccuuuucagauaagggcacugaggcugagagaggagcugaaaccuacccggggucaccacacacagguggcaaggcugggaccagaaaccaggacuguugacugcagcccgguauucauucuuuccauagcccacagggcugucaaagaccccagggccuagucagaggcuccuccuuccuggagaguuccuggcacagaaguugaagcucagcacagcccccuaacccccaacucucucugcaaggccucaggggucagaacacugguggagcagauccuuuagccucuggauuuuagggccaugguagaggggguguugcccuaaauuccagcccuggucucagcccaacacccuccaagaagaaauuagaggggccauggccaggcugugcuagccguugcuucugagcagauuacaagaagggacuaagacaaggacuccuuuguggagguccuggcuuagggagucaagugacggcggcucagcacucacgugggcagugccagccucuaagagugggcaggggcacuggccacagagucccagggagucccaccagccuagucgccagaccuucugugggaucaucggacccaccuggaaccccaccugugaguacaaggugccccagguggacugggcuggggcuuugaggccuucaggguuggauggccaucuugcguauuugugugggauaugcacacacaggcagcacaugcgcaggugugugggcaccugugugucugugcaaaugcccugaggugggaaugagcuuggugugcaucaggcacagccagccaguguggcugcagcaaaacacacagggaaagaauggagggggcaucaaucacugcuucaguaaauuuuuauugagcgccuucuacgagaacacaagaggagcuuccauucugaggaggaaacaggcaggaaacaggcagauauccuguauaauuucaaguagugauaagugcucucuagaaauaucaagcaaggugaggagacacagagcaccgguggcaguggggcucuauuuccagguuggaugguugggaacauccuuucuaaagggaaccuggagugggaaggaaccaugcagguaucucaggaagagcuuccuccaggcaggaagaucagcagguggaaaggcccuggagccaccauucaguaaacaucauuugagcaucucuaccagcuagguuccauuaugggaaugggaauauggugguggacagggcugccuggucccuuccauacuucucacacuagggugguugagagagcuugggagcuaacgaacaagaugggcugagaacacugccuagcccagaggaccugagcuuaguguguagacauugcugcuguuacugccuuugucauuguauuauuuauuuauuuauuuauuuauuuuuagacagaguuuugcucuucuuacccaggcuggagugcaauggcgugaucucagcucacugcaaccuccaccuccuggguucaagcgauucuccugccucagccuccugaguagcugggauuacaggcacccgcaccacgccuggauaauuuuuuuguauuuuuaguagagacaggguuucaccauguuggccaggcuggucucgaacuccugaccuuaggugauccaccugccucgacuucccaaagugcugggauuauaggcaugagccacugcgcccagugauuauagaaaguuaaaggcacauggcaaugcacacgccuaucuacgucuucccugccaaagcaaagggcagccucugggcucacuuucuugcguuucuacuuccaaaaggcagucagaacuggcagggccuuggagaccacuucauccaccuccuagggucccuaugggagaguugagguccagagcagggaaggguccugacaggcucugaccagggccucugaucccuacaaacccccaaucggugucccucucuaccaggacccaagcccaccugcugcagcccacugccuggccaugaccaucacuuacacaagccaaguggcuaaugcccgcuuaggcuccuucucccgccugcugcugugcuggcggggcagcaucuacaagcugcuauauggcgaguucuuaaucuuccugcucugcuacuacaucauccgcuuuauuuauagguaaagcuggcagggcugggccggggggccugggaaggauguggcuggggcugggagcuccugggggccucccagccagcucaggggccaguguaccaguucacuacaagacuaagcugagcuccugaccagguccugggcacuggagcugaggcuggggcugggggcuggggagagaaaagaagucagacugagaggcugcucaagccaggccagcaggguuuuagccacccuuccuccaaccccaggaggaccccuggagcccaggcuuugucuggccccacucaacuggccuguuuuacugaaucccacacagacucauaggcccacauaguacauuaaaaaagagagagagagagagagagagagagagagauggagucucacuguguuguccaggcuggucucgaacuccuaggcucaagcaaucccccugccuuagccucccaaggggcugggauuacaggugugagcuacugcacuugaccaaccacaugguacuuuuuuuuuuuuuuuuuuuuuuuugagacaggguuucacuccaucacccaggcuggagugcagugggggcaaucuuggcucacuguaaccucugccucccaggugcaagcgauucuccugccuuagccuccugaguagcuggaauuauaggcacacaccaccacgccuggcuaauuuuuuuuuuuuucuguauuuuuaguagagacaggguuucaucauguuggccaggcuggucuugaaccccugaccucaagugauccacccaccucggccucccaaagugcugggauuacaggugucagccaccaugcacagcccacaugguacauuuuuuaaaauuauuuuuuaauuaaaauguuuaucuaaggccaguagcagugacucgcgucuguaaucccagcacuuugaggggccaaggugcggggaucacuugagccugggaguucagcgugggcaacauagugagaccccgucucuaccaaaaauuuaaaaaauuagcugggagugguggcauuugccuguggucccagcuacuugggaagcugagguguggggauggcugaagccugugaggucgaggcugcagugagcuaugaucacaccacugcacuucagccugagugacaggcuaucucaaaagcaaacaaaauaauguuuaucuaaacaauaaaauauaaucacagaauauaugauagcauuuuaaauugaaaaagcauuaaugauuacauggauuguaaaauaucaaauacaugaaauucuuguguucuuaauaaugcuagcaacaaggcacauuugguuuuuacuagggcaccaagguacuuuaaaaaaaguuagggccagccacaggggcucacaccuguaaucccagcacuuugggaggccaaggcaggaggaucacuugagcccaggaguuuaggaccugagcaacauagggagauccugauccugucucuauaaaaaauuaaaaaauuggcuaggcccuuuggcuuacacccguaaucccagcacuuugggaggccgaggcggguggaucaugaggucaggaguucaagaccagccuggccaacauagugaacccaaucucuacuaaaaauacaaaaauuagccgagugggguggcacgcaccuguaguuccagcuacucaggaggaugaggccggagaaucgcuugagcccgggaggcagagguugcagugagccgagaccaugccauugcacuccagccuaggugacagagugagacuccgucuaaaaauaaaauaaaaaucaaaaaaugaucugggcaugguggcuuaugccuguagucccacccagcuccucaggaggcugaagcgggaggauugcuugagcccaggagguugaggcugcagugagucaugacugugccacugcccuugagccuggguaacagagcaagacccuaucucaaaacaaacaaacaaacaaacaaacaaacaaaaaccaauaaaccaaaaacauuuaucuaaacaauaaaauaaaggacagauauaaucaccgaauauaugauagcauuuuaaauugaaaaagcacuaaugacuacaauggauuauaaaacaucaaauacauaaaauucuuaaguuccuccuaauaccaaauacaaagcacauuggucuuugguuuuuacuugggcacuaaugcaugcugaaaaagagucagacuucauuuuuuagaguaguuuuagguucacagcaaaauugagcagaagguagaguucucaugugucucuuugcuccucccccugcccccagccuccccacuaucaacacccccacacuacagugguagauuuauuacaaucccugaacccacagugacacaucacuaucacccaaaguucauagcguacagcaggguucacucuugggcuguacauuccauggguuuggauaaauguguaaugaugucuccaccaucacagcaucaggcagaguaguuucacugcucuaacaaaauccucugccuauucaccccucucauuaaagccaaacacucuguuucuuuuuuucuuuuuagagacagugucucgcucugucacccaggcugaagugcaauggcaaucacagcccauugcagccuccaacuccugggcugaagugauccuccuaucucagccuccaguggcuacgacugcaggcauacggcaacggcacccaacuaauuuuuuguagagauagggucuugcuauguugcccaggcuggucuugaacucuugguccugccuuagccucccagagcucugggauuacaggcgugaaccaccgugcccgucccaaacacucuguuucgaccugcuuuuaaacaacugacccuuggcugcauucaaaggaucagggugucugaaacuggccucugcagcaggaccuuccuuccuacacaucucccaguggccagugugaggauucuccccacaagaaaccacuggagggggccuccuccuguccggguuuggggcuguacaaggagcaucauggaccuggcucaggccucaggaggggcccugggcuggggaaaaugugggauagcaucgaggcagucccacuccuacccagggccgggcuagaccuggggacagucucagccaucuccucgcugcguccacacaauuccacccccacccccacccccaggcuggcccucacggaagaacaacagcugauguuugagaaacugacucuguauugcgacagcuacauccagcucauccccauuuccuucgugcugggugaguucccccuucuggcuguuccgggucccuguggccgcccaggcuccagacaggccaggggaggaucacgaggagcugcggcaaggggcuggggagggggcgggggaacgccagcggcaggucggcgccucucuguagggaaaggugcggacugcagccagugaaacugaaguuagacguuagguaagacguccugccguuagcaaugaaaaccccauuuucugagggaagcgcugacaucauggucccuggagccccugcgcgggaggggagggggucuggcggauuucugggaccagcagggggacccccgggugacagaacccuuggggcucucgcgccuccaugcgaggcucugccugccucucgcucccgagcgccuuccaggagggcugggggcuaggcccgcucgcagcagaaagcuggaggagccgaggcaucgccgggcgcugggcccugggcucuggccgcagccuggccccucgccccucgccccccgccccuccugcccaggcuucuacgugacgcuggucgugacccgcugguggaaccaguacgagaaccugccguggcccgaccgccucaugagccuggugucgggcuucgucgaaggcaaggacgagcaaggccggcugcugcggcgcacgcucauccgcuacgccaaccugggcaacgugcucauccugcgcagcgucagcaccgcagucuacaagcgcuuccccagcgcccagcaccuggugcaagcaggugggcggaccgggagcaacggggaggcaccgggcagagccaggggccgagaugggcgcggcaggaauggaagauggguggagccaaagucccccggacucgggggauuggguggagccaggagugggguguagucaagauuuggggguccaauugggcgggacagagucgggugucugaagguggggcgaggccaggagcccacccuccgagaguaggagucugaggcagggcuaaggacccuugagggauaauggaaagaagggugacggcuugggaacuggugagguacuagggucuacuucccucugcccuugccccucuugaucuccgguuuccacucuggagguaugggacauuggucucugacacccccucagccuggccugaccugguccugguuaauaagacagacccaggcuaggcgugguggcugucgccuguaaucccagugcuuuaggaggcaaaggugggaagaucgcuugagcccagcuguuugagacgccccugagcaacauagcgagacccccaucucuacaaaaacauuaaaaauuagcagggcaugguggcgugugccugcagucugaggcugaguaucgggaggcugaggcaggaggaucacuugagcccagcaguuccaggcugcagugcgcuaagaucgcaccgcugcacuccaaccucggugacagagccagacccuuucucuggaaauaaauaaauacccugcccacaugcucagcccagaacagcaccuaguaggugcucagaaauuuuuuuguuguugaaagaaagaggauggcaaaggagugcugagguuccuauaggucagcaggugccggccaucccuucugcagguucucccacccaccgccuucuucacuccacucugcaggcuuuaugacuccggcagaacacaagcaguuggagaaacugagccuaccacacaacauguucugggugcccugggugugguuugccaaccugucaaugaaggcguggcuuggaggucgaauccgggacccuauccugcuccagagccugcugaacgugagcccacuguacagacagggcugccgcagagugggaagggcugugguccacaggaaacaagguuuccuacaaagagaagccuugggccccugagggucuuccgagagccugaggugggguugcagaaucuuuuccaacagcaauccacagcccgagguggucccuucucagaggccccucccucuucuccaagucugugagguccugguucccuuuugauagaugaggaagcugagacacaaagagguuuagugagcuucccauggccacacagccaggaauggaccauagguaccaggcccugguaccuggagaagaggugggggcgagcccagggugggggcaggugguguucagaaccccaucccccucuucugccccccaggagaugaacaccuugcguacucaguguggacaccuguaugccuacgacuggauuaguaucccacugguguauacacaggugaggacuaggcuggugaggcugcccuuuugggaaacugaggcuagaaggaccaaggaagcagcuggggugggaagggcucaccuagaggcuaaguggcuccccugggaguuggguccacacuuugaaguugggucuggacuuugaagugccaaguucuaagaguccaggcuccugccuggcccaguccaguagaggcaaugugauuauccccauauuaaagagagguuggccgggugcaguggcucaugccuguaaucccagcacuuugggaagcugaggcagguggaucaccugaggucaggaguucgagaccagccuggccaacauggugaaaccccaucucuacugaaaauacagaauuagcugugugguggugcacgccuguaaucccagcuacuugggaggcugaggcaggagaaucgcuugaacccgggagguggagguugcagugagcugagaucaugccacugcacuccagccugggcgacacagcaagacucugucucaaacaaacaaacaaacaaacaaacaaagggguuaacagagccccuaagucacauaagugugcaagucagaacaaggccuuggucuccugucucagacucccagccccuggagcauccugauuucaggguucccaccuagcccuuugcuaccacauccuccuccuccucccagguggugacuguggcgguguacagcuucuuccugacuugucuaguugggcggcaguuucugaacccagccaaggccuacccuggccaugagcuggaccucguugugcccgucuucacguuccugcaguucuucuucuauguuggcuggcugaaggugggccucuccagggcccugcugggcuggaggcauggccagaggggucauggccagcagcugccugagacgaggaugcagugucaggaaaggaaggucucacggguagaaagcagccaggcgugguggcgcacaccuguaaucccagcuacucgggaggcugaggcaggagaaucgcuugaacccgggaggcggagguuguggugaguugagaucgugccacugcacuccagccugggcaaaagaaugaaacucuaucucaaaaacaacaacaacaacaaaacaaagcccuaagguucagaagccccugcccuuuagaaggcagaucggcaccaccucuccuuauucaagaugccuguugggcugucuuguuccucaccucaaguggcuuguccagguauucccucccaccacagccaauacuccgaacagauguucugaaucacacaguuuucucuccaccucuuuaucuuuccuuccuucuguugcccacccacucucucucccuuccuaccuuccuuuauuuuuugguaauggggguguaagucucugucucugcccuuccugucacugugacacacacacacacacacacacacacacacacauacacacacacacacacgcauuccuauuccucuaaauucccccugcccccccaguuaucuuugguuucugcagaucaaaacaaaucacacuuuuaugcuugaaauucuccggggugccccaguggccugcaagauguccccuggaccccuaaggcagacgcgugucaccucuucggggcuuuguuagggcauuuuagagguugcuauccaggaaucugcccaccuagacugcccuuuaguucagcccagcuucaguauauaucucuguugcaugaaugaauaaaauuaugcaacuccagguaagauacaugaggugagauaaaggcagugacucagccgagugauacacucagggacagcuguggguguucagggaaggacuggcucagaagaguuagaggggcuguguccagaagugugugggugcccacaaguguggggggcuggagcccuaaacucugccuuugaagacaguggucaggcaggaagggcgucaugggguguggaaauagcagcagcugagguuuaaagggggaagcuggcuuugaggaguucugccugaggguuuacagagccucaccuguccccaagguggcagagcagcucaucaaccccuuuggagaggaugaugaugauuuugagaccaacuggauugucgacaggaauuugcagguauggggagagggagagaaaccauaccauggaccuuccccaaaguggacccaaagagaggaccccacuguucuguagggaggccucacagugaaugaucaacccuuccccuccucccuccugcagccagucauucacucacaggauucucaccucaaucuuugaggcugcaggcaggcacccaucuccccauuucacaggcagggaaacugagguccagagagagggagagauuccuccaagucaucaggcacauacaagguccugccugggaugaucuuucugugggacuucuucugucccuggugaccaggugucccuguuggcuguggaugagaugcaccaggaccugccucggauggagccggacauguacuggaauaagcccgagccacagccccccuacacagcugcuuccgcccaguuccgucgagccuccuuuaugggcuccaccuucaacaucagguguggccagagccagggggcugggugggaagccccuccuagugcaggggucugccuaggaacuuagaauagcacuaguuaaugcauacagguugcuucaguaagugucaggcacuguacuaugcucuuuauaaacauuaacuauuuuuuuccucccaauaauucugguuuguuaucccaaguuuucagauaauuaaaguacagguucagagagaguaaguuguccaaggccacauagcuaccaaauggugcauuugcuacucgaaggacagccugugaucagugaugcaguggaacguuaggaccuggcucuugucauccagaacuauguuuucuuuucuuuuugagacaguaucucgcucugucgcccagguuggagcgcaguggcgugaucuuggcucacugcaaccuccgccuccuggguucaagugauucuccugcuucagccuccccaguagcugggauuacaggugcccacaaccacaacuggcuaauuuuuguacuuuuaguagagaugagguuucaccauguuggccaggcuggucuccaacuccugaccaguaaucugcccgcuuuggccucccaaaaugcuggaauuauaggugucaaaacuauguuuucugauaagcuacgaugcuuggaugggaaguggaagugggguucccugggaugggggaggggcagcaaagucccagcaggcagccaggccaucacagguaccuccugaauugacuuuguccuaccgaguaaagggcucaggccacccacagcagccagacuuauccccacauggucccacuucccugauuccaucugaaucccucuugagcugcagugggcugaagggcuaucccagcugguccuuucuccccaggacaacagaguugaaagugccuuggagaguguugggcacaugucaggguucauacucaaggguuucuuccacgguauccagugcuguucucgcuuguucuuuucuuuuuuuuuuuuuaaacggaguuucacucuuguugcccagagcuggagugcaguggcauaaucucggcucacugcaaccuccgccucccagauucaagcaauucuccugccucagccuccugaguagcugggauuauaggugccagccaccaagcccggcuaauuuuuguauuuuuaguagagacaguuucaccauguuggccaggcuggucucgaacuccugaccucaggugauccacccuccucagccucccaaagugcugggauuacaugugugagccacugugccuggcugcuuguucuuuuaagaaccaaauauccuacuagacugcaaucgaguuuaacuacagucuauagauagugugaggaaggguugggaaggugaucaaaugaaggcuggaggcuugcuuaggucagaaacauuucuggaggaugacuuugagcccuacauggucuguaccccagcagcugaagguuguugagggguggggagggcugaaaacagaacgauaaagcauagaccuugucuccaaggaaugcacaauuuauggagggagcucaaacccaagccucaaacucuggauacaagguacaaaguacuggauguccagaaaagggacagaacauggaacacagucaucuuugucugccugggaggcggcuuccagcugggucuggagcugagccauggaacaugggaagaaucugaacuugggcaagggcaggccauacucucugguagauaagcuuucccuugcaggguaaaggucuggggcucccgggaugccuguugcuaggaagucaaauuucucuuuguggaugucacucccaguuggaaccacaaauuccuggcauugcccagagucacucaugggccucaucugaaccacucaugccagggcaccaguguuucugacugccuggagugagggguuuuacaggggaagugaaugaugaggaggccuuuacacgccaggcggggugguugcggggguuggauguuaacucuggucaagagggaaucaacaaacagugaggugagcugggccuggagggaucaccgggagguacaggacagaucaggagagaggugagagcuggggcauggugaggaagacgguguggccuuggcuugggccaacugagagagaggagcggggguaagggagaaguaaggccagguguugguccuuuguccacuggcucagcccugcaucuccuguuucuuuccagccugaacaaagaggagauggaguuccagcccaaucaggaggacgaggaggaugcucacgcuggcaucauuggccgcuuccuaggccugcagucccaugaucaccauccucccagggcaaacucaaggaccaaacuacuguggcccaagagggaaucccuucuccacgagggccugcccaaaaaccacaaggcagccaaacagaacguuaggggccaggaagacaacaaggccuggaagcuuaaggcuguggacgccuucaagucugccccacuguaucagaggccaggcuacuacagugccccacagacgccccucagccccacucccauguucuucccccuagaaccaucagcgccgucaaagcuucacagugucacaggcauagacaccaaagacaaaagcuuaaagacugugaguucuggggccaagaaaaguuuugaauugcucucagagagcgauggggccuugauggagcacccagaaguaucucaagugaggaggaaaacuguggaguuuaaccugacggauaugccagagauccccgaaaaucaccucaaagaaccuuuggaacaaucaccaaccaacauacacacuacacucaaagaucacauggauccuuauugggccuuggaaaacaggucuguccuccaccugaaccaggggcacugcauugcccugugccccaccccagcuucccuugcucugagccuacccuuccuccacaauuuccuaggguuccaucacugccagagcacacuggaccuacgcccagcacuggcuugggguauauacuuggccaccuucacagggauccuagggaaguguucgggaccuuuucucacuucacccugguaucacccggaagacuucuugggaccaggugaaggaagaugagguugugcugaccagaaugcugcuggagaacugccccagggcugacaggccaggcuuagcugagcagauguuaucacuggccccaacuuacuuugagcaaggguggcugacccaaaaccaugagguggcagucagcuggaugacagaugaacacuucccccauaacuauuuaggguaguacccaagcacuacaggaaaggguggcaggaacugccucacuccuaggaacugguagauggugagguugaggguguccagcgcccuuaggucauuuucucacugccugggaaccucaccaaaauacuucuugcuuccuuggggucagcccaaagcugucacaaaaucagauauuucccuuuauuccagauuuccuggacacuuucacccaauuauaaacaccccacuucagccccaaucacgugggaggaaguguaacuucccuuuucuggauucucaagcaguuacuuucacggucagaacacgcagcuauuaugauugaaaacuuaaaagggcaacaauuucagucuugcuucuagggcuagacaggaacuuggcaaacaucuguggccuguucagcaaaggauguuaauauuuaagaaucuugucuugggcuggguguggaggcaaguggaucacaggaggucaggaguuugagaccaaccuggccaacaugaugaaaccccaucucuaccaaaaaaaauacaaaucagcugggcgucguggugugccuguagucccaacgcaggagguugaggggagaauugcuugaacccaggagguggugguugcagugagauugagcaacugcaauccagccugggcgacggagugagacugucucaaaaaaaaaaaaaaaaggaucgucucaaccuuugcccuccuacugcaacauuuugguauuugaaaugaagggaccuuccauacuuaugcuguuaauacuuucauucucacuagggaugaagcacauuccuaaccugcuuccuaauggggaugcuucgccagccagguccucaccuguguguacaccagcaggacacugauccagucacagccauacagcuguccacacugaagaacauguccuacaacagccugaaucaaaugguuagcuuaauagauaaaaaucccagacuacuucagccuuuaaugccuuuuauucauaaaaacugugaaagcuagacugaaccauuggaaacauuuaacucagacucuggauucagagucgggaacccuuaguucuaucugaauccaagacagccacaccuuaguauacugcccaaacuaaugaguuuaauaaauacaaauacucgu

SEQ ID NO: 18748 - RNA, 21361 nt, Homo sapiens
agcggauggggcccgggugcaguggcucaugccuguaaucccagcauuuugggaggcgggagggucacuugaguccaggaguucaagaccagccugggcaacauggcaagacccauuucuacaaaaauaaaauaacaccaaaaauuagccggguaugauggggcgcgccuguagucccagcuggggacucccgagacugagguggggguaucuccugagcuuaggauguugaggcugcagugagccgacaucaugccacuacacugcagccugggcgacagagugagacuccugucucaaaacaaaaaagaggggcggggaagcaguaacaagcacagguguccucagcccauggauggcagcgcccgccuccacgcgccagugcccuccugcuccccuaccucccccuuggccaccccugggcauccccagcccugcagcgccgagggcggaggggaggccacccgcccccagcagagggcuccgagagagcugcagcggcggugggggccccgcagagauuggggcccaugguuugaaggcuguucacaggcaccccgagacagcguccccccucugggcgcacuggauuugacguugcaggacgcgcggcuggaagccccccaggccccgcugcucacagaccgggacuccgccuccgguucccgagggcguggcgaggcgcugcgggacgcccaacaggugcguguuguguccccaggccccgcgcuccggguggagucaagaaccuggaagccggcagcccgggaaaagggggcgggacggugccccggggcagggcuggguggcggccgcuguccucccgggaggggcgggccgccucgacgccgcccucccuggcggccaauggagaccgaggccccgcgccuggauuggagcggacgcggggggucagccagccuugggggccggggccuggccgggggcgggggggcaggcgaggcgaggcgggcgccguccgcgcgguuauaaggcggggaguucccugcgccgcgagccgggaggcgcacgcucgcucguacggcggccgcggcggcagggcggggccggagcagcgggcggcggcggaggcggcgcccgggagcgcucuucgcuucccucggggucuugcucggaccucggccaccgccugggauccccaggacucgugcgugcagcaugggcggcgucggggagccgggaccgcgggagggacccgcgcagccgggggcgccgcugcccaccuucugcugggagcagauccgcgcgcacgaccagcccggcgacaaguggcuggucaucgagcgccgcgucuacgacaucagccgcugggcacagcggcacccagggggcagccgccucaucggccaccacggcgcugaggacgccacgguaaggaagccauaaggaagccacccaccggcggguggagccuggagcucggucgugggcgugaugucccgcuccaccuguggggccuuagcauccucccuccccucgcugaccuuugaccuccacgccgggacccagaguugggguggacuagccagggccagaugugggguagggagggcaguucccugcguggaggacccgcagcuguccacggagcaggucugcgggggaggagggggccucagaggugggugugucaugcugcagagccugcccugggugaggggcugcccuguugcucccaggucccuguuucaguucuggguccccaugcugggugcuugcugagugcuagggguagggcagggcaggguccccaggggccgguaaggacaugccauuagaggcugggggcugggccggccugaggucuguggcuuucccaagagcuucuguaaagggcucagggacagugacucaccucuccgggcuagcagcugcacgugggagggcuuugccagccaggcugggugggccucuccuggaagcacagucaccccaggaacaggcuggccccuggggaccccaacuucccaaucccagccccugucuagacaggcagggauguagccuggccccaggguacugucuggcuggaguccagugguggagcagcccgaccagccccuuuuccuuaguuacccaccugcauaauagggguuggggccacgaugcccuguccuugacccuccaaauuucuagguuggccacacuggguaucaggaaggucuucaagacccgaggacaugaauccugaaugcuggcuuuuugggcagcagcggagguucuguccagucccaggacugucggcgucccucuugacagggccaccugcucucugccgauugccaucuccagcauguuggacaaucuucacuggacucuuugaggaagaaagccccucuuuuccccuuccaccccaugaagcugaggagugagaauaagaauccuccugaaauucuaaaaaaagaaaaaaaaaaaaaagagaacgccuuguccguggcuguucaggcgccagacgcuggcccgaggggacagcacagccgugggaugaagcagccugggggcaguauuugagcgugcagguguuugcaugucugggugaguguggugugugugccugccuuucugccagggcguggcgaggugaggggcacggcuucuccccaaaggccuugcugagcccuggccucccuucaaggagucuuguggaugccugcucuggucuuuuucuaaaaaaguaucuauuuuauuuauuauuauuuguuuaaaaauagagacagggucucacuauguugcucgggcuggucucaaaguccuggguucaagcauuccuccugccucagccuccgaaaguucugggauuacaggcaugagccaccacucccggccugcucuagucuuuuguaaccuagaggacaguauggauacagaaaacuuuacuccccaccaaccgccggagacagagucuugcucugccacccagacuggagugcaauggcgccaucuuggcucacugcaaccuccgccucccagguucaagcgauucuccugccucagccucccgaguagcugggauuacgggcacgcgccaccacgcccagcauauuguauuuuuaguagagacgggguuucaccauguuggccaagcuggucucgaacuccugaccucgugauccacccaccucggccucccaaagcgcugggauuacaggcgugagccaccacgcccggcugggauacagaaagcuuuuauuucaucacuguuuccugccuggugccaggcccaugcugggguuccucccaaguggaauuacugacuuaacauuuagcuugggauccugagacuuccaucacacaguuuucucauugauucgcagccaauaauaucuguuuuaaaaacaucucaggccgagcgcuguggcucacaccuguaaucccagcacuuugggaggcugaggugggcagaucaccugaggucgggaguuugagaccagccugaccaacauggagaaacccugucucuucuaaaaaaauacaaaauuagccaggcgugguggcgcaugccuguaaucccagcacuuugggaggcugaggcaggagaaucgcuugaacccaggagacggagguuccggugagccgagaucgcgccauugcacuccagccugggcaacaagagcaaaacuccgucucaaacaaacaaacaaaaaacaucucucugcuccuuggggccgggugccagcucugcuauuggaggcacugagcgaccuugaagcaggcaugucacuccucugugccccaguuuacucaucuguaaagugggagagcuggggcagacagugagcuggcugagggcaggacugugucuccucaagcccauggcccagggcugccagguaguaguuuguauucgguaaaugcugcuggccccuaagugugagcgugcccugcaaacugcagcguauggugggacagcccugcacggcuaccccuuuccugggugaccuuauuugguuacgguccuaucugaaguaggaaagggacacuuuaggcugucucuuagcucccucaaggccccacagccuggacuagaguugccagaaauacuugguccauucaggccaaagggacugugagguugcugggauggugcaaucagucuuuguccaugaugaacccacaggguagaccagggguugggccagcccagugcccuguguaguugagcccaggccccaggcaucccaucccgggcgguggccucagguggagguggggcagccaguugccagggauguguuccagcggucaccucucaccagccccggcugcccaucagcuguucucaaguccaggcaaugaagccuuccugccaggaaauucccagaguuucugugccaugaagucagccuguggccaucuugggacacaaggccgggugcccuggggagaguacucugggcccuuggccagguuugucugagagucauaggcagccugauacuaguggagccagccagggagggaugaggcccagccgcugcuggccauaaguauauaagggccaugugcugagugccuacuaugugccagguuuugaaaucaguacuugauuuauugaaacccucucuuuuaauccucaaggugccccuaugaggcacguaccauuuauuguuauugccacuugacagaugagaaaacagaggcucagagaggcaaaguggcuugaaauucagugauuggucugggauuugaauccacagccauguucuuaagggcaugcuaugcugccaccuauccuguuuauuuccggcacucauugauucuucaauguuugacucauuaaauccaucagugagcaucuucucugugucaugcaugguucucaccucugaagauguagcugugagcaaaacuucuacagggaaugaguucacagcagagggaucagcuagagcaaaggcucagaggugggaccgugcguccuguguuccaggaauacaguauggcugcagcagagagcaguggagagagggccuggcagugaggucuagaggcggccgggcuggcucaugcuggauguuuguguccucggaaggacuuuggcuuuauuuuaaagaggauggggagccccagagagcacagcagggaagccuggggagucugauggacauuuaaaaggauccuuaauggagagagugaaggcagagccuuccagaaggguaagagaagggaggauggagaccugcccucccccaagggaggccacucagaagagguagaguguggccagggcagagagcaagagaggcuguggacacaggcacacugguccagugagagccauuagacacauuagauuuagcuucauguugucuuuagagagggagccagccuggccucgcucuaugaucuuggacacauccuuucacuucugggucucaguuuccccauuagugugaugaggaugagaaugcuuuuguccugggcacacuaugaggguggugcugggcaccugggugccugguuaccaugggcaacaaagcucuauucauggguguggugaaugcauugcccacagcaacucagggcggaugaggaguuucccagcagccccuggugcccuuucggcugaagcccuaacaacugugggaaaauccaaguuccagcagacccccugagcccucugccuuaggacccuccuucuaggugguucucugagccuggccugagcuggaggagggaguggccagugcugcagcagaggcugcuucauaguaauugcagccaacaguuauugacuaggcacuguucugagggguuuagaugugguaacugauugaauucgccuaacaacuuuaugagguaaguccuauuguuagcccauuuuguagaugaggagacugaguuugaaacugggggguguaauggaaccuucucaggacccuugaaggguagggccuuuguacucgggccacgagggugggguuugugucugggugggagcuggggagggacaggacuaggauuaggcagaucugaggccacaggaguugguugggggguggcuccagagccacuccacucccuccuaccacauugacugccuugaaaguccccuaauggccacucccaugaagugugacugcucugggcuccccgcaggcguuuucugcaaggccaccgcccacccaggccccuuccccagaggggcugcagugccuugcuccuuccuugugggaagaguugggauugucuggcgucagcaggauacugccccugggcaucccucccggucucuuccugcggguuucugaugaaacagccaggcuccaguaguggagccagaggucagugguggagagaggaccaggagccagaggguauagcugcuuuggggcuacuguggggucagggacacuugugaggccaagcguccuggcugcaggagcccucacauauaugcccacccuucaccaggacauugaggggugcugggggacagggguagcuuuuugggggugucugccuucgacuugggcuccgcuacacaggccaaauuuggaugucccauguuuagagcuguguuucuuugggaccucuuggggccucaguuuccucaucuguaaaaugggauacugauagugcuuccccacuggccuccucugacgggcgccagggagaggaugggacggagcauggugugcugggcacgcuccugcuguacccacccaccugggagaggggagaggcaggaauguccuggggguguccuuugaggcauagcccugucaccccaacauccuacaaaggcaugagaaggcagcgaggacagaccccgaccaccugagcccucagcagcccugccacacucccugcuucacccccuuccugacugaucuggcacauucuugauucuccuagggagugacccaaaaucccucccugcccugcugugucucugggguggaaggaggcugccagccccuccucucucccagccucaggcuuggccaggacuuaacaggcaggcagagaagcagcuucuccacucucuucccugacaccuguaggccccuccugcaggcacuuaccucuaaguggacucucaggaggaggcucaucagggcugcagggcucagaaagagcugggcuguggagcucuugccaaccgccaggccccuucuaagugcuuuagcgccaccgacugcauccucccagcagccuugugagauggggauuugugguucccaguuuacugaugagaaauacugaugagagauggguguggucuugucuggggcucccuggcuccuggauagcagcucagguuccauccugggcaggcuggcucugggacacccccccgaccagcugcugugugggauucacgguggggcuugggcagggcgugggaucuuggggccaacugagccacucuaggcuuccagggaccaaggccaggcugagcugucucuguauccugagagagcaugaacaucacagaagaugggcccggguucgaaucccagcucugccacuacuaacugggaccugggcaggugucccuucccgcugagccuucauuuccucaccagcaaaaugguucgugccccugcuuugggggcuguggaggguuggcucuugucuacuuguucauaccugcuguugagcagcugcucugugccggccucugaggaugccacugugaacagagccugucgcuaccuccaggagcuuguguuuaggggugccguuuugauuccagcacuuucacccagcucugcuccgguacccgaugagagacgucgagugccgcuuuccacucgcuugggugcguguggggguuggggggacagggcuuugugcacguaccccuggguggauguuccugggugcacuuagggugugugagggugggaccucccacaguucccugaggcuccacugaugagguccaagaaccgccuuccugccccccagcccaggcucccagcagcugggcccuuggcuucuugagauagugacuggccucacggcaaggacccccgcacaccaccuaggagaacugcugcuuccccucuguuccaggaguggcgacaagcacaguuuuucgcuuuuguuuuuguuuucuucacuuuaaguuccgggaaacgugcagaaugugcagguuuguuacauagguauacaugugccauggugguuugcugcacccgucaaccccucaucuagguuuuaagcuccauauacauuaggcauuuguccuaaugcucucccuccccuugccccucacccgcccaguaagccccggugugugauguucccuucccuguguccauguguucucauuguucaacucucacuuaugagugagaagagaccuggacucugaucuaaccucggucaaauggaacugugugaccuugaagaaguagcuuaaccucucugagucuuagcuucugccuggcacccccauccuuaaggagaggcccacagaggaccaggucacaugaccucagccaguuccagagaaggcuguuugcuuccagguuucggccugaguccaggccccugcccuacucgcacucccugauagcaugagaagcacagccccagggugcccacccagcucugagagcccagccugcuucccagggaacugucacagccccaccugucccuuccccagcuggagcccugucaauggcuuugggguucucugacacagcccugagggggcucacacuuccccuuaucauugcaagggguagaucuggcuugaaggcccuggggcaggcuugguucuguccuccccugucagugccucgacagggcuggccugggugaaucaggaccaacgggaaaggaggcgaggagaccaaucuggacccaagauccucagcucaauaagguggccccagaacugacauggggugauagagggaagggcugggagggaggagauucuggggccgcagccacagcuugcacguugcgccgggugugucugugcgugccagcugcaucuuugcguaccaugugugcaaggcuguguuuggcugaguguucaugugggccgugauugugggcauguuucugagugucugagugaugccugcuggugugggcuggugggugugucugcaugugcgugugugucuggggaguuucaaaggagaaagagggacucaccaucacgcuggcucagccuuaaaaagguaggacauccugacacgugcugcaacauggauggaccuuaaggacauugugcugagugaaacaagccagaggcaaaggaacaaacaugugauuucucccagaugagguuuccggaggaggcagaucuguauggacagaagguagcauggugguugccggggcagggggaggagagaauggagaauuaguguuuaauggggacagaguuucaguuggggaaggugaaaagguucuggagcuggaugauggugaugguuggacaacacugugcaugcacuuaauaccacugagcuggacaccuaaaaaugcuuacaaugguaaauuucauguauauuuuacuacaauuuuuaaaaaauuggcugggcgugguggcuuaugccuguaaucccaacacuuugggaggccaaggcgggaggauugcuugagcucaggaguucaacaccagccugggcaauauggugaaaccccgacucuacgaaauauacaaaaauuagccuggugugguggcuugcaccucuaaucccaccuacucaguaggcuaaggcacaagaaucucuugaaccugggagguggagguugcaguaagccgagaucaugccacugcaacccagucugggcgacagagcaagacucugucucaaaaaauaaaagauaaauaaaaaaauuagaggccagguguggcucacaccuguacucucaacacuuugggaggcugaggugggaggaucgcuugaagucaggcauuuaagacaugccuaggcaacauagugagaccuugacucuacaaaaaaauucaaaaguuaaugagacaugguggcaugugccuguaguccuagcugcuggggaggcugaggugggaggaucacuuacgaccaggauuucaaggcugcagugagcugugauugcaucacugcacuccagccuggugacagagugaggcccugucucaaaaaaauuuuucaguguuuuucugggcugggcgugguggcucauuccuguaauuccagcacuuugggaggcugagguggguggauugcuugagcccaggaguuuaagaccagcugggcaacauggcaaaccucaucucuacaaaaaauaaaaauaaaaaauuagcugggcaugguggugcacaccuguacuaacagcuacgagagaggcuaaggugggaggaucaccugagcccgggagguugaggcugcagugagccaugauugcaccacugcacucuagccugggcgauacagcaagacccuaucucaaaaaaaaaaaaaaaaaaaaaaaaaaaaaacacccaguggggucaguagaaccccaagagucuucuucccucccagcuccccuguacaccagccccagcucugcagguagcugggggcccagacagcuuccuggggacccccagccuucccucugcccuuuuuucuaccaguuuugcugccccuccuucaagacucauguccagagggggugagaucugcacuuauacagcccccuccucuguaaugagugagccaagucagcccagguuauuccagaaggggcacccuaccagccccccaguccccaagcugcccugggccuauaaaagcaggcaaggggaccccuaguagaucauguagguguuaccucuuagugggugcuggaggggccugaagugcuuucuucccccagggugguaggagaauguccuggcagugacuucagggcccgcugucacuuccguuuuaagacucaccagcugguaggcucauuagcaagaggacaauaggaggccccuguccucagucagcuuucuucaaagguguuuccuuuagcaacugggaggccucccuucuccagacccauggggacaacaccacccagcuacugguucuauaagcugcuguauggcucuggcuagcccauucagagaaagccucugaaaguacaaggaaaaaaaucaguccaagagcugugaacaauuagugagccgauuacaauaccaagaccacaggcagaccuggaaggcuaagugagcccaggugugaaguucaagcuuacuuuacuucugggccacuuccuggcuggucucuuucccuggcccuuaucuuucuccuggucugucuucucuucucacccccuuucuuuacucuuucuuccuucuccugcaucguacuccacccccacuccagcuauuacacagaaucgcgagaauguuggauuauucauuuuauuuaugauguuuucuuuuuuguaaaaauagagacaaggucucacuauguggcccaggcuggucuugaacuccuggccucaagcaauccucgugccuuggccucuuacagugcugggauuacagaugugagccaccaugccuggcccauuuuauuuacuuuaaaaaaaaaauuaggcugggcgcgguggcucacaccuauaauuccagcacuuugggaggccaaggugggcagaucaacugaggucaggaguuaaagaccagcuuggccaccuggggucaggaguuugagaccagcuacuccggaggcugagaccggagaauugcuugaacccaggagguagagguugcaaugaacugagaucaugccauugcaugccagccugggcaacagagcaagacugucucaaaaaaaaaaaaaauuauguuuugugcuccugcuuccugcuuuguaagucaaaucaguuuaacuguucaagugucuuccuugcaaacccccaaggacucaaugugugucgcccuugacugauccccccgccccgugacccagugguccucaguuccagguuuucccaccuacccuucacccacugcuuauguuuauaaaaacgggguaaaucaaauguucgugacccagaucuuauucuacaugcaguggaaacuuguaugacuuaagcuuuuuggaaaagcagaaccuuuuuucgugguucaagaaaucaaagucuucccgggaggucuuucuguaaauccagagcugcagauguuugaccguguucagagaggggcccuugugcugggugaaguggauggggcacagcaggcaaugggugaaaagcaggacaaccuggggcccugggaggaccagggagggcccaugucuuugacuguucaucagccggcugacuuccuguccgccugucgucugcucugcccauccauccguaguccuuccgccugucucugcugguugccgcugugcuacucagcugugucugucuguccgccugacugucugcucuccuucaggaugccuuccgugccuuccaucaagaucucaauuuugugcgcaaguuccuacagccccuguugauuggagagcuggcuccggaagaacccagccaggauggaccccugaaugugagccagagcccuaggagaggcucagccccugagggagggggauggcuggagggcugggagacauugccacauggccaggagcagcucccucggcauucgcccaaggggaugcagagccagggcugagccugcccuccccucccagggggcaggcaguugaaagugaagcuguagggaugcccugagaaguccagggcuccagaucugguuuagccaggcacccguuuggaucccgaggcaagcucccucccuguugucgcccaguguccccaucaaaaggaggauuuugaugaacugauuucucuccuggcuguagcgucuuacccaccccauaccuuuugggagggagaggaggcuucaccaccagccagugcuccagcucacaccccgggcuggguacucuugucacuucauuccucuuugcccacaccccuugggccuggcgaugggaggagcggcuggggcuccaggagaauggggguggggaggaauuucuuccuuggcugaucggccccucugcuauggcaggcgcagcuggucgaggacuuccgagcccugcaccaggcagccgaggacaugaagcuguuugaugccagucccaccuucuuugcuuuccuacugggccacauccuggccauggaggugcuggccuggcuccuuaucuaccuccuggguccuggcugggugcccagugcccuggccgccuucauccuggccaucucucaggugaccccaguucuguguugcagccaccuuaacugcccaacagacgugggcccccaugcaucugggcauugugaacauauuugcuaaaugaaugaauggaccuaugaaaggaugaauggaugaauaaacagaugaaugagugaacagucugaaggcccaucaggcaugucugugggucaagcugcauuccagaugagccaagaaguuccuucuugaacagauuccgaucaagcacagggccacugagccagaggcugcugcccugcagcuucaugacacuuacgagccccuccaccucccugggacucaguucucaucuguaaaaagaggacacuggcccacaagggucuugaaauggagcauuagcacggggguacccugcaagcugaaaggauucacuggggccccaggcccuggcgggcuccguccuucccaacagcuucugacccugccucucuccccaggcucaguccuggugucugcagcaugaccugggccaugccuccaucuucaagaaguccugguggaaccacguggcccagaaguucgugauggggcagcuaaaggugagggugggguggguggucagccaggugcuggguggcgcugggucugcccaagugugugggcacagucgggggcacagccugcccugagagcccccuccuccuccacagggcuucuccgcccacugguggaacuuccgccacuuccagcaccacgccaagcccaacaucuuccacaaagacccagacgugacgguggcgcccgucuuccuccugggggagucauccgucgagguggguggggagggacguggacaaccucuggcugggccugcagcugagggggagcuaaugcacuggguccccacucugccccugaccuagccccugaucuggccuccacucuggcugggccaagcucugcccccgugucuuuccuucccaccucccaaccugcuggggacgaccagcccgcuugcuagaaucuagaguugccuuugacccuuggccccagccagccccgugaccuugcccgggagaaggagguggccuggagagcugcugucuccagccgccgccugucuccacaguauggcaagaagaaacgcagauaccuacccuacaaccagcagcaccuguacuucuuccugagugaguguccaucuguccuucuggggugggggagugccugggccugcacuguccucccugcuguccuggaccacucccagccacuuccuggggcggggcacgucugucaggucucccuggucauggcauccucccagccucugcagucuguacacacucucccagcagcaugccuuugccccagcugucucccgugccugggacaccuugcagccacgggccaucacagcccugcugggagcuuccccaagccccacguagaauuucuucuugcccucacuagagugguccggagcccuagagucuuugggcaguuguuggggcggacagagugaggacucaagucuggcccugacuugcggugaaggguggugggagguggugggguaagggcagccuggggaggcuuggacacagaauugggggugauauggggucauucagcuggaugugaccagcaccaacgucccaggggcauuccuggaguaacagagccccucacucuggcgcccacucaccuuggcagcccagccccacuccugaacacucucaugccccuucuugcagucggcccgccgcugcucacccuggugaacuuugaaguggaaaaucuggcguacaugcuggugugcaugcagugggcggugagugggguugcccaggaccccgggcauacggcugccguggcaggagguggugccucgggggacaguaccugcccaugaaggcaaacagggugcacaugugcgugcaacaguguggcucacauguaugcgugcaacaguguggcucacaugugugcgcgcagcaggagagcgagugugcccgugacuguacgugugguggggggggguugaggaacagggggggugugggucucucucggugagggugucuucccaggaggaguugcugggcugacucugccaggcaucugugucccuggcagggucuuccccaacacacccugcaugacaccuucgucacuaaaaucagccucgugagcuggcagggcaaggacccuguuccuuuacucagcugagaaaaccagagagggugguggccuguccugggcucugaggcaaaucaggcagaaggguuggaugccugagguccuccucccacccaccaggccuccagaccuccgggcaccuggagaccucucgguaucgccucugcccuccucugcaggauuugcucugggccgccagcuucuaugcccgcuucuucuuauccuaccuccccuucuacggcgucccuggggugcugcucuucuuuguugcugucagguauggcagggaguggcgaggucacacacaggcgacaggugacccccacugcagccccccaccagagcuucccuuuucccgucugcagaauggggccagugguacugccucccuggcuugcugguggaaucacauaaacacaagcguggcaggagcccagggucgguggguuuagggagcguggccuggcuuguaaguggcccggugggugucggagcugcucuggacucagccucacaguggacacugcuccauucagauucuuuaaacacuggcaagggggcgauggccacaauccuauuguacagauaaggaagucaaggccacuuggggacagcugcucuccagccuccacucagggugccuaaguggugagcuggaccuagggcagugcccgagccuccccacaggguccuggaaagccacugguucguguggaucacacagaugaaccacauccccaaggagaucggccacgagaagcaccgggacugggucagcucucaggugggcagcagggguggggcccauccugggugggguggggggucccagcuaggagccagauggcaaagcagggaugaggcccugacggggcugccaggugggggauggugccguggggucagggaucugcaacggccuccucacaugugccccgccggcuuccggcagcuggcagccaccugcaacguggagcccucacuuuucaccaacugguucagcgggcaccucaacuuccagaucgagcaccagugagugugggugcugggggccagugggagguggggaggggguccugggaggggauccugggaggggacccguggguggggccucucucuggaaucucccacuucaggugccagcauacgcuccccacccccagccucuuccccaggaugccgagacacaacuacagccggguggccccgcuggucaagucgcugugugccaagcacggccucagcuacgaagugaagcccuuccucaccgcgcugguggacaucgucaggugaggcugcagcccggccccucuguucugguggcuuccccagggccuaugccuacccuuguccaggucagccucaugcugagcccccagggucccugagccuuucuguccacgucccaugcccuuccucccuuccccagccuucacgcacacagugagaauuucuggagcaccuacugcagacucacaaacagcagugccugcggugagcaggucuaugcaaaccuacccccaaaggcugagggaaagaagcuaacagauccaguuucucagaaggaaacacuuaacagggacucauaaacagaagccaugucucagggccgggugcgguggcucacgccuguaauuccagcacuuggggaggcugaggugggcggaucacuugaggucaggaguucgagaccagccuggccaacauggugaaaccccgucucuacuaaaaaaaaaaaaaaaaaaaaaaaaaaaaaaaaacaaaaauuagcugggugugguggcaggugcccauaaucccagcuacuugggaggcugagggaggagaaucacuugaacucgcaggggcggagguugcagugagcugagauugugccuuugcaguccagccugggcaacagagcaagacucucucaaaaacaaacaaaaaaaccaugucucaggcagccaagaguugggacauccccucacacgcccucuagaaagaacccucuauauagcaagcuuuuagggugaaccccaugcaggugguucuuaugaaccuggugaccacuggagguuagauaagcgucuacaagaggagguuaucuaugccaugagcuuggcauucagggucaagcaucggucaucagacaguuuugcuugaagauggcauugcccuuguagcaaugcaggcucuagagagcuuccugcccucuuggagcugauguuccuuccagcaaaggaaacagcaagcaauuaaaauaacaaauaaguacauuacagaagaugggcaaaagaacaaugaaaagccccucaggguggggacaggggaggggaggggggcggccaggcaggggcggcaguuucuaaauaggugguagggugggcaguauugacaggcugacgugugagcagggacagggaggaggggagaggucucgccacagggacaucuggcaaagagcguucaggcagagggcacuugacccugaaugccaagcucauggcauagauagccgaggcaggcaugcaggcacucagagaagggacacgcccggcuugcaucuuggaaagcugccccuacugggaaugacuggcgggcaggagucgaaguggaaaaggagagcagaggacacugcagccauccaggcgaggggugauggggcucagcccuuguggucaccuuggagguggagaacagaggccagauuccaggucuuauaccucugcgccuuuguacacgcuguuccccuuacuugguugcccuuccuuccugugcugguguucagaugcccacuucuccuucaugaucucucccagccugaugcucugagccccugccauuuggcacagcccuuuagagcgccuggcacagggcuuccuagcagauuguugacauuucuggcuccacugaccaauaucaggcccaagaucgggugggcagguuccacguccucucuguccuuggguugcagcgcccagcaggaggcagcaauggagaacugggugcaggagggacaggcccacccaggcucaugccuggacuuggccuuggcugcccuccagcuccccuacccgacacccgucaccccggucuagauuccauuccagagaaugagcauucagcuguucucccaacccacccuccagcccgcaucgcugccugcccccagggaagggaacccacagggaauggggaucuccgcucacacuuaccaugggggauacagggguguuaggaucuugcaacugagcuccuaacacccacccccacugccacccccaccucccaggucccugaagaagucuggugacaucuggcuggacgccuaccuccaucagugaaggcaacacccaggcgggcagagaagggcucagggcaccagcaaccaagccagcccccggcgggaucgauacccucaccccuccacuggccagccugggggugcccugccugcccuccugguacuguugucuuccccucggcccccucacauguguauucagcagcccuauggccuuggcucugggccugaugggacagggguagagggaaggugagcauagcacauuuuccuagagcgagaauugggggaaagcuguuauuuuuauauuaaaauacauucagauguauuauggaguggaguggugaauuugcaugaguuuugaagcuggggucugcccagacuccccaacagcauucaggcccucggccaucaauguguguguuggggccggcggcgggguugagggggagcgcuaaggagcucccuuuagcucuagaugcccugggccugggagcccagggaugccuggacucggaccugcccgagggccuauucacuuccuauucaugcugggcuucaagucacuugacgcuucugcauggugggaugagcgggcccagcagaugaggacccagggcugggggccaugucugcggacgcuucuggacauggacugggaaagacgguugugccucuugaccugcacuggccucccacagcccuccaugauggggggccugaaagggccccgcgcagcgggccaccugcugaucuuagcgccacaucuggcaucacaccaguggugguggugcagccugugcccgguggcccaaggaggcaacgucgaucucccucaagcccaccugggaccaggugcuugucuguaguuacugcagugaauaggcuggacccccgaggcauggccauuccugucccugagucccuggagucaggucuuaggcuccuugucuggcagugggcuggacugugccuguggguuucggacaguucuggggagggcuuugaguugccucuuggggcacccagaauugggaagaagaucuggcuggaccaaucaguccccagcauccacacagccugacagcuccaagcugagcugaggguuucaucugaagugucggcagcuugaaaaagaaagcugagugaggauuucuaugaggccuuucuggagugggagcuggggucgcccuaccagcugcagggguugcccccuacuuuuugggcuuccauuggccuggacuggguucucuuugggagguggaaaaggcgcaaauucugccaauuuuuguucagccccuccaaggcccauccuccgugggacggagcuggaggggaagccccacugccccaucaacccgcccccuacuccacacacauacaagguggcgcugaguguugcugcccaugaacuucucuuccgagacagccagaaagcuccucagugcuaaagcugaucaccguagucucacaccugcuuccucucugugaggaggggccgucugcacauucccauggacucuugcggcucuucccaggggcuccccuucuagaaaguucucucugacccgcagggcuccuccccuucccugcccagccugugacuagggucucugugacggcaccuggaauacugacaucauuugcugcuggaggcugguggcagcccagagccuggcccgggagacccugggguguguuuucugagaggaugacagacaggguguuuggguccugcuucccucacccugacuucuggggcaggagagcacugggggagguccuguucggcucacauaaucucccagacccaggagcagacagcccaaagcucccuauggccucccggcccagggcagugccagcagaggccuccugguagggccagggaagcagaggguggcagccccuucagcuugguugugagugagaugccugcccuccuccgggugccacccagccccaccggauccacucaagucagacagacuugggggugggguggggugggggcaaguccuguuucugccaggacgcaggcugugugaccuugggggaguuccuugaccccgagcagcaguaccuagggugauggaagaaaggcucuuagcaaagggcacagcagcaggcucaguuuauucacaaauuuugugcacacaacccaauuccccaggaugaccauuugcucugucaccuagggcaaguucuuuuuugccuucccugagccucaguuuucagccgaggguaagauuggaugcuccuugaaagguacuuccugccucagacacacgcuucucauggccagggcgugccuugcauucagggucucugcacaggcuggucccucugcagggacucccccuuccugucaccgccuguuuaaauccuguuggcuccuagugccacgcgggcgcccugagccagcgcaggcuccgaauggcauucccuccguccacacccugguagagaucgcugugcgcuggcuccgaggcgcucgccagggagaugcuaacaccgaggauccacgacagcugagccugcagcgccacccaggggcgcccggagcaucugcgccaguguggggcgggccgugcucccuacugucccugguaacuugcuuugcggaccccugggaggccccgccuucagcagcc

SEQ ID NO: 18749 - RNA, 21361 nt, Homo sapiens
ggcugcugaaggcggggccucccagggguccgcaaagcaaguuaccagggacaguagggagcacggcccgccccacacuggcgcagaugcuccgggcgccccuggguggcgcugcaggcucagcugucguggauccucgguguuagcaucucccuggcgagcgccucggagccagcgcacagcgaucucuaccaggguguggacggagggaaugccauucggagccugcgcuggcucagggcgcccgcguggcacuaggagccaacaggauuuaaacaggcggugacaggaagggggagucccugcagagggaccagccugugcagagacccugaaugcaaggcacgcccuggccaugagaagcgugugucugaggcaggaaguaccuuucaaggagcauccaaucuuacccucggcugaaaacugaggcucagggaaggcaaaaaagaacuugcccuaggugacagagcaaauggucauccuggggaauuggguugugugcacaaaauuugugaauaaacugagccugcugcugugcccuuugcuaagagccuuucuuccaucacccuagguacugcugcucggggucaaggaacucccccaaggucacacagccugcguccuggcagaaacaggacuugcccccaccccaccccacccccaagucugucugacuugaguggauccgguggggcuggguggcacccggaggagggcaggcaucucacucacaaccaagcugaaggggcugccacccucugcuucccuggcccuaccaggaggccucugcuggcacugcccugggccgggaggccauagggagcuuugggcugucugcuccugggucugggagauuaugugagccgaacaggaccucccccagugcucuccugccccagaagucagggugagggaagcaggacccaaacacccugucugucauccucucagaaaacacaccccagggucucccgggccaggcucugggcugccaccagccuccagcagcaaaugaugucaguauuccaggugccgucacagagacccuagucacaggcugggcagggaaggggaggagcccugcgggucagagagaacuuucuagaaggggagccccugggaagagccgcaagaguccaugggaaugugcagacggccccuccucacagagaggaagcaggugugagacuacggugaucagcuuuagcacugaggagcuuucuggcugucucggaagagaaguucaugggcagcaacacucagcgccaccuuguauguguguggaguagggggcggguugauggggcaguggggcuuccccuccagcuccgucccacggaggaugggccuuggaggggcugaacaaaaauuggcagaauuugcgccuuuuccaccucccaaagagaacccaguccaggccaauggaagcccaaaaaguagggggcaaccccugcagcugguagggcgaccccagcucccacuccagaaaggccucauagaaauccucacucagcuuucuuuuucaagcugccgacacuucagaugaaacccucagcucagcuuggagcugucaggcuguguggaugcuggggacugauugguccagccagaucuucuucccaauucugggugccccaagaggcaacucaaagcccuccccagaacuguccgaaacccacaggcacaguccagcccacugccagacaaggagccuaagaccugacuccagggacucagggacaggaauggccaugccucggggguccagccuauucacugcaguaacuacagacaagcaccuggucccaggugggcuugagggagaucgacguugccuccuugggccaccgggcacaggcugcaccaccaccacuggugugaugccagauguggcgcuaagaucagcagguggcccgcugcgcggggcccuuucaggccccccaucauggagggcugugggaggccagugcaggucaagaggcacaaccgucuuucccaguccauguccagaagcguccgcagacauggcccccagcccuggguccucaucugcugggcccgcucaucccaccaugcagaagcgucaagugacuugaagcccagcaugaauaggaagugaauaggcccucgggcagguccgaguccaggcaucccugggcucccaggcccagggcaucuagagcuaaagggagcuccuuagcgcucccccucaaccccgccgccggccccaacacacacauugauggccgagggccugaaugcuguuggggagucugggcagaccccagcuucaaaacucaugcaaauucaccacuccacuccauaauacaucugaauguauuuuaauauaaaaauaacagcuuucccccaauucucgcucuaggaaaaugugcuaugcucaccuucccucuaccccugucccaucaggcccagagccaaggccauagggcugcugaauacacaugugagggggccgaggggaagacaacaguaccaggagggcaggcagggcacccccaggcuggccaguggaggggugaggguaucgaucccgccgggggcuggcuugguugcuggugcccugagcccuucucugcccgccuggguguugccuucacugauggagguaggcguccagccagaugucaccagacuucuucagggaccugggagguggggguggcaguggggguggguguuaggagcucaguugcaagauccuaacaccccuguaucccccaugguaagugugagcggagauccccauucccuguggguucccuucccugggggcaggcagcgaugcgggcuggaggguggguugggagaacagcugaaugcucauucucuggaauggaaucuagaccggggugacgggugucggguaggggagcuggagggcagccaaggccaaguccaggcaugagccugggugggccugucccuccugcacccaguucuccauugcugccuccugcugggcgcugcaacccaaggacagagaggacguggaaccugcccacccgaucuugggccugauauuggucaguggagccagaaaugucaacaaucugcuaggaagcccugugccaggcgcucuaaagggcugugccaaauggcaggggcucagagcaucaggcugggagagaucaugaaggagaagugggcaucugaacaccagcacaggaaggaagggcaaccaaguaaggggaacagcguguacaaaggcgcagagguauaagaccuggaaucuggccucuguucuccaccuccaaggugaccacaagggcugagccccaucaccccucgccuggauggcugcaguguccucugcucuccuuuuccacuucgacuccugcccgccagucauucccaguaggggcagcuuuccaagaugcaagccgggcgugucccuucucugagugccugcaugccugccucggcuaucuaugccaugagcuuggcauucagggucaagugcccucugccugaacgcucuuugccagaugucccuguggcgagaccucuccccuccucccugucccugcucacacgucagccugucaauacugcccacccuaccaccuauuuagaaacugccgccccugccuggccgccccccuccccuccccuguccccacccugaggggcuuuucauuguucuuuugcccaucuucuguaauguacuuauuuguuauuuuaauugcuugcuguuuccuuugcuggaaggaacaucagcuccaagagggcaggaagcucucuagagccugcauugcuacaagggcaaugccaucuucaagcaaaacugucugaugaccgaugcuugacccugaaugccaagcucauggcauagauaaccuccucuuguagacgcuuaucuaaccuccaguggucaccagguucauaagaaccaccugcaugggguucacccuaaaagcuugcuauauagaggguucuuucuagagggcgugugaggggaugucccaacucuuggcugccugagacaugguuuuuuuguuuguuuuugagagagucuugcucuguugcccaggcuggacugcaaaggcacaaucucagcucacugcaaccuccgccccugcgaguucaagugauucuccucccucagccucccaaguagcugggauuaugggcaccugccaccacacccagcuaauuuuuguuuuuuuuuuuuuuuuuuuuuuuuuuuuuuuuuaguagagacgggguuucaccauguuggccaggcuggucucgaacuccugaccucaagugauccgcccaccucagccuccccaagugcuggaauuacaggcgugagccaccgcacccggcccugagacauggcuucuguuuaugagucccuguuaaguguuuccuucugagaaacuggaucuguuagcuucuuucccucagccuuuggggguagguuugcauagaccugcucaccgcaggcacugcuguuugugagucugcaguaggugcuccagaaauucucacugugugcgugaaggcuggggaagggaggaagggcaugggacguggacagaaaggcucagggacccugggggcucagcaugaggcugaccuggacaaggguaggcauaggcccuggggaagccaccagaacagaggggccgggcugcagccucaccugacgauguccaccagcgcggugaggaagggcuucacuucguagcugaggccgugcuuggcacacagcgacuugaccagcggggccacccggcuguaguugugucucggcauccuggggaagaggcuggggguggggagcguaugcuggcaccugaagugggagauuccagagagaggccccacccacggguccccucccaggauccccucccaggacccccuccccaccucccacuggcccccagcacccacacucacuggugcucgaucuggaaguugaggugcccgcugaaccaguuggugaaaagugagggcuccacguugcagguggcugccagcugccggaagccggcggggcacaugugaggaggccguugcagaucccugaccccacggcaccaucccccaccuggcagccccgucagggccucaucccugcuuugccaucuggcuccuagcugggaccccccaccccacccaggaugggccccaccccugcugcccaccugagagcugacccagucccggugcuucucguggccgaucuccuuggggaugugguucaucugugugauccacacgaaccaguggcuuuccaggacccuguggggaggcucgggcacugcccuagguccagcucaccacuuaggcacccugaguggaggcuggagagcagcuguccccaaguggccuugacuuccuuaucuguacaauaggauuguggccaucgcccccuugccaguguuuaaagaaucugaauggagcaguguccacugugaggcugaguccagagcagcuccgacacccaccgggccacuuacaagccaggccacgcucccuaaacccaccgacccugggcuccugccacgcuuguguuuaugugauuccaccagcaagccagggaggcaguaccacuggccccauucugcagacgggaaaagggaagcucugguggggggcugcagugggggucaccugucgccugugugugaccucgccacucccugccauaccugacagcaacaaagaagagcagcaccccagggacgccguagaaggggagguaggauaagaagaagcgggcauagaagcuggcggcccagagcaaauccugcagaggagggcagaggcgauaccgagaggucuccaggugcccggaggucuggaggccuggugggugggaggaggaccucaggcauccaacccuucugccugauuugccucagagcccaggacaggccaccacccucucugguuuucucagcugaguaaaggaacaggguccuugcccugccagcucacgaggcugauuuuagugacgaaggugucaugcaggguguguuggggaagacccugccagggacacagaugccuggcagagucagcccagcaacuccuccugggaagacacccucaccgagagagacccacacccccccuguuccucaacccccccccaccacacguacagucacgggcacacucgcucuccugcugcgcgcacacaugugagccacacuguugcacgcauacaugugagccacacuguugcacgcacaugugcacccuguuugccuucaugggcagguacugucccccgaggcaccaccuccugccacggcagccguaugcccgggguccugggcaaccccacucaccgcccacugcaugcacaccagcauguacgccagauuuuccacuucaaaguucaccagggugagcagcggcgggccgacugcaagaaggggcaugagaguguucaggaguggggcugggcugccaaggugagugggcgccagagugaggggcucuguuacuccaggaaugccccugggacguuggugcuggucacauccagcugaaugaccccauaucacccccaauucuguguccaagccuccccaggcugcccuuaccccaccaccucccaccacccuucaccgcaagucagggccagacuugaguccucacucuguccgccccaacaacugcccaaagacucuagggcuccggaccacucuagugagggcaagaagaaauucuacguggggcuuggggaagcucccagcagggcugugauggcccguggcugcaaggugucccaggcacgggagacagcuggggcaaaggcaugcugcugggagaguguguacagacugcagaggcugggaggaugccaugaccagggagaccugacagacgugccccgccccaggaaguggcugggagugguccaggacagcagggaggacagugcaggcccaggcacucccccaccccagaaggacagauggacacucacucaggaagaaguacaggugcugcugguuguaggguagguaucugcguuucuucuugccauacuguggagacaggcggcggcuggagacagcagcucuccaggccaccuccuucucccgggcaaggucacggggcuggcuggggccaagggucaaaggcaacucuagauucuagcaagcgggcuggucguccccagcagguugggaggugggaaggaaagacacgggggcagagcuuggcccagccagaguggaggccagaucaggggcuaggucaggggcagaguggggacccagugcauuagcucccccucagcugcaggcccagccagagguuguccacgucccuccccacccaccucgacggaugacucccccaggaggaagacgggcgccaccgucacgucugggucuuuguggaagauguugggcuuggcguggugcuggaaguggcggaaguuccaccagugggcggagaagcccuguggaggaggagggggcucucagggcaggcugugcccccgacugugcccacacacuugggcagacccagcgccacccagcaccuggcugaccacccaccccacccucaccuuuagcugccccaucacgaacuucugggccacgugguuccaccaggacuucuugaagauggaggcauggcccaggucaugcugcagacaccaggacugagccuggggagagaggcagggucagaagcuguugggaaggacggagcccgccagggccuggggccccagugaauccuuucagcuugcaggguacccccgugcuaaugcuccauuucaagacccuugugggccaguguccucuuuuuacagaugagaacugagucccagggagguggaggggcucguaagugucaugaagcugcagggcagcagccucuggcucaguggcccugugcuugaucggaaucuguucaagaaggaacuucuuggcucaucuggaaugcagcuugacccacagacaugccugaugggccuucagacuguucacucauucaucuguuuauucauccauucauccuuucauagguccauucauucauuuagcaaauauguucacaaugcccagaugcaugggggcccacgucuguugggcaguuaagguggcugcaacacagaacuggggucaccugagagauggccaggaugaaggcggccagggcacugggcacccagccaggacccaggagguagauaaggagccaggccagcaccuccauggccaggauguggcccaguaggaaagcaaagaaggugggacuggcaucaaacagcuucauguccucggcugccuggugcagggcucggaaguccucgaccagcugcgccugccauagcagaggggccgaucagccaaggaagaaauuccuccccacccccauucuccuggagccccagccgcuccucccaucgccaggcccaaggggugugggcaaagaggaaugaagugacaagaguacccagcccggggugugagcuggagcacuggcugguggugaagccuccucucccucccaaaagguaugggguggguaagacgcuacagccaggagagaaaucaguucaucaaaauccuccuuuugauggggacacugggcgacaacagggagggagcuugccucgggauccaaacgggugccuggcuaaaccagaucuggagcccuggacuucucagggcaucccuacagcuucacuuucaacugccugcccccugggaggggagggcaggcucagcccuggcucugcauccccuugggcgaaugccgagggagcugcuccuggccauguggcaaugucucccagcccuccagccaucccccucccucaggggcugagccucuccuagggcucuggcucacauucagggguccauccuggcuggguucuuccggagccagcucuccaaucaacaggggcuguaggaacuugcgcacaaaauugagaucuugauggaaggcacggaaggcauccugaaggagagcagacagucaggcggacagacagacacagcugaguagcacagcggcaaccagcagagacaggcggaaggacuacggauggaugggcagagcagacgacaggcggacaggaagucagccggcugaugaacagucaaagacaugggcccucccugguccucccagggccccagguuguccugcuuuucacccauugccugcugugccccauccacuucacccagcacaagggccccucucugaacacggucaaacaucugcagcucuggauuuacagaaagaccucccgggaagacuuugauuucuugaaccacgaaaaaagguucugcuuuuccaaaaagcuuaagucauacaaguuuccacugcauguagaauaagaucugggucacgaacauuugauuuaccccguuuuuauaaacauaagcagugggugaaggguaggugggaaaaccuggaacugaggaccacugggucacggggcggggggaucagucaagggcgacacacauugaguccuuggggguuugcaaggaagacacuugaacaguuaaacugauuugacuuacaaagcaggaagcaggagcacaaaacauaauuuuuuuuuuuuuugagacagucuugcucuguugcccaggcuggcaugcaauggcaugaucucaguucauugcaaccucuaccuccuggguucaagcaauucuccggucucagccuccggaguagcuggucucaaacuccugaccccagguggccaagcuggucuuuaacuccugaccucaguugaucugcccaccuuggccucccaaagugcuggaauuauaggugugagccaccgcgcccagccuaauuuuuuuuuuaaaguaaauaaaaugggccaggcaugguggcucacaucuguaaucccagcacuguaagaggccaaggcacgaggauugcuugaggccaggaguucaagaccagccugggccacauagugagaccuugucucuauuuuuacaaaaaagaaaacaucauaaauaaaaugaauaauccaacauucucgcgauucuguguaauagcuggaguggggguggaguacgaugcaggagaaggaagaaagaguaaagaaagggggugagaagagaagacagaccaggagaaagauaagggccagggaaagagaccagccaggaaguggcccagaaguaaaguaagcuugaacuucacaccugggcucacuuagccuuccaggucugccuguggucuugguauuguaaucggcucacuaauuguucacagcucuuggacugauuuuuuuccuuguacuuucagaggcuuucucugaaugggcuagccagagccauacagcagcuuauagaaccaguagcugggugguguuguccccaugggucuggagaagggaggccucccaguugcuaaaggaaacaccuuugaagaaagcugacugaggacaggggccuccuauuguccucuugcuaaugagccuaccagcuggugagucuuaaaacggaagugacagcgggcccugaagucacugccaggacauucuccuaccacccugggggaagaaagcacuucaggccccuccagcacccacuaagagguaacaccuacaugaucuacuagggguccccuugccugcuuuuauaggcccagggcagcuuggggacuggggggcugguagggugccccuucuggaauaaccugggcugacuuggcucacucauuacagaggagggggcuguauaagugcagaucucacccccucuggacaugagucuugaaggaggggcagcaaaacugguagaaaaaagggcagagggaaggcuggggguccccaggaagcugucugggcccccagcuaccugcagagcuggggcugguguacaggggagcugggagggaagaagacucuugggguucuacugaccccacuggguguuuuuuuuuuuuuuuuuuuuuuuuuuuuuugagauagggucuugcuguaucgcccaggcuagagugcaguggugcaaucauggcucacugcagccucaaccucccgggcucaggugauccucccaccuuagccucucucguagcuguuaguacaggugugcaccaccaugcccagcuaauuuuuuauuuuuauuuuuuguagagaugagguuugccauguugcccagcuggucuuaaacuccugggcucaagcaauccacccaccucagccucccaaagugcuggaauuacaggaaugagccaccacgcccagcccagaaaaacacugaaaaauuuuuuugagacagggccucacucugucaccaggcuggagugcagugaugcaaucacagcucacugcagccuugaaauccuggucguaagugauccucccaccucagccuccccagcagcuaggacuacaggcacaugccaccaugucucauuaacuuuugaauuuuuuuguagagucaaggucucacuauguugccuaggcaugucuuaaaugccugacuucaagcgauccucccaccucagccucccaaaguguugagaguacaggugugagccacaccuggccucuaauuuuuuuauuuaucuuuuauuuuuugagacagagucuugcucugucgcccagacuggguugcaguggcaugaucucggcuuacugcaaccuccaccucccagguucaagagauucuugugccuuagccuacugaguaggugggauuagaggugcaagccaccacaccaggcuaauuuuuguauauuucguagagucgggguuucaccauauugcccaggcugguguugaacuccugagcucaagcaauccucccgccuuggccucccaaaguguugggauuacaggcauaagccaccacgcccagccaauuuuuuaaaaauuguaguaaaauauacaugaaauuuaccauuguaagcauuuuuagguguccagcucagugguauuaagugcaugcacaguguuguccaaccaucaccaucauccagcuccagaaccuuuucaccuuccccaacugaaacucuguccccauuaaacacuaauucuccauucucuccucccccugccccggcaaccaccaugcuaccuucuguccauacagaucugccuccuccggaaaccucaucugggagaaaucacauguuuguuccuuugccucuggcuuguuucacucagcacaauguccuuaagguccauccauguugcagcacgugucaggauguccuaccuuuuuaaggcugagccagcgugauggugagucccucuuucuccuuugaaacuccccagacacacacgcacaugcagacacacccaccagcccacaccagcaggcaucacucagacacucagaaacaugcccacaaucacggcccacaugaacacucagccaaacacagccuugcacacaugguacgcaaagaugcagcuggcacgcacagacacacccggcgcaacgugcaagcuguggcugcggccccagaaucuccucccucccagcccuucccucuaucaccccaugucaguucuggggccaccuuauugagcugaggaucuuggguccagauuggucuccucgccuccuuucccguugguccugauucacccaggccagcccugucgaggcacugacaggggaggacagaaccaagccugccccagggccuucaagccagaucuaccccuugcaaugauaaggggaagugugagcccccucagggcugugucagagaaccccaaagccauugacagggcuccagcuggggaagggacagguggggcugugacaguucccugggaagcaggcugggcucucagagcugggugggcacccuggggcugugcuucucaugcuaucagggagugcgaguagggcaggggccuggacucaggccgaaaccuggaagcaaacagccuucucuggaacuggcugaggucaugugaccugguccucugugggccucuccuuaaggaugggggugccaggcagaagcuaagacucagagagguuaagcuacuucuucaaggucacacaguuccauuugaccgagguuagaucagaguccaggucucuucucacucauaagugagaguugaacaaugagaacacauggacacagggaagggaacaucacacaccggggcuuacugggcgggugaggggcaaggggagggagagcauuaggacaaaugccuaauguauauggagcuuaaaaccuagaugagggguugacgggugcagcaaaccaccauggcacauguauaccuauguaacaaaccugcacauucugcacguuucccggaacuuaaagugaagaaaacaaaaacaaaagcgaaaaacugugcuugucgccacuccuggaacagaggggaagcagcaguucuccuagguggugugcggggguccuugccgugaggccagucacuaucucaagaagccaagggcccagcugcugggagccugggcuggggggcaggaaggcgguucuuggaccucaucaguggagccucagggaacugugggaggucccacccucacacacccuaagugcacccaggaacauccacccagggguacgugcacaaagcccuguccccccaacccccacacgcacccaagcgaguggaaagcggcacucgacgucucucaucggguaccggagcagagcugggugaaagugcuggaaucaaaacggcaccccuaaacacaagcuccuggagguagcgacaggcucuguucacaguggcauccucagaggccggcacagagcagcugcucaacagcagguaugaacaaguagacaagagccaacccuccacagcccccaaagcaggggcacgaaccauuuugcuggugaggaaaugaaggcucagcgggaagggacaccugcccaggucccaguuaguaguggcagagcugggauucgaacccgggcccaucuucugugauguucaugcucucucaggauacagagacagcucagccuggccuuggucccuggaagccuagaguggcucaguuggccccaagaucccacgcccugcccaagccccaccgugaaucccacacagcagcuggucgggggggugucccagagccagccugcccaggauggaaccugagcugcuauccaggagccagggagccccagacaagaccacacccaucucucaucaguauuucucaucaguaaacugggaaccacaaauccccaucucacaaggcugcugggaggaugcagucgguggcgcuaaagcacuuagaaggggccuggcgguuggcaagagcuccacagcccagcucuuucugagcccugcagcccugaugagccuccuccugagaguccacuuagagguaagugccugcaggaggggccuacaggugucagggaagagaguggagaagcugcuucucugccugccuguuaaguccuggccaagccugaggcugggagagaggaggggcuggcagccuccuuccaccccagagacacagcagggcagggagggauuuugggucacucccuaggagaaucaagaaugugccagaucagucaggaagggggugaagcagggaguguggcagggcugcugagggcucagguggucggggucuguccucgcugccuucucaugccuuuguaggauguuggggugacagggcuaugccucaaaggacacccccaggacauuccugccucuccccucucccagguggguggguacagcaggagcgugcccagcacaccaugcuccgucccauccucucccuggcgcccgucagaggaggccaguggggaagcacuaucaguaucccauuuuacagaugaggaaacugaggccccaagaggucccaaagaaacacagcucuaaacaugggacauccaaauuuggccuguguagcggagcccaagucgaaggcagacacccccaaaaagcuaccccugucccccagcaccccucaauguccuggugaagggugggcauauaugugagggcuccugcagccaggacgcuuggccucacaagugucccugaccccacaguagccccaaagcagcuauacccucuggcuccugguccucucuccaccacugaccucuggcuccacuacuggagccuggcuguuucaucagaaacccgcaggaagagaccgggagggaugcccaggggcaguauccugcugacgccagacaaucccaacucuucccacaaggaaggagcaaggcacugcagccccucuggggaaggggccugggugggcgguggccuugcagaaaacgccugcggggagcccagagcagucacacuucaugggaguggccauuaggggacuuucaaggcagucaaugugguaggagggaguggaguggcucuggagccaccccccaaccaacuccuguggccucagaucugccuaauccuaguccugucccuccccagcucccacccagacacaaaccccacccucguggcccgaguacaaaggcccuacccuucaaggguccugagaagguuccauuacaccccccaguuucaaacucagucuccucaucuacaaaaugggcuaacaauaggacuuaccucauaaaguuguuaggcgaauucaaucaguuaccacaucuaaaccccucagaacagugccuagucaauaacuguuggcugcaauuacuaugaagcagccucugcugcagcacuggccacucccuccuccagcucaggccaggcucagagaaccaccuagaaggaggguccuaaggcagagggcucagggggucugcuggaacuuggauuuucccacaguuguuagggcuucagccgaaagggcaccaggggcugcugggaaacuccucauccgcccugaguugcugugggcaaugcauucaccacacccaugaauagagcuuuguugcccaugguaaccaggcacccaggugcccagcaccacccucauagugugcccaggacaaaagcauucucauccucaucacacuaauggggaaacugagacccagaagugaaaggauguguccaagaucauagagcgaggccaggcuggcucccucucuaaagacaacaugaagcuaaaucuaaugugucuaauggcucucacuggaccagugugccuguguccacagccucucuugcucucugcccuggccacacucuaccucuucugaguggccucccuugggggagggcaggucuccauccucccuucucuuacccuucuggaaggcucugccuucacucucuccauuaaggauccuuuuaaauguccaucagacuccccaggcuucccugcugugcucucuggggcuccccauccucuuuaaaauaaagccaaaguccuuccgaggacacaaacauccagcaugagccagcccggccgccucuagaccucacugccaggcccucucuccacugcucucugcugcagccauacuguauuccuggaacacaggacgcacggucccaccucugagccuuugcucuagcugaucccucugcugugaacucauucccuguagaaguuuugcucacagcuacaucuucagaggugagaaccaugcaugacacagagaagaugcucacugauggauuuaaugagucaaacauugaagaaucaaugagugccggaaauaaacaggauagguggcagcauagcaugcccuuaagaacauggcuguggauucaaaucccagaccaaucacugaauuucaagccacuuugccucucugagccucuguuuucucaucugucaaguggcaauaacaauaaaugguacgugccucauaggggcaccuugaggauuaaaagagaggguuucaauaaaucaaguacugauuucaaaaccuggcacauaguaggcacucagcacauggcccuuauauacuuauggccagcagcggcugggccucaucccucccuggcuggcuccacuaguaucaggcugccuaugacucucagacaaaccuggccaagggcccagaguacucuccccagggcacccggccuugugucccaagauggccacaggcugacuucauggcacagaaacucugggaauuuccuggcaggaaggcuucauugccuggacuugagaacagcugaugggcagccggggcuggugagaggugaccgcuggaacacaucccuggcaacuggcugccccaccuccaccugaggccaccgcccgggaugggaugccuggggccugggcucaacuacacagggcacugggcuggcccaaccccuggucuacccuguggguucaucauggacaaagacugauugcaccaucccagcaaccucacagucccuuuggccugaauggaccaaguauuucuggcaacucuaguccaggcuguggggccuugagggagcuaagagacagccuaaagugucccuuuccuacuucagauaggaccguaaccaaauaaggucacccaggaaagggguagccgugcagggcugucccaccauacgcugcaguuugcagggcacgcucacacuuaggggccagcagcauuuaccgaauacaaacuacuaccuggcagcccugggccaugggcuugaggagacacaguccugcccucagccagcucacugucugccccagcucucccacuuuacagaugaguaaacuggggcacagaggagugacaugccugcuucaaggucgcucagugccuccaauagcagagcuggcacccggccccaaggagcagagagauguuuuuuguuuguuuguuugagacggaguuuugcucuuguugcccaggcuggagugcaauggcgcgaucucggcucaccggaaccuccgucuccuggguucaagcgauucuccugccucagccucccaaagugcugggauuacaggcaugcgccaccacgccuggcuaauuuuguauuuuuuuagaagagacaggguuucuccauguuggucaggcuggucucaaacucccgaccucaggugaucugcccaccucagccucccaaagugcugggauuacaggugugagccacagcgcucggccugagauguuuuuaaaacagauauuauuggcugcgaaucaaugagaaaacugugugauggaagucucaggaucccaagcuaaauguuaagucaguaauuccacuugggaggaaccccagcaugggccuggcaccaggcaggaaacagugaugaaauaaaagcuuucuguaucccagccgggcgugguggcucacgccuguaaucccagcgcuuugggaggccgagguggguggaucacgaggucaggaguucgagaccagcuuggccaacauggugaaaccccgucucuacuaaaaauacaauaugcugggcgugguggcgcgugcccguaaucccagcuacucgggaggcugaggcaggagaaucgcuugaaccugggaggcggagguugcagugagccaagauggcgccauugcacuccagucuggguggcagagcaagacucugucuccggcgguugguggggaguaaaguuuucuguauccauacuguccucuagguuacaaaagacuagagcaggccgggagugguggcucaugccuguaaucccagaacuuucggaggcugaggcaggaggaaugcuugaacccaggacuuugagaccagcccgagcaacauagugagacccugucucuauuuuuaaacaaauaauaauaaauaaaauagauacuuuuuuagaaaaagaccagagcaggcauccacaagacuccuugaagggaggccagggcucagcaaggccuuuggggagaagccgugccccucaccucgccacgcccuggcagaaaggcaggcacacacaccacacucacccagacaugcaaacaccugcacgcucaaauacugcccccaggcugcuucaucccacggcugugcuguccccucgggccagcgucuggcgccugaacagccacggacaaggcguucucuuuuuuuuuuuuuucuuuuuuuagaauuucaggaggauucuuauucucacuccucagcuucaugggguggaaggggaaaagaggggcuuucuuccucaaagaguccagugaagauuguccaacaugcuggagauggcaaucggcagagagcagguggcccugucaagagggacgccgacaguccugggacuggacagaaccuccgcugcugcccaaaaagccagcauucaggauucauguccucgggucuugaagaccuuccugauacccaguguggccaaccuagaaauuuggagggucaaggacagggcaucguggccccaaccccuauuaugcagguggguaacuaaggaaaaggggcuggucgggcugcuccaccacuggacuccagccagacaguacccuggggccaggcuacaucccugccugucuagacaggggcugggauugggaaguugggguccccaggggccagccuguuccuggggugacugugcuuccaggagaggcccacccagccuggcuggcaaagcccucccacgugcagcugcuagcccggagaggugagucacugucccugagcccuuuacagaagcucuugggaaagccacagaccucaggccggcccagcccccagccucuaauggcauguccuuaccggccccuggggacccugcccugcccuaccccuagcacucagcaagcacccagcauggggacccagaacugaaacagggaccugggagcaacagggcagccccucacccagggcaggcucugcagcaugacacacccaccucugaggcccccuccucccccgcagaccugcuccguggacagcugcggguccuccacgcagggaacugcccucccuaccccacaucuggcccuggcuaguccaccccaacucugggucccggcguggaggucaaaggucagcgaggggagggaggaugcuaaggccccacagguggagcgggacaucacgcccacgaccgagcuccaggcuccacccgccgguggguggcuuccuuauggcuuccuuaccguggcguccucagcgccgugguggccgaugaggcggcugcccccugggugccgcugugcccagcggcugaugucguagacgcggcgcucgaugaccagccacuugucgccgggcuggucgugcgcgcggaucugcucccagcagaaggugggcagcggcgcccccggcugcgcgggucccucccgcggucccggcuccccgacgccgcccaugcugcacgcacgaguccuggggaucccaggcgguggccgagguccgagcaagaccccgagggaagcgaagagcgcucccgggcgccgccuccgccgccgcccgcugcuccggccccgcccugccgccgcggccgccguacgagcgagcgugcgccucccggcucgcggcgcagggaacuccccgccuuauaaccgcgcggacggcgcccgccucgccucgccugcccccccgcccccggccaggccccggcccccaaggcuggcugaccccccgcguccgcuccaauccaggcgcggggccucggucuccauuggccgccagggagggcggcgucgaggcggcccgccccucccgggaggacagcggccgccacccagcccugccccggggcaccgucccgcccccuuuucccgggcugccggcuuccagguucuugacuccacccggagcgcggggccuggggacacaacacgcaccuguugggcgucccgcagcgccucgccacgcccucgggaaccggaggcggagucccggucugugagcagcggggccuggggggcuuccagccgcgcguccugcaacgucaaauccagugcgcccagaggggggacgcugucucggggugccugugaacagccuucaaaccaugggccccaaucucugcggggcccccaccgccgcugcagcucucucggagcccucugcugggggcggguggccuccccuccgcccucggcgcugcagggcuggggaugcccagggguggccaagggggagguaggggagcaggagggcacuggcgcguggaggcgggcgcugccauccaugggcugaggacaccugugcuuguuacugcuuccccgccccucuuuuuuguuuugagacaggagucucacucugucgcccaggcugcaguguaguggcaugaugucggcucacugcagccucaacauccuaagcucaggagauacccccaccucagucucgggaguccccagcugggacuacaggcgcgccccaucauacccggcuaauuuuugguguuauuuuauuuuuguagaaaugggucuugccauguugcccaggcuggucuugaacuccuggacucaagugacccucccgccucccaaaaugcugggauuacaggcaugagccacugcacccgggccccauccgcu

SEQ ID NO: 18750 - RNA, 39340 nt, Homo sapiens
ggaacgcgggaggauguggaacccgaggcggggggagccggaggggcgggcagaggaggugucgaggcccugagcucccggggaguuuuuacuggaggcaaaaguccauagcgggagggcugagggaggggcggaggaaggggaccgcuugggggcacugggaagccagggauccuccgccaggaaggcagggacacucccgagcgcaggcgagaaggcugggggagggggcgcggugggaggaguaggagaagacaaaagccgaaagcgaagagggcccgggcugcacacaccggcugggaggcagccgucugugcagcgagcagccggcgcggggaggccgcagugcacggggcgucacagucggcaggcagcauggggaagggagggaaccagggcgagggggccgccgagcgcgaggugucggugcccaccuucagcugggaggagauucagaagcauaaccugcgcaccgacagguggcuggucauugaccgcaagguuuacaacaucaccaaaugguccauccagcacccggggggccagcgggucaucgggcacuacgcuggagaagaugcaacgguaagggucugggggcgccccagccacccuucucugcugcaggcggagucaggaucccuggcuccccgugggccaaacagaccuccggcgcugaauggagcuugggacguccuguagggaaggaaagugcaucuauugcacucguacccccuccccaauccuccuccuccucugggccgacugggguggagaccggaucugggacccggggaggcggcgcugcggugaaagucccagcgguggagaacagggcaagcaucuaccgcgcgcgccgggacccacgcguccuccccuuccucgggguuugucuggaggcagggacuccccaagaggggcgcucgggccagacggcuuuggcgcccccagcggggaagauggccgccccugcgcgccgcugaaaggagcgggagcgcaggcagccaggugugggacuccgcgcuugucccgcacucuccauccagacuggguggcgagaaggaaagcucguccccggccggagaucgcuccugcugggacucuugucuaagaaguuccucaauggccaccugggaaaaaccgcccagcagcucggguucccacgcuccagggauuaucuagacucaccccaagcucgagccggccuucuuggggaccggcguccgggauugguggaaggagaacggccugggguuugcaaagcccaggucgagugaggccuugagccgguggauuuagcagcacuagacuggcuuggcaacagguccgucugcacucgagguuacucucgggcguucaacucaauggcucucucuuuuuaaauccugccaagaacacccuucccucaucuugcacuccuaaagguugugggccucucuggagccauugcugcccaccuuacccccaccaaaugcguggcucagugauuaccccgcaccagcuacccgcaccggggaccccagucugaaauccuggcauuuauuuaaggaugcagcugguaucccauggauucgaaugggccagaaggaaaagaacagaggcaaggagggaagaaagggcggcuuuugguggugguagugaauuggaugcagagaaaaaaggucugaugggauacagaaauuggggaaagugaauaggagagaggcagaaaggagggaugaacuugacguagaucauuccaccuggaggucuaggaugcccaacuguuggugggcuuuugcucucuaagcuguguaggcccgacccuuaacuuccccaccucuugcaucucauggagacaggccuaggggaaggccagaccaggccaccauaacccaagcuggacaauggacagguggugugggccagcagggccagggcuuaucuaagauugggaaggucagcgauacugaaauucccuacagcuuucagucccauccuguuuuacuugcuuguggacauugcuuaagcccaguggguuugugaugcuauuuagaacuuagguggguauguuucacauaccuucagugcuaucucaccuggaccuuuacgcggcccagugaggagguuggguuaauguaacuccuaaguaaaggaccuucuggauccuggcugggaucuuuccacuauauguugcuggacuugggcuggucuguuucugauuucauagguaaauuguagaagguuccuguccuguccaggcccucaccaaaaaguuuccagaaggaaaagucaaauacgaugaauuuggucugauuauuccacauuguuaaacauauuuucuuaugugaacgcuuagucuggcaauugccuugaccuuucugguuuaauuaccauaucagauugauuuauuucuuccuuguucuggauguucucagugcuuaccugaccuuaacacugaguucccuccaaaaaucagugcucacaucucuccuaacagaggacuagaaugaccuacucuucccugaccuuuucucugucucauaaaaauguaauagucucgucauuucugguccugcuccagcgcuuucuguauaacuuucauggacuauaaaucugguaucuuggauguugguugcuuuguuacuuucauaagcuagggugggagccaaccggggcugcaaacagaucuagaauugaagaaagaugucauuacugggcucauccacuaaguguugucacuugacugagccccaucuccucaucuauaagguacaccuguaccuguuucaaugagacugauuuguggcaaagcacccagcaacuguaaccacuagaugaaugcaaugggguguuaucaggcaaacgggaauaagaacaaguauuaugaaacagcuagaauggaaaguaugcaaagaggaauuugaagaaaaaauuuaaaucuaugcuagcuuuauuugguguagcaacacguaaaagcaaucccuguccccagagcuuccugucuucuaaaauaagacuuuuggggcaugaaauacacgaacuggggauacagauuugaaugauggugaugauggagugagcagcuggguucucuuuguuuuguuuuguuuuuuuaaacuguccaggaccagguuggaaaaaggccuugagcagcgugggguggguggggcauguggaaaggggaccuaaagagagaagcaggaacaggcuacugaaauccagagacccuugccuaggcuguugagcaaguggcuuugccccuuggggugaugguuugucccccagagcauggggagugacaauuuauggaccaggcacagucuggggagggacugaucagaagacaguuuggauucccugcaacauucccaggcaauguucugagcccaucacagugcagucauuccuaacacaaggcuggaaacaggucggaagucaagguagccauucuugggacaauccucgaagucagggaagccauucucgggacaaucaggggccucaauagggcauuuucuuuuuuuugaagagcaaaagauccagguagucaagauccaucucccuagaaggauggggcaacuguuacgugguccuuccacagaagcuaaacccugaccuugccuauaauaaugcaaguugcuugauuuuugcaacuuacaaaacacauucauauguaucacuucauuucauacucggaucagccccguaggcaucucucacugcucugagguaucaaaccuggcuuaaguggcagugcucagacuuaaacucagaaucugaccucaaguccuccccucccagcuuccuucccuuccuguugcuaccucugaucucuucccuuugguacugcggugcuucucucgccuuuuccuugcugugggcaaaaggaacccucacccgcgcccuaagagcgugucugcucuuuucacagcagucccaccacugcagaacuguucaucuucagcgacaauucaucaaacauuaauugagugucuccauggcucugagcugggcccagacacagagaugaauuauucacagacagagaccugaagcugugggaugugcucccccugcucucucucaagcuggggcuuggaucuggacccucugccucuagacaucagcccccuaccccuagcccuugucucagcaacuguuccugcccggucugcauuggugaccucuuagaaucaagggaaggugagaagagaccagagguuuguuccaccuuucaaccugcuccuauguuauucuugugaaaacgcaacagaucgaaaguggaacucuggccuccuuugcacggggcaggaggguuguaguauuuagaggcaggagaccuggguuccagccccagcuuuaugaauucccaggccuggagggcagcuccaucuccccagcugagaucugggugggagcuguccaauuucuguggcuguagccucagcauccccaggaagcaguucugagaugaaaguggagaauggcaucaauuucuucaugcccagguugccuuuguaggggccugucuccugugcagcccugccuuucugcccucaggguagugcauggacccuguguuaugggggaggcucucacugcggggcucuuuggccacagagcacugccccaccagccuccauugcuucuuuccuuggaggggacauggcauaggggcuuccugcccugccugccucucucugcugcagaaaggaagucagcaucccugucuugcucuucauuuccacuggagaaugcgaggaucccuccugugcaucuccacacucuuagaucacuuguuccauaaaguucugguccgcagggcugccaccuacugcacugugugcccugugcuugcccgugcugcacuucccaaauccuaggcaaagugcccaguugugcagcauucgaucagagauuagccuugcuccccagaggacaugggcacggccauaaacaaauccuggcaccaggugcucaguggauggcgagcaacugugaguuguacccagaguggggcaggggcagggaaaaugucccuguggagaaguugacuggcaucagaccugggugauggcagaagcaggaacuggcaaagagcgaagugugacaagcgcuucagaaucaggguguucugaccuccccaccucacacaccugcccugccgaggcgggugcaucucugcuuucuccaccuguuuaccaauccuuucucuuccccaugucccggguccucuuccuggaaagucucuggcuucucucccguuacacuaggauagagccugguuccaauucuugguccaaagacaaaguuuggguuggcccucccuugccuugaauccuggucugccuuauaccugccagauauuucuguaacccggcaggugcuggaaaccuucugccagcguuugagacacauuuauggcaaugugaagggagagacacaaaauauaaucaacucucagggaggaggacacucauguugagggaagccuuuguaugaacagcgggcaaugcucaagguagccacaugugacucaaacucuacucagcucauucccgagugugauagugggcagguggcucugccaaccuacgccugauuucuuaucucuaaaaaaggaccugccucacgaaguuugguaaagaugccuggcugauguaugcaagccacucccauggccccguggcucgccugcgucaccucagcagguggcagcuguagcaaccaccagcguggggaugccggagaaggcuuuugguguuccagaggcagaagccaaguugugugaaacgcggaagaggacaagugucuggucaugacugcacagugggaaaguaugagaucagagugugugcagcugugggguccuggguccauuuauucccucgugagccaucuuauuaggccccguuacaggcacuguguuuauugcagcgaacaagacaggugcaggccuucccaacugggguuuaugcuccagcgggggacgcaggccauaaacaaguggguacgucacgcagucugaugacgaaccuugaugacugcuaugaagaucuaacagggcaaugacccagggaaggcccagggcugggagagcucuuuuggaugugauguugggaaaagccucuuggaggugauguugaggcugagucccgaauggaggcagcccugguguggaaaggagcgugguauguucaagggcgguccgcaccaggccugcucggaaagcugccacacugaccaugggcaaggagcugauccaacagacugcucgguuuucuaaaacggcaggaagcguguggcacgugagaaaagaguccuuagaggcagauggaccuggauuugauccuggcucugccaccuggagcccaggacuuugcuuccugagcuccugcaucuucaccucagaaguuggggcuugaggccuaagggaguaacaugagcaacacuccuggcucccugccuggcgcaugcccauuaccccugggcucagggaggugaggcugcccgagagcccucuggaaauggcugagcagcaaccaaggucaaggcagggcucgucaucugucugcucccuuggaguuggaaccucgacugcaggguucggguguuggggaggcagcaggaguggagaugagucuauuugcaagccauugagucuugccuuucaaugagacaagaggaauccauuaguuaucagccacugcagcugcuucucaggaaacugccuuaccagggacuuccuguucauuucucaaaggccguggugugaugugaggaggaccaaugaaggggcuuuuucaggcccagcccugggcccugacuuuggcagcuccuccgggccucucccagggccuugcucauuuugcauaggcggcugaggcucugguggggacugaucaccccacccagagccagcaaagcuggucaccacugcaacccugggcuccucccugcccgcacccugggccuccucccugccugcccccccaccccagcccuccucccugccugcccccagggccuccucccugccuccccagggacuucucccugccuccccagggacuucucccugccuccccagggcccuggaauagcacgucucuuuucccugaaaauacucuugaccugauccucugcuaccaucccuuuucggcucggcuagugggucacaggcauuuuuuaagaaaccgugggcccaguuuucuccugcacgaaguguugcuuugucagucuguucuagacacaaauagaacaaagaccaagcaaaggacuugaugccagcaaugcaguaaggagaugaugggagacuggcaguuacccuugggagauccuuacguguggggcugaaaagauuuccaggagugguuagcacuuucuccaccuucccccgacccuuuuuuuuuuuuuuugagauggagucucgcucugucgccaggcuggaaugcaguggcacgaucucagcucacugcaaccuuccaccucccuggcuaaagcaauucccugccucaaccucccaaguagcugggauuacgggcgugugccaccacaccuggcuaauuuuuuuuuuuuuuuuuguauuuuuaguagagacgggguuucaccauguuggccagucugaucucaaacuucuggccucaggcaauccgccgccucggccucccaaagugcugggauuaccgcacccggcccccucuucuuuuuaauuuugaaauuuucccaacauccuuaaauguugaaggaacaagcaaacaccuguguauccucaaccaagauucacuagucuuaacauuuugccacauuugcguuuuuccucuuuauaugugugcaguugccuuuugaaaauaagcugcgucauugugugaucacaucccuaaggucuucaacauuuccggagaaaaaaggaagagaugcucuaacaucaucacaguaccuuugucacauuuaagaaaauuaauaguaauuccuugauaugaucaaauaucugguccauauucauuuuuucucauucaacucccgaaaaaccugguauaacuucuuuuuuccuucaagugagagccugucacauuaaagaauugcaggauguuguuuuguuuguuuguuuguuuguuuuuugagucaaagucucacucugucgcccaggcuggagugcaguggugcaaucuuggcucacugcaaccuccaccuccugguuucaaaggauucucaugccucagccuccugagcagcugggauuacaggcgugcgccgcuacaccuggcuaauuuuuguauuuucaguagaggugggauuucaccauguugcccaggccgaucucaaacuccuaacuucaggugaucgcccugccucggcuucccaaagugcugggauuacaggcaugagccacugugcccggccuguuuguuuuuugagacagggucucacucucuugcccaggcuggagugcaguggcaccaucauugcuuauuguaucuuccugccucagccucccgaguaacuggaguuauuggugcaggccaccaugccuggcuaauuuuguuuauucuuaguagagacaggggucuugcuauguuacucaggcuggucuugaacuccuggccucaagugauccuccugccucugccucccaaagugcugggauuacaggcaugagccccugcgaccagucaagaguugcaguuuuuauaucauuuuagucucuuuuaaucuagaccaugcuuccguacuuuuguuuuuuccacaaacuuguauguuuuuccccagcuauauugauuuuucugauuguuucucaugguggaguuugacugguuugccaauccuaccaaugucuggaagcuugauuugaugcagauuacacaguguucaccacugggacauucuauugcauccccucaggggagccuggugcuggcucaucucuaauagaaauacuagauuuuuuaugagauaauucauguaauaugcauaauauguauagaaaaaagcuggaaggaaaaaugcuaaaauauuagcaauaaugaccacuuucugggugauauuuauuuuccucuuuauucugcugugccuuuucuaacuuggccaaaacucagcacguuuuuacuuuauaauugggaaaaaaagauuaaaauguguaucauuauagcaguguuagaguuuggaaaguaaugaaaauaaagcaaggcauaauccagcuaccuuaacaugugcaauaauagccuagauccuccuaggcuuuuuuucaggaacgcuuuuuacauaauucuguguuuauuuuuuuauuuacuucaucacagcacauuuccagugccaagguaguauucggucuuguccuuuucauugaccacccuggacauguaggugaggaacuaguaagagaugguggguggugugguuugugcaccaugcaaggcacucagcucacgagcagucgaggcucaaguccucccugagccccgugucugccuggugcgccuuccuggagggucaccauuucccgaccugcccaaaggcagccuaugcaucuauucacaaaccccuggggaguguagcaugccugcaccagcacagaagcccagguggcuguugccauuggcguugggcacugagggcucuguccuggaaaaaugcuggagacggcauuuggggccagaucacaggagaccccguuuggugucugggugcacacauggagcuguugcuggugagcacuguccuccuuggggcccaagagcagacagaguucaggucuuagccucaucacugcccucugcucuccaggaugccuuccgcgccuuccacccugaccuggaauucgugggcaaguucuugaaaccccugcugauuggugaacuggccccggaggagcccagccaggaccacggcaagaacguaagucuggcuugcaaccuggguggggguggagacgaggcuggggguggcugggagucugagagaggcuccccuugccccaugaccaguaacuggggcugaggcaggggugcuuuuguccuggaggagccacugugguucaccuguguucagggagggccucagagccucccugggagccgggguuugacaacaacuaguggcgucuccucucuccuggccaguuucauuuuccuucuccuccaucccuuuccaggaaggugccagaugacaaucuaggggaaagacaggacagaaacaccgaaaaaugucauuugaugacaagaguggcuuuggggugugugguccggggcaccucuuugagaaagaaugaccauucccuggucaucuguucauugucugcaggucagacgccccccugggugcugggcuuccaggacagccaugugugaaaauagcaaccccugaggucucaugggcuguuguuuuguucaacaaugaagucuccauguaaauggcggagccguuuauagaagaaaguugggacaggaggcaggggcagggcaggacggggaggagaguuguuacaaggagaggagugguacccacaggcugugaccaggguggucauggaagucccacccuggccucagcaagcucuuccuccucuuguugccagccugggccagaccccucuguuuagcagagccagggcaggaccagggucucucccggccuggacucuuggccagucccccaccacccccauugccucuggcuuuccugaugagcugcgggccacccugcagguccuucaaaggccaaugccccuccucucaccuugcccuccauggcacaugagaucaccugcccuguacccaugccagcccaugcuuguccccuccugccuccuucgcaaguggguccaucucccacucucaccuccagcaccuccuggccugcggcuuccccagcucugcucguccugcccuguagcucccuuguccauggccuugcuccuuggcucucuccacugcucucccuuucugcugcagauccugcaccauuuagcauccaagcucccaccaggcaccaccagaaccacccuucauagcaccuuggucaugcccuguggguaccgcuccucuccuuguauccacucuccuccccguccggcccugccccugccucuugucccaaguuccuucuuccucgcaaugccauuguguucccagggcccuccuugacuccgcuuugccucccuggcuccaugugcccgggacucacagcccccuccugccugccucagcucgcccuccugcgcuaguuugugucgcccccaacucaaccccucaagacccaacagugugcgcagagcaaguggugcucuguuuggugguggaaaaugcaaguuuuauuuuucuuuucuuuucuuucuuucuuuuuuuuuuugagauggaguuuugcucuuguuacccaggcuggagugcagugacaccaucucggcucacugcaaccuccgccuccagguucaagcaguucuccugccucagccucccauguagcugggauuacaggugcccaucaucaugccuggcuaauuuuuguauuuuuaguagagauggaguuucacuauguuggccaggcuggucucgaacuccugaccucaggugaucugccugccucggccacccaaagugcugggauuaaaguuuucuuuuuuaaaaaaguguggucaaccauuuuggucauuugacguguacaguucaguggcaucaaauaagcacauuuacauuguuauguaaccaucaccaccauccaguucucaucuuccccaaauugaaauuccacauccauuaagcacucacuccucauucucccaccucucagccccuggcaggcaccauucuacuuucugucucugaauuuggccucuccaaggaccuccuguauauggaaucauacaauauuuguccuuuggugacuggccuguuucccuuagcaugaugucuucaaaguucacucacauuguagcaugugucagaauuuccucccuuuucaaggcugaguaauauuccauugcauggauagaccacguguugcugauccauucauccaucacgagaucuuuguguuguuucuaccuuuuuccugaugugaauagagcuaugaacacaggguguauaaaaugcaagcuuuugagucaaagccuuucucugucacucuuaccuagcugugacaaauauacaggccccagggcuguguggggcaugugguaacagcagcuauuguagggacuccuggagggucgaggcuuguggcuuggcccccucuugccacagcuucucuggguugugcauuggcuguugaaauggcagcucgagacauauguucccuccagaguggcugguggcugacuccuuucccugugcucuuggucaacagucaaagaucacugaggacuuccgggcccugaggaagacggcugaggacaugaaccuguucaagaccaaccacguguucuuccuccuccuccuggcccacaucaucgcccuggagagcauugcaugguucacugucuuuuacuuuggcaauggcuggauuccuacccucaucacggccuuuguccuugcuaccucucaggugaggcgugacacccucacuuccccuagcugacagaggccuggugccuguuugcugaggcugugacagcacgugugacccucucuccccaggcccaagcuggauggcugcaacaugauuauggccaccugucugucuacagaaaacccaaguggaaccaccuuguccacaaauucgucauuggccacuuaaagguaagugucagcagcccugggcaucuguccuguuggacagcaguugagacagagggaccaggauuccucucugcucagugcucugaggcuacagggugacaaggcaggugugccuaugcugagggccauggugacucuccauucugcugacuuccugagcccugucucuggaucagguccgaaccacaaagccaugguguacuacucauuaugaagacaggcacacaccuuucuugucuuuuggcucagcggauuguauuuuuugauguuccuuagcuaaggacucaucuaacaaaucuguuuuuguuuggggacaguaaaguagcaguauuuuuuuuuuuuuuugagacagaguccugcucuugucacccaagcuggaagcaauggugugaucuugggucacugcaaccuccaccuccggguucaagcaauucuccugccucagccucccgaguagcugggauuacaggcacucgccaccaugccugacuaauuuuuguauuuuuaguagagaugggguuuugcuauguuggucaggccgguaucaaacuucugaccuugugaucuaccugccuuggccucccaaagugcugggauuacaggugugagccaccgcauccggccuguagcaucuuuuuugaugaguugguaugcuuccuuucacuggggaugugagcucuuuaauacguugugcugggugugguggcaugcaccuguaaucccagccaccugggaggcugaggcaggagaauugcuugagcccaggaguucgagaccagccugggcaacauagugagacccccccccaucucucaaaaaaaaaaaagaaaaagaaacacauugugcuccucucuuccccucagaagccaagagguacaaagcagcauuugaaacagcaacuaucuuuagucuguguuuuuggugcccccauucucuccuuccucaucuggcauuuaugcuuuuaucuuuauuuuagccuuccguuauauaugagucuuuuaucucaagccacuucaaauacucuuuggaaauaagcgggguacaaaaaguaaaagucauccuauaaggccucagauaggggacaccaaacuacggaaugaucagcuggcccaaaggacaaaagucauuagaagugcaggaguuaaggaaguuccacucucaccucccccuagauaaggaagcagaccacagagucucagcauguuuguagaaagacaagcuggaauugccaacugccuuguucugaucugacaggcguuaucuccucaguuuugaaaaugagucuuugccaacuugcucucugaaauagacuauccccaucccagccugacccaacaguaccugcuuccugagaaaagcuggguccuaaagaauccaucccuccacacccuggcaagggacgagcuacaugugggguguagcuuauccccucuuccacccagaccgcaacggggcccuuggcuugccggcugcagaucucacugguggccaaccaccccugagcuggucaccaguuucgcagcgagcagcuugccuggcccugagccugaagcggccugagaaccuggucucuguccagaaucucaggggcaaagggagagggugcacauaguggagugcuuuguuucauuuuauacucuucucuguuggaucaaacccuccucaguauggcaaaguaacauuuaacuccugacccauguuagcccccacacacuuaacaaagaugggcuguguccugcuuccagauucugggcaggggccgggcaggggggauuguuccuguccaauugcccucagucuuugaggggccccagagcacggcuguugcgucaggcgggagacggggccaggacagaggacuggucuccauguagaacguggaugacagcaaacaggguccuugggcuuggggaugugggcuccacucauggcccaccagcccccacuggcuguguccuuggugcugugucacagagacaggccaaggacauggacauguggcucacucaggggugccccagagcacggaggucaagcuugccugaaauuggcucuagcacucggcaggugcacagccauggggacaaaucuuguaggucugugucucuucccaucacugggaaaaaggggacuggcuacagggagguccucaagggccucgccaacucagaugucuuagcacaggcuggaaagaccugugaguagguuaccaggugcugugagaggcugggacccccuucuuccuguuggcugcacugcuaaugggauuuaaugggaguucuucacauccugaccuguuugccuucagcccgugucaugcccaguggacauuucuuccaaagugugaucuuuuacaaagacgauucugagguuaaaacucuuucguaguucagcacuguacuuaggaugaaaugcaaacuucagccaggcacaguggcucacgccuauaaccucagcgcuuugggaggucaaggcaggaggauugcuugaagccaagaguuugagaccagccugggccacauagcaagacccugucucuacuaaaaauaaaagaauuagccggggaugguggugcaugcuuguagucccagcuacuggggaggcugaggccggaggauggcuugagccugggauuugaaggcugcggugagcugugauggugccacuacauuccagcaugggugacagagugagacacugucucuaaauaaauaaaugcaagcugaaaggcccagugccaucugggcgcugcaucuggaaauggacaucaccagacuuucugcagccucaucucaggccaccagggcugggauuagggugaaacaaguaaggcacucgcuuaggguauaaaaucuaaggggacaccagacaaauucuaaggggacaccagacaaauucaguuaucaagauaaaugauguuuuaaugcaaugugguuuuguuuuguuuuuugagauggaguuucacucuugucgcccaggcuggagugcaauggcgugaucucaacucacugaaaccuccgucucccggguucaagcgauucuccugccucagccucccgaguagcugggauuacaggugugcgccacuaugcccagcuaauuuuuuuguauuuuuaguagagaugggguuucuccauguuguccaggcuggucuugaacuccugaccuaaggugauccaccugccuuggccucccaaagugcugagauuacaggcaugagccaccacgcccggccugcaauauguuuuuaaaaaaaucaaaauuaaugcaaaaaaauccacaaugaacaaaauaucaaaauuuuaaauaaagaucaggaugaacugagggaaauggaaaaacaugcaacccucuaaacauguucgugugucauuuuuuaaugguugauuuuuuuuccagaggauuaaaguaguuaaaaaaauauuuaacaaugaagaaguugauguauuaaaagucauaacauucuaaguguaaaugcuuuauuuauaccaaaacagaacuuauuauacuuuugcuucaguugaauguaauuagaaauuaguuaagaccgggcgagguggcuuggccgggugugguggcucaugccuguaaucccagcacuuugggagggugacgcagguagaucacuuaaggucaggaguucaagaccagccuggccaacauggugaaacccugucucuacuaaaaaaacaaaaauuagccaggcgagggugcucgggaggcuaagacaggagaaucacuugaaccagggagguggagguugcagugagccgagaucgugccacagcccuccagccugggugacagagugaggcuccaucucaaaaauaaaaaauaaacauaaaaauuauuuaagcuaaucgcuugguugacagaaaccaucaaacucagcaauucuuuccauugaaaaugaaaugaggccaggcgcgguggcucacgccuguaaucccagcacuuugggagguugaggagggcagaucacaaggucagaagaucgagaccauccuggcuaacacggugaaaccccaucuccacuaaaaauacaaaaaauuagccgggcgugguggcacacgccugcagucccagcugcucgggaggcugagacaggagaaucacuugaacccgggagguagagguugcagugagccgagacugcaucacugcccuccagccugggcgacagaggaagacuccgucucaaaaaaaaaaaagaaaaaagaaaaaagaaagaaaaugaaaugaggcaaaaaguaggcuuugaaaauguuaucgaugaguuuguuuccauuaaagccagaagugcacuuuuuuuuuuuuuuuuuuuuuuuuuuuuuuugccucaggcucugauauggcgccacccagcacugcuggucacaguuauaccgaggagcuuuccucuggcuucuggagcacucuacacucccccuuccucucccagggccucccguaggcucuugccucugucaggaaagcaccccucacucugccuggccaacuucuccagcugcguggacacuuagcuuuccuggccccagcucaguuuggguuuggugugaugaggccagacccucccucgcagcuccgugaggacaagggcuuugucucuugguucaccucccaggcagagcacggcagcuggcuuaggguaggcaacaucugcaccacauucugggaacacggagcuggccauuguuccugggcaaggcgggcuucccggugcccggaaggaggggcucuugaaggacaagcagggcuucaccuggcaaagaagaauggaagagaggcccggugcgguggguuaugccuguaaucccagcacuuugggaggcggaggugggcggaucaccuggguucaggaguuugagaccagccuggccaacauggugaaaccccaucucuacugaaaauauaaaaauuagccgggcaugguggcgggcgccuauaaucucagcuacucggaaggcugagguaggagaaccugggaggcggagguugcagugagcugagauugcaccacugcacuccagccugggcgacaagagcaaaacucugucucaaaaaaaaaaaaaaaaaaaauggaagagaaucacagcagaggaaguagcaugaacaaaaaaugcuuucauuacaucucaucccgaguccagggagaaccgggacugcccaccucacugccuccuuguugucagcccgucuugcuuuccuccaucuguuuguucaauaaacaucucuggguugguauccuccaaacaucacgcuuacuuguuucaugccuugcuccucaguuucuuugugccagagauuuuuccauuugauucuucccaggaauuuuguuccuuuugacaacaaacgcaaaugugucauuugauuccucgagccucuaagcuuucuuucuuucuuuucuuuuuuuuuuuuuuuuuugagacagacucuugcucuguugcucaggcuaaagugaaguugguaugaucuuggccuccuggguucacaggauucuccugccucagacuccugaguaguugggauuacaggugcccgccaccacgcccagauaauuuuuguaguuuuaguagagacgggguuucuccguguuggccaggcuggccuugaacgccugaccucaagugauccacacgcuucagccucccaaagugaagccucugagcuuucacucucugacuuuuuuuuuuuuuuucucucucucucucucucucauggguuuugaggccugccaguuuccagggcccugagguuacugcaaaggccacagcuguccguugcuguucccacccauggcuauuaguguccauagacugugugugccaaaagcaucucccaaguaaaauguuuguuuagcaaauaggcauuuuuugcaaacccuuagccaaagcauugauccggcaacaguucaccaggauagucgugaugccaaagggucaggaaaguguguuuucuuucaucugucgcugggcaacugucgagggccauaacucugagcugaggagacggacaccuguggccucaaaagaaauauccauguuaugugucuugucucaugggauccuauuugaguguuagaaacaggaaaguucuucuuguucauguuagcaguuguuuguugagcccucccuccagccuuccuggugugacacgaaucucaggacccacccucagcauagcagcacaacugcgcucuccaaaucguuuauugagauacaguucucacuuuuuuuuuuuuuuaaacagagucuugcucugucucccaggcuggagugcaguggugugaucucugccucccggguucaagugauuuuccugccucagccucccgaguagcugggauuacaggcgcccacaaccacgcccggcuaauuuuuguauuuuuaguagaggcgggguuucaccauguugcccaggcuggucucaaacuccugaccucaagugauccacccgcuucugucucccaaagugcuggaauuacaggugugagccaccacgcccagccaguuuucccauuuaaaguagacaaaucaaugacuuuugguauauucacagauuuaugcaaccaucaucauagucgauuuuagagcaucuucaugaugcucaaaagaaaccccacguuucuuagccaucacaucccaacccccucacucccuccccuaccccaauccuagcccuacacaacugcucagcuuucugucucuauagauuucccuauucugggcguuucaugucgguggaaucaugugauauguggucuuuuguggcuccuuccuucccuuagcauguucuccaggcucauccguguuguagcaagggucagugauucguucuguuuuacggcacagccaaaugauauuccacuguguggauaaucugcauuucauucacccacucaucuguugaugaacauuuguguugcuuuugcucuucugguucuuuugaagaaugcugcugugaacacugcucuaugaguugguguguggacauguuuucauuucucuuggauauacgcucaggagggagauuucugggccacauaguagggaccacuucucacugucccugaaaccucggcuuuaccuugcacagcucugguuccacaccuggugacggagaggcagagacuggcugccacaccugcuggagcgcucaccguguggucccucagcagcacgccucaucugccaccaucgucuuaugaucagggaaacugaagccuagagagauaaagugacuucacuccaucuggggcuggcgcaugcucugagcucagucauggcagggcuggauucuggccuugugggggccugaagugcuauccccgaggguugaagguuccgggaacugcuccuaagaagggccuguuacaagcgagcucgguucccugguggcuugcauggcucauccccaccccucucuccccacagggugccucugccaacugguggaaucaucgccacuuccagcaccacgccaagccuaacaucuuccacaaggaucccgaugugaacaugcugcacguguuuguucugggcgaauggcagcccaucgagguacgacuaagaggaugguguugaccuaggaaguguuuguccugggcgaauggcagaccaucgagguacaacuaaggagaugguguugaccuaggaaguguuuggccugggcgaauggcagccaucgagguacgacuaagggguugguguugaccuaggaaguguuuggccugagcagggagcagggaaggaagccuagagagcugacauucagccaggcagguccacaucuccugcuacacagauaccucuccuagguacccugaauuguucuggcuggaauguauguggaauggccucaccuguaaauacagacacagcuccucauuagaaugguagaugucucccuccuacccuuaggccaggaagggcauuuucuggcuuguuuuuucccaggguagagggaaaucuuguuccaguucagcaggaaggcaagauuucaggggcucaagcuuggucgccaaccgacuagcucauguugagaaaaccuuauuuggagaaucaucauccuguacacugggaggagccucaacguggcuugguccaaucugcuucaccaguggauaagaaauugaaggucagcgagaggauggaacacguucagggucacauaauuuauuuaguuuuuuuucugagacggagucuugcucuguugcccagagcuggagugcaguggcacaaucuuggcucacugcaaccuccgccuccuggguucaagcaauucuccugccuccgccucccacguagcugggauuacaggcaugugccaccaugccaacuaauuuuuguauuuuuaguagagacaggguuucaccauggccaggcuggucucaaacuccugaccucaugaucugccugccucggcuucccaaagugcugguauuacaggcaugagccaacgugcccagccgagagagucacguaauuuaguggccagucuagggugaggccccagaccuuuggacugcuaggccauugccuuccauuuacuauaccauuuuauuuucauauuaguucauuuuauuacuacaaauauagaacacacuugguauaaacuucuaaacaguacagaaauauccagaauuaaaacacgagucucagccugggcaauauagcaagacccugucucuaaaaaaauacauauuuuuuuaguuagccaggcaugguagcacgugccuagucucaguuauuggggaggcugagguggguggaucccuugagcugagcccaggagguugaggcuacagugagcuaugaucacaccacugcacuccagccuggguaacagagcaaagcuaugucucaaaaaagaaaaaaaaagugagucucucaaaccuccccuuugccccaaauuuuaugcccuugaggguaaccacuguuaacaagaugcuauacagucuucuagauauuuuuauauguguauaaacaugcauauaucuguuucuuuacaaacaaaaauuuuaggccagcugugguggcucacaccuguaaucccagcgcuuugggaggcugaagugggagaagugcuugagcccaggaguucaagaccagccugggcuacauagugagaccccaucucugcgaaaaauacaaaagauuagccagguguaguggugugcgucuguggucccaggugcaggggaggcugaggugggggaaucacuugagccugggagccucaaggcugcaaugagcuaugauugcaccacugcacuccagcggggacagaagagggagacucugucucaaaaauaaaaaaauaaaaaacaaaaaaauucuaccuuguauccugcaacuugccaccucugcgaauguggaugcccuucccccccaguucauguagacaggucucgucucccucuagccauaugguauucuguuguacuucugaaccauaacaggaccuacauuauuuuauaugguagacaaauugagugucaguaguucauaauuucuuucuuuucuuuucuuuucuuuuuuuuuugagacagagucuuacucucuugcccagucuagagugcaguggcacgaucuuggcucacugcaaccuccaccucccagguucaagugauucuccugccucagccucccgaguagaugggauuacaggugcacaccaccacgccuggcuaauuuucucauuuuuaguagagacgggguuucaccauguuggccaggcuggucuugaacuccugacuucgugauccgcccaccucgcccucccaaagugcugggauuacggguguaagccaccgcgccuggcccauaauuucuuuugaauaaaagccccaccaaugcguuccacaaaaaaauguucuuauuuaauacauucuuuuuuuuuauguagagccucuaugucgggaccuaauuuagaagaaaaaaauaaauauaugcgcugcuuuuuggaaauacauuaaugauuaaaaugaaaguuuagaagauccuuguugcuuuuaugcagaucuuaggagccacaaagccaugcauagaguaggguucaaucagcaucugccaagugaggccaauuuucccucacuaaggaguggcaccgugagugaaguaguauucccgacagccuuggcgccuaaggcuuggaacaaggcgaggagacagccuggcuccccaguucugguuuguacacccucuucuuauuucauuuccacccgugagacuaucugagcaggaacguggauuuuucuguaacauggccaauucgcaggaaaucagccacaguucuguacuuuggaagccucucuaagcugccagggauuccauuuucugccaaaguacaggcuauuguuauucuucuaggaaacaguuugccagcuuuaauuagaggugucuagaaaacagaacugaugaacuugaggcccucugauaaguggggacaaaggcuucauuuucucggcgaggcuuuguaauguagagccguuggcuguccugacagauguucucugugucuccaacaaagaaagucuagucccaccagcugcacuggcaagaaggcgucuuucuugugcgugguggccagagaagccucuccuuucccgacaucuucucacccccgacacuucuggaacgcuggcuuuggggcaggagauaggggugggaggcugugaggaucugguuguucaguuaccagcggcguuuggaaguccccagccagugccgcgguguucuguggaaauccccgcucucacacucauggggaaaggauuggugcuuccuggguuccugguguuuugaccugugcucuggcucucgcaggacccggccgcccuggaaggaacccuggucucuugacugaagugacagugggucugaugggacuugucacaugccagucccacacaccacagcagggccagguggggcggccaggucccagggccucaagccaccaucccagucuccagagcaaggaugccggccagggcuucuaucucuggggacagauaagcaaagcagcccugccaagcggcucccagcacguggaacugugaauagcgcgggcuccgcaguaaagcccuuuuccucguuuucugcauuuuggucuuauugaugcuguccaggaggauucuuuuugucauauguagcaaaguauauucacuuuacccagagauucauuucuugugugcuuagaaaguucuucauacauauuauuuucaguucuuuaagguuuuguguuucaaucuuuaacuucugccaaaugggauauggguaggaugauguucggccuucacuuuucuccagagucggccaguuuucccggcacccccaugagguggcauugcuucuucauaugaggcagugagugcuccugagcccgggcuuggccugggcugggcugucuguccucucccaggccaccgucuggaugacuugggggccacacucacacucauucauccuuggcacuuaacucauuggaagcucguaguggggugccuuuccccuucucuuucucucucuuuuuguuuuuguuuuuguuuuugagacaaggucaugcucugucaccuuggcuagagcguaguggcgcaaucucgguucacugcagccucaaccuccugggcucaagccaucguucugccucagccucccgaguagcugggacuacaggcacccgccaccaugcccggcuaauucuuguauuuuuaguagagaugggguuucaccauguuggccaggcuggucucgaacuccugaccucaagugauccgccuaccucagcuucccaaagugcugggauuacaggcaugagccacugugcccggccaaggucuguacuucuuuauaugucucauggauguuucuuuuaaaacgcaauccuuauauguuuuauauuuugucauuaugauuggagguucuccaguacucgggaaagcaguggauauugggguaguuaucuuaauuuucuuuuuuuucuaaauuuuuguuugcauggccuuccaaugaaugggauaguuaucuuuugucccgcuaguguccacuuacgucucuucguaauucuaguuguguuucgguugauucuuuugaguuuccuggguagaugaucauauccuagaaaauaaugaaaacguagucucucggcccagcgugguggcucacaucuguaaucccagcacuuugggaggccgaggcuggcggaucacgaggucaggagaucgagaccaucuuggcuaacacaaugaaaccaccgucucuacuaaaaauacaaaaaauuagcugggcaugguggcacacgccuguagucucggcuacucuggaggcugaggcaagagaaucgcuugaaccugggaggcggagguugcagugagcugagauagcaccacugcacuccagccugggcgacagagugagacuccgucucaaaacaacaacaacaacaacaacaacaaaacaaaacaaaacaaacagaaaaaaaguguagucacucuuucuuucuucucuuucuuucuuucucucucucuuucuuucucucccucccucccuucccucccucccucccuuccuuccuuccuuccuuccuuccuuccuuccuuccuuccuuuccuucuuucuuucuaaucuggauguugaaguagucucuuucuuucuaauagcuccacucuguuuucugcuuuggguuuuauugcauugacgggaaauuucagagcugaguuuaauagcggugauauuggcagcagccuuguuuuguucuucuuuugccauauccccguuuucugagggggcuggugagaccauuaucccgguagcaguguaaaggggccucagaagccgugcggugccugagauccuccuccuccucccauccgggaaaccaccucugcugcucugacugucugaagcuaaccuccugggcuuccugcuugaggcagaccuucaugaacaggcuuaagccacccaucccgccuugggacacacaugccgcccucucggggaccuuggacugggaccuugccauucugcuccugcuggggaggucgugccgccuguuucucucugugugugaguuugcagguucccagaggcagagacugggcuuugcgacagcuccccucccccaacccucgauggacaaggagggcccuugucauuccucagacauuuuguuccaaagcugaaagguccccuccacauggcccggcaucccccaggcccucauccaagccuggccuugaggugcauggagaggccgaggacaggagagucagccccgccgccagggcuggcugcacucccucccuugccccuggccugcgucucugccugucaaccgcagccugggaaggcacuguugcugaucagggggagguccaugugugccacccacacccuuggccgcagcccagccaggugaaagucaugugucuuccuugccucuugggcuuucucugugugugugacggggacuccucuggaggaggagaugugugggguccuccacuccccacacuuggggcucugagcccccaguugggaagaagccugacucuuguugagugagucuguggaccgggcacugugaugggcagugugcgugcacaacgucacuuaauccuugcuuaacccgugaggcgggagcugucaucgacccauuucauggauggaacagcuaaggccaagagacaugaagugacuuguucaagguaacagcaaggaaaaggcaacaccacuguccgaacccaaaccaucuggcugcaaaccacagcuucggaguccugggggcccuugugaaauauguuuguuggguagccccagcuuucugaucaauuaaacagccaggcacucaccccccuagcuugcuacauucuaaaauaccucucccucccuucccuggucccaugacuuaaacggcaaagcucuggcaaagaacugagcgugggaaagaugagagcagagaguuagccacagggcagggcuucguaucccaaacccacaguuguacuuucugguuugggaggggaguauuggccaucccccagcagagccgcugcagcugaggccaucgagaugggcacagauguguagugguaugucaccauacgcauguacauacacgugcgugacugugaugagcauuuugcucaccgucccacagaggcccacucugaggccugcugcugccuggcaagcaggacccccuggcucccgagggucauucuggggcauugaagggacgcacacuaaagccagcagugcuuaccagcagaggcagccccuguaaccuguguuguccacccacaggccaccaucacccaugagaacagggugccuacugugcacaugcagcuccaaacagacuccccaggugccucccaggcccccacaacagcguggccagcccucagucccuccauaggaugcccuggccccugcugaccugccuggguugcccucugugcucacuuccgaguacagccggcccagcccgagagggaugggaugcucugugggacagagaugcgguggggaggagcucuugagcagagcuggagacacugcaugccaaggcuggggcuaugagccugcucccuggccucugggagaagcuuagagcaggacucaggggccuguucugugggccacugcaggccccgagacuggccaccucgagagcaacgucugcagugcuggcuccuccagcaacuccguccacuggagacucaugaaaggcuccugugaggccucccuggcucggaccucuccauggccggccucagcccuggccuuaauaauagucuuccugcaaguggccguccuuucugggaaugagugagauccuugccaaggcucaggaggccacacagaacaaagggacuguuucuggggguucuucagcugguugugccgugaccauggccauuggcgccaagaugcaagccuuggggacaggguggaccugguucccacccacagccucuucccucaggaauccaugcucucccugugauuuggacaaucauuuuacucaccuggaugagaggggcacuggccuaggcaucauccaaggucccuucccucuguaacucacuuugaccuccugacugcaauaaguaugacuggacacuauaggaggaggcaucucuggccuucggauccagggguauagggagggugacgggcaguguccuggggucagcacuuggcauuaugcccauguucucauuggcuccucuuaccaaccacugauucaaaugccagacaaggcucagcaaggcuaagcgacucacauagucucagcacuggugagaggcagagucggcucaagcgcaucugcuggcugcaagcccagccuccccacacugcaagggagaggagcaggugucacucagugagcggcaucuuuuggucucaguccuggaagugcagggugggcuggucccuaggggcuggaccauggaauuaagggcuccagggauccccuggggccgugguuccuaugccuggcauuggacaaugacgaugcccaggacccagcccagcccuccuccauuagagccucugggcaucaggcugcccaaggugcaggcucugauggggaagaaaccggugccgucauggggaccucagguagccagauguggccugaggagucugugcuguggccuccucuguccucaagguuaggcuccagcuggggaggagugauucacucuuguaaauuacagggaggcuccagggaggcagaugcucccagccugaugacuggcagcaauucuggggcccuuaccuagguucucccugccacugcgggcuccgggagcucuccauggugaccuaggaacuccccugggugcuuaugcuccgccgagaguugcucuguugcacauucauucaacaaacauuuguuuagugccugucacaugggcucagagucagcuuuuuggguucugaucccagucagggccacuuccuguggccuugggccauggcuuaacgcugagccucagccucagaagugccggccuuguagaggaucgaugccaucgggccagugcucggcuagggcugaggaagcguuggccgcugcuggcuguagcauggggagcccagagggcuggaggggccccaggcuuggugggcccagggugcagauugacaggaaagggacaguggugugcccugagcagauagaagggaugguggcugcaggauggguuggggaacaugggaggcugggagcugaggcuacugggugcucaugaucucuccucucuccucaguacggcaagaagaagcugaaauaccugcccuacaaucaccagcacgaauacuucuuccugagugagugcucggcgccccgaaaucacucugggacccuccccuccccccagaguggcgugucucucccuccuaccugacaucuuuuucagauccagaaagugacacuaaacuuguuagaagcgggggccacagcagccuugcugugcagaccccucagccuguguuacaggccugauggggacacagaggcucagagagucccaggggugacacacguccucaagggcucccagccuucucugcaggccccggggucccuggcugcuucugcccacgucugcagggcuggccccugcacucagugcugggccuggguuccccugaccuuccggcacaggcaggguggaauggaugccucuaagcgccugucucucuccugcaguugggccgccgcugcucauccccauguauuuccaguaccagaucaucaugaccaugaucguccauaagaacuggguggugaguuggggacacagcuggcuuggcauggggaggagggugacugggacagggggacccggggguccuacgcugccuccucgugugccccaguggagccuguggggccccaggcaucuccucccugggguagcugccucucaggaaaggacucccucuggggccaccaggaccuaguccuaaagaucucuacucucccucagacauagggaguccacuggggcagccccugcuuuugcagagcccccgagaaaguucucaaaggcagcaggaugagaggcaaguguggccaucucccuuccccgcucccugugggcccugagucccaugaacuggguugccccacacccugguuugaaguuggagcagcugggcguuggcugagaugacagguguggucguuugcgaagaccguaugacaaagcaccacgaacugaguggcauaagcagcagcgauguguuuucucccgguucuggagaccggaaguccaaaacugagguguuagcaggguggauuccuuagggcucuggaaggcucuguucugggccucucaucggcugguugauggcuuucguccucccucucgguacaucaucucucugcauauuuguaucuguaucuguguccaaauaucccucuuuaaaaaaauuauuuuguuuauuuguuuauuuauugagacagagucacauaggcuggagugcaguggugugaucucgacucaacugcaaccucuaccuccugggugcaagcaauucuugugacucagccucccaaguaccugggauuacaggcaccggccaccaugcccagcuaauuuuuguauuuuuaguagagaugggguuuuuccauguuggcgaggcuggucucgaacuccuggccucaagugaucugcccgccucagccucacaaagugcugagauuacaggcaugagccaccacgccuggccuauuuuuuaauuuucuuuuuuucuucaccaaaaguggauucuugaaaauuuuuccuuuuuuuuaaaauagggacauuggucauauugcauuagggcccauuguaauuacgucaucuuuuuuuuuugagaugguguuucgcucugucgcccaggcuggagugcaguggugcgaucucggcucacugcaaccuccgccuccuggguucaagcgauucuccugccucaaccuccugaguagcugggaguacaggcgccggccaccaugccuggcuaauuuuuguauuuuuaguagugaugggguuucaccauguuggccaggcuggucucgaacucuugacucgugauccacccgccuuggccucccaaagugcugggauuacaggcgugagccacugcacccggcagauaaauuguuuaucugaaaauuaucaaagacuaaauugucacuuucugaaaugcuugcuuaaaauccagucuuucucagcagucuauuugucccucaugcuccaaccaauagccauggggaaguuuuuccucucuuaaccaaauguggacuuguuuauugauuacuguuuuuuguuuguuuguuuguuuuugagguggaguuucgcucuuguugcccaggcuggaguacaauggcgugaucucggcucaccgaaaccucugccuccuggguucgaguaauucuccugccucagccuccgaaguagcugggauuacaggcaugcgccaccaugcccagcuaauuuuguauuuuuagcagagacaggguuucaccauguuggucaggcuggucucaaacucccaaccugaggugaucugcccaccucagccucccaaagugcugggauuacaggcgugagccaccgcgcccggccuguugauuacuguuuuaucgcuugcuaacugaaguuguccuuuucacccugacugugaauuuaagagcagccaagucaaauuuuaucuccaagucuuggacccauauauccaaucuaacuccauuuggaggugucccagccauugcaaauccaacauauucaauguaaguccucuccucuucucccacaaccuaauccugauggucuccauguuaaugaauggcuccaucauccacccaguggcucaaguuagagacuagcaccauuauguuuuuucccuccuuauacauguuacacccucuccuugccucuagcauccaaucccguucuaacucauaaguggccuauugccgggcgcagucacucaugcuuguuaucccagcacuuugagaggccgaggcgggcagaucaugaggucaggaguucgagaccagccuggccagcauggugaaaccccgucucuacuaaaaauacaaaaaauuagccuggcaugguggugugcaccuguagucccagcuacucaggaggcugaggcaggagaauugcuugaacccgggaggcggagcuugcagugagcaacuucuuuuuuuuguuuguuuuugacugugcuuguucccuaaggaacaaaguauuaaacaggaaaagaaaucacccuauguuccuaaaaggggauggcagaguggggacaaugugaugagcccauggggcuuucagagccaggagcgcaccuaugaccuggggcacugguucucaggggagcuguucugcccuuuggcaguauccggagacacuuuuaauugucacaacuucaggagaggagggugcuacuggcaucuggugggcgucuagccaggauggugcuuagcacccugccaugcccuggagaaccgcccaugacaacaagcagccugucccaggugccaauaguguggagguugggggacccuggcuuagaggaaagaggugacaaacccuaagaucuuugaaggaggcuucccggggagauuuacaugcucuggcaagguucccuguucccggggccacguccuggauccugagaugcucccacgcuucacccuccuggaauuuugcuguaucugacaccacuggccacucccucuugcaguucuuccuguuggcuuccagguccccaccucugcuggcuucuucccaacccccucgcuccgccucuuuggcugcuucugaucucuugggcucucugccccugaaaccagcgaucucuguguauguguugcucucuacacucaaaagaaguccaggccaggcaugguggcucacgccugugaucucagcacuuugggaggcugaggugggagggaucaccugaagccaggaguuuugagaccagccugagcaacaugggcgaaacccugucucuacaaaaagcugggcguggugaugcgcgccuguaaucuaccuacuuuggaggcugagguaggaggauggcuugagcccaggaguuugaggcugcagugagcugugaucacaccacugcacucaagccugggcaacagagugagacccugucucuuaaaaauaaaaguugggccagggcaaugguucacaccuguaauccuaguacuuugggaggccaaggcuggaggaucacuugagcacaggcauucgagaccagccugggcaaguaagugagacccccccaucucuauaaaaacuuaaaaaaaauuauccagguaaggccagacacaguggcucaugccuguaauaccagcacuuugggagccugaggcaggcggaucacaaggucaggagaucgagaccauccuggcgaacacggugaaaccccaucuccacuaaaaauacaaaaaauuauccgggcgugguggcgggcaccuguagacccagcuacuugggaggcugaggcaggagaaugguaugaacccaggagguggagcuugcagugagccaagaucacaccacugcacucuagccugggcgacagagcgagacucccucucaaaaaaaaaaaaaaaaaacagaaauuagcuacucgggaggcugagguagaaguauggcuugagccugggacagagucaugaucacaccauugcacuccagccugggcaauaaagcaagaucccaucuccaaaaaaaaauaauccguaaccccauccucauuuuguuuccauauauguguagauacacugcacacuauugcaccacacacacagaauagaaggaaugugauggaaagugggagcagaacuggcuacaucugccucccuccucaccuugaaggccaccuuauuggaacgugagguccugcccucggccaauguuggccccaaggccaucuccagccucuccugagcgcucccuuccuccuuuccuguucagcugcuggcacccgaccccugaucaccuaggaccagccuagauuccccacagccaagcaggcacaaaugcagccaccguugccucugacaguucuggaaucugucaccuccuugucagugccguggguucugguuuaggccucugucauuucaugucugagccgcuggaauaacuuccuagucucccccucuccaguggguggggaucuauuuuaagacacaaaugugaccuuguucuucagucguuugaagugagacagggcagucccuuggccucaccuuccaccucggacaccugugcugagccuguggcaugucaccauaccuaaacucauggcaggaugagcgcccuggcagugggaacaggccaugcagaggccccggggagggaguaagcuaggucagggggcugaguaaagacagguucuuaaccccaugaggcuccgugggugacugggugggaugggggcuuuagcaggggagaguugggaccugcuuggagcgaaggccacucugguugccauggccacgaggacaagcaggagacugugggaagcugaugcugugguccaguugagacaagacuuggguggcagagagacaguggacaggguggagccgugaagucacccucccaguacaugagagaagacguccaagcccagucccugacaccaguccagccagaggcagggaggagagcagaguggagggacacaggaugacaguggggcguggggaggccagccucugcugugagagcucugagauagggacgaugguaccucugaccuucccuaccccuccaagcccucuguccugcuggaaggagaugccaggaggagacccaggugcugaggaggagggacaggacugggggacgguuggggaccuggccccggguugggggcgcaccuucagaaucgcccuugccccacgagagggcugcugacccccaccccuaccccauggcugccccucagcaggaggguccguuucucucccgaaaaacagggcacagucacuuccugaugcuaaaacacucagcauuucccuagaaacaaaggcagccaugcaaaccccgagcaagcagguggcguguaguugcccauugcauuucagugggcugcgguccagcuucuagaggccugagugugaggugugugcacaucuggggcacgcacuuggugccagggcagaggagagggcagguugcaccuaacuucaucuuuccccgcaggaccuggccugggccgucagcuacuacauccgguucuucaucaccuacaucccuuucuacggcauccugggagcccuccuuuuccucaacuucaucaggugccugggcuuugcugauucaucccugggcccuccacuggcacugaugauggcuuuggcaugagaagaggcucggacggcuccacuuugccuggggaccucccauccuggccccuuggcaggggcuguccugggcugguugggagaguggaucuguucccacuguggcugggcccccggaggccccugcgcugagcuguguucucuugcagguuccuggagagccacugguuugugugggucacacagaugaaucacaucgucauggagauugaccaggaggccuaccgugacugguucaguagccagguagggaagucagggccggucaccagagccuggucccaauguccauguccuggccccagaugaucugcaccugcuaacacagggcugugcugggccucccggggcugccuguguccuuuugcugggagcuucagggcugagcaagaaagggcagcaggaaucccccagagggacagguggggcaucugggugggcugaggccaucaggcaggacgguaugauguggacggguggccuggagacccuggguaaggcugggcccccugggaaugaggccgggcccuugggccuuccuuuguucccugacacucauccccuccacugacagcugacagccaccugcaacguggagcaguccuucuucaacgacugguucaguggacaccuuaacuuccagauugagcaccagugagcgcggggcugcggggaggcggggagacccacagcgggagggaaguggccgcuaucccacugggcagaaugcagaaugugggggccaccucuuugucucucugacaaggucucugcccaauauagagcaaggcucccagccagccccgcugaggucaggagaggggcuccccuauuccaucucccugagggucauccugugccccucaugcugugccacuuggucauagugguuaccaccucccuccaugugggccugggacuuuguaguuauggagccugcacacgcaccucaugacccugugaggcuagcagggcagggcuacguagcuugccuggaacaucggccgagggacugcccugcugccccuuguccuugcuucaccucuugucacuguuuuuuuuuuuuuuuauuaaaaaauaaaaaauguagagacagagucucacccuguuuccugggcuggagugcaguggugcuuucuuggcucacugcagccucgaacgccugagcuaaagucauccucccaccucagccuccugaguagcugggacugcaggugcgugccaccaugcccaacuaauuuuuucuuuuuuuuuuuacuuuuauuuauuuauuuauuuugagacagaaucucacucuguugcccagacuggagggcaguggcgcaaucucggcucacugcauccuccaccuaccagguucaagcaauucucaggccucagccucccacguagcugggauuacaggcgugugccaccacgcccagcuaauuuuuguauuuuuuaguggagacgggguuucaccauguuggccaggcuggucucaaacuccuagccucaagugauccaccugcguuggccucccaaagugcugggauuacaggugugagccacugcaccuggccuaauuuuuuauuuuuauuuuuuguagagaagaggucuugccgugucgcccaggcugaucucaaacuucuggccucaagugaucugccugccucggccucccaaaaugcugggauuacaggcgugagccaccgugccucaccucacugccucuuuuccuagcauuccccagcuauuucauuucuuuuuugaaaaacaugacacuuugucucuggccacccaauaucuucccagcuccauagagcacaaacgcccuccugcucacggagggcugcacccuccccuccacacacguggcaccccacugggcacacacgaggagccacacuuugagacugguccuggcuguggacagggucucugagggccccagccagccucugcccagguggugggaggaagcgggagcagcauggcccucugaguccucacgcucugcccacccuacacacuccucagccucuuccccaccaugccccggcacaacuuacacaagaucgccccgcuggugaagucucuaugugccaagcauggcauugaauaccaggagaagccgcuacugagggcccugcuggacaucaucaggugagggguggagguccacaggcgcugggcccugggaucacccguggugcagacagugggaucacaagaggggcugggcccuccuggcacagucacccaccagggcaccugccuuacucccgagccuguguuaggagcuguugggcuuuucucccugggcugcgagaagaccaucccuuucugugugggguuccuggugggcucugagcugacagccccacaggcccaguggcagugguaagcccugguuagggccaaggggacauacaugccaccuuaaugauggccuccucagcccuugcacucccuggggccacucccguccuggucccugacccugguccauccccaacuuugcaggucccugaagaagucugggaagcuguggcuggacgccuaccuucacaaaugaagccacagcccccgggacaccguggggaaggggugcagguggggugauggccagaggaaugaugggcuuuuguucugagggguguccgagaggcugguguaugcacugcucacggaccccauguuggaucuuucucccuuucuccucuccuuuuucucuucacaucucccccauagcacccugcccucaugggaccugcccucccucagccgucagccaucagccauggcccucccagugccuccuagccccuucuuccaaggagcagagagguggccaccggggguggcucuguccuaccuccacucucugccccuaaagaugggaggagaccagcgguccaugggucuggccugugagucuccccuugcagccuggucacuaggcaucacccccgcuuugguucuucagaugcucuugggguucauaggggcagguccuagucgggcagggccccugacccucccggccuggcuucacucucccugacggcugccauugguccacccuuucauagagaggccugcuuuguuacaaagcucgggucucccuccugcagcucgguuaaguacccgaggccucucuuaagauguccagggccccaggcccgcgggcacagccagcccaaaccuugggcccuggaagaguccuccaccccaucacuagagugcucugacccugggcuuucacgggccccauuccaccgccuccccaacuugagccugugaccuugggaccaaagggggagucccucgucucuugugacucagcagaggcaguggccacguucagggaggggccggcuggccuggaggcucagcccacccuccagcuuuuccucaggguguccugagguccaagauucuggagcaaucugacccuucuccaaaggcucuguuaucagcugggcagugccagccaaucccuggccauuuggccccaggggacgugggcccugcaggcugcaggagggcacuggagcugggaggucucgucccagcccuccccaucucggggcugcuguguggacggcgcugccucaggcacucuccugucugaaccugcccuuacuguguuuaaccuguugcuccaggaugcauucugauaggagggggcggcagggcugggccuugugacaaucugccuuucaccacauggccuugccucgguggcccugacugucagggagggccagggaggcagagcgggagggagucucaggaggaggcugcccugaggggcuggggaggggguaccucaugaggaccaggguggagcugagaagaggaggaggugggggcuggaggugcugguagcugaggggacgggcaagugagaggggagggagggaaguccugggaggauccugagcugcuguugcagucuaacccacuaaucaguucuuagauucaggggaagggcaggcaccaacaacucagaaugggggcuuucggggagggcgccuaguccccccagcucuaagcagccaggagggaccugcaucuaagcaucuggguugccauggcaauggcaugccccccagcuacuguaugcccccgacccccgcagaggcagaaugaacccauagggagcugaucguaauguuuaucauguuacuuccccaccccuacauuuuuugaaauaaaauaaggaauuuuauucucac

SEQ ID NO: 18751 - RNA, 17281 nt, Homo sapiens
cggucugcccugcggugcugaaaacccggcgcgcaggcggcuggcucugggcgcgcgccagcaaauccacuccuggagcccgcggaccccgagcacgcgccugacagccccugcuggcccggcgcgcggcgucgccaggccagcuauggcccccgacccgguggccgccgagaccgcggcucagggaccuaccccgcgcuacuucaccugggacgagguggcccagcgcucagggugcgaggagcgguggcuagugaucgaccguaagguguacaacaucagcgaguucacccgccggcauccagggggcucccgggucaucagccacuacgccgggcaggaugccacggugagcgcagccaggcgggggcacaggagagggcgggaccggaggcugagugcaggggagacagaguuacgcacuccgagccaaacaccgacuaauucggaggaaagcccggaggcgccugaucauaccuguugcccggugauuggguguccugcggaugcgggaugaaaaggcgggagagaggccuggagaaguggagucuggggaguggggauggaggccaacaacacgcacacacaaacaaagggucccgccucccugccgugcauuccaucugcagccccgagccucaggucucugggcggggacagaaccccgagcuggguaggcuaggagggaggagagcaaggaugcaggccgccuggggagggagggggucaguggccaggggagggagucacauccugucucgauggcuaggagaggcagcgcagccgcgucuggaccuaggugccggucuccacucgccagcaggagcggagagggagcaggaaaggagcccauucucgaggauggggcugaaacgggaagcuuggggagaccgcugccuuggggaccccugcgucgugugaagacuggaggacgcggaagggacagcgcuggccggggagggcaagcggccgcuggcguacauaagggauugggaauggcauacacuuagcgaggacccccagagcuguucucgaaucgccggggaggccacugagccgcaggccagcgaggucuucagcuauuccgcggagcggaccgcuguuuacgcucuggggcgguaggcccuucgcgggguccugucccuucuucccuuggucucacugcggggucggcgcgcgccccagccccaggccugcugcuucccuuucuagaccacagcccucagagcuaaggccccggcgccucucugcuggguuggaguccuggggacucaguccuagggacucgaaagucggggcguucccuucaccgcguuucccccuuggcggccagaauggcguccccuccccuugcaucccccucugaucccgugcccugcagcgugaugcccuccacugucccuauccacuacccuggcgucccagagugugccgcgggucaccagguucccauaacgucgcagcagagcuuagacgcugcggggcgaagacccgccccacccucugacgcgaccagccuagugggcgaggccagagcuugcgcgggucaaccagagugaccacucgggagcccugacugcggccaagggcgcaggcgugucccggcgcaugcgcagacgaaacaggcaccaacgcuggagcuucccgcagugugauuuggggccgggaaugccgcggcggggacggcgauugguccguauguguggugccaccggccgccggcuccgccccggcccccgccccacacgccgcaucacuuacagggcccggggcugccggaccugccaacgugaaucuuaucgccauggaccuuaccuugcacaacccaaaguagcugccuuggggcaggggguggccagagugcuuagggaaauguggagcccuacccagaacaacgguggagggaaagggaagaaacgcagaagugccccaguucggacguagggaagucuuccucuucgugguuuuuggagaacccuagcuaagagaggaaagggacuuauugaaagacccgcaagaagggacggaagucucauagcccugagaggugaagccagcuggaguugaugggucgaauggggaccuagagaacuuuucuguaucuagagguuuguaaaaugcaccaaucagugcucuguaaaaacgcaccaauuggcgcucuguagcuagcuagagguuuguaaaaugagccaaucagcaggacgugggcagggacaacuaagacaauaaaagcuggccaccccagccagcugcugcaacccgcuccaguucccuuacaggcuguggaagcauuguucuuuugcucgucacacuaaaccuugcugcugcucauucuuugggucugcaaagaguguuauuccuuuaagagcuauaacagcgggaagguccacggcuccauucuugaagucagugagaccauacccgccggaaggaaccaacgcccgacacagccccacccaucucuccuguuucucaccuauacugaaauucuugggcaaaagcugucuguggacacacccaggggaaaggccagcccaggcagguguuucuuagugguuccccucagccaaugcuucccauuccuugaugcauccuucuaacuagagcagauacucggugaucuuaaacuguggacaccugggagcacccucaaaaggcagcugggccuagggagauggccugugcuucugugucaggaguugguuccuucaggugggcucguggucucgcugacgucaagaaugaagccaugaaccuucgcggugaguguuacagcucuuacagguggcguggacccaaagagugagcagcagcaagauuuauugugaagagcaaagaacaaagcuuccacagcguggaaggguacccgagcagguugccgcugcuggacguuggggggugugagggggagcagccuuuuuuuuuuuuuuuuuuuuugagacggagucucccugucgcccaggcuggagugcaguggcgcgaucucggcucacugcaggcuccgcccucccccgggguucacgccauucuccugccucagccucccgaguagcugggacuacaggcgcccgcuaccucgcccggcuaauuuuuuguauuuuuaguagagacgggguuucacuguguuagccaggauggucucgaucuccugaccucgugauccacccgccuuggccucccaaagugcugggauuacaggcgugagccaccgcgcccggccgggagcagcuuuuauucccuuauuugucccugcccauguccugcugauuuguccauuuuauagagcacugauugguccauuuuacagggugcugauugguccauuuuaccucuagcuagcuaaagagcacggauuggugcauuuuacaaaccucuagcuacagaaaaguucuccaagucugcacucgacccaggaaguccaucuggcuucaccucucacuucaacuuggguacagccuucuggcgggcaggaggauggccuuuggugcgaacacugccggaguccagggggcuggcucccucaccuuucaucuucucccggcacuugcaggaucccuuuguggccuuccacaucaacaagggccuugugaagaaguauaugaacucucuccugauuggagaacugucuccagagcagcccagcuuugagcccaccaagaauguaagacccuguguuugcuaugucgcaacuauugguuguugagggggacagagaggggguggaaggagagucuagaugggaucacagucauaguaaucacagucaguaguagcucuggggagucuugaggucccugcuucucuugcauagucaugaggucacaggcccaagggagcauggcuuugcaaccuauggcucccccaaggcugccacuaccauggcugccaucauuguuaucaucauuguuaucauaugagcacuuacuaugcaccaagcauaaacucauaacucuuacacauuuacagaugagauaacaggcucagggagguuaagcaacacagccaaggaucacacaguuaguaaauggcagagcaaggacuuaguccccugaacucuuaggcacuaucccauggcaccuccuccugucauccucauugucgugguaucuuugccuaggacuguggacuucccacagcuaccucagugggagguccuugagccugagagggcccuugucuccaguagcauuggggugcagaugagaagaauaacagcuccucuuccucuucugcagaaagagcugacagaugaguuccgggagcugcgggccacaguggagcggauggggcucaugaaggccaaccaugucuucuuccugcuguaccugcugcacaucuugcugcuggauggugcagccuggcucacccuuugggucuuugggacguccuuuuugcccuuccuccucugugcggugcugcucagugcaguucaggugagagccuuuggcuugucaagugcacagcaaugcucagcaucccuggggaaagcuccuuggguguuugaggaaggccaagagugccugcccuccaagcagggcagaucugaagguaugcaggagugagugcaggaacaugcauucugcugucuugaccugucugcucuuuagccacauggacaucuucauuucucucacugccuuuuuagcugcuucuccaaggguucucuucuuccuaugcgguuuguucucugccacagcccaccugugccaggagccaaguuucugguuucuuagcaaagcuuggcucccuccccaccacugacauugcccaauauguuaauaaugauugagcgcuaauucuugacugucaggacccauuuggcaagccuucugcucauguuucaguccuuucuguauucuagaugucaguccaucauaagucaugagcuucaggccagguguggugacucaugucuguaauccuagcacuuugggaggccaagguggccggaucacuugaucucaguucaagaccagccuggccaacguggugaaaccucuacuaaaaauacaaaaaggccaggcacaguggcucacgccuguaauaccaguaccuugggaggccaagaugggcagaucauuugaggugaggaguucaagaccaccuggccaacauggugaaaccccgucucuauuaaaauacaacaguuagcugggagugguggugggugccuguaaucccagcuacaugggaggcugaggcaggagaauugcuugaaccugggaagcgaagguugcagugagccgaguuggcaccauugcacuccagccugggcaacagagcgacacucucaaaacaggccagguaugguggcucacgccuguuaucccagcaguuugggaggccaaggugggcagaucaccugaggucaggaguucgagaccagccuggcuaacauggugaaaccucgacucuuacuaaaaauacaaaaaaaucagccaggcuugguggcgggcaccuguaaucccagcuacuugggaggcugaggcaggagaauuacuugaacccaggaggcggagguugcagugaucugaaaccgcaccauugcacuccagccugggcaacaagaacaaaacugucucaaaaaaaaaaagucaugagcuucggagcuggcgaaacagaagaacagagaagggauggugauuugccccaacucacgugugagucaguggcagaggcagaacuaggacccauguuuccugacuccugaggugcaucacaggccuuggcagaugaaggaagugggagaggcugaaggaggcaucgaggucagugaaggcgacacuggggcuggugggcugcucucaguguugacucuucucaccuaggcccaggcuggcuggcugcagcaugacuuugggcaccugucggucuucagcaccucaaaguggaaccaucugcuacaucauuuugugauuggccaccugaaggucagugggauggggaggagcucucuaaaacuccaggcaaugaagggcugccuugggggaagcuuuucauacucgugucccugcuuuucuguagggggcccccgccaguugguggaaccacaugcacuuccagcaccaugccaagcccaacugcuuccgcaaagacccagacaucaacaugcaucccuucuucuuugccuuggggaagauccucucuguggaggugcguggagguaucaguggaaaggucuuggggaauaggaggcagccaacauaggggaguuggggaagaugcccacgauguugucagugugggcaagacacuggggcugggcuggcuggggcuuuugccauuuuggaaguucuggaaggcaacaggcaauagaugggggcugcccaggagggagucaccauccucccuagagaguucagucagcaaaccguuacugcauaaaaggcaccucauuuugcaaaggauccagcggaugaccagaaggauccaaaugaugagauagccuauccuugaaggugcugauggcaccuccuggaggugcuuuuuugacacucuugccccaggcaaguauuccccuugcacuuuguauuucucucccacacuuagguauccuucuugucacagucuucucuguccagggcuggacugucuuacucuucuuucauguccaauaucuggaacauucauucacugaguacuucuucccacccugcugauccccagccugauuuccuggguggucagcguuggguuugagaugucgucugaaguuguaagcagaaauaauguagcugcugaaggaauaaugccuggggguggagaucuggugagcuuuuagugagcauuaggcaauggaagguucuaaaaggccagcagaauucuuugaaaaguucauuuaaagcccuuugucccaaggcuguaggcugcagaguucuuccagguccaccuccuccacuuugugacauuucagcuugcgaggaauuaaauugucguuaaaacacauuucaguucuaggcaugaguucaagguagccuggcguuccucucgccccuggccaugagaacuuugaaagggcuuuggcagcacugguuggccuggcaugaggagcucauagcuugaggcucaugccccaccuguccauaauguucuuauuuucccaucaugagcauggacuuggguuuguuacauguccgauaccauuauggucaguacuaugcagaugacgaagcagcccugucccccgucugacucccauggcugcuucaagggcagugugguuauuugcugggcaguggcauggggcuugugcauuucuacugucacuacagaggguuuaaaaaaaagacaugggcagguuaaguggaagggaacagucucacaccacuaccuuuauugcuucuugguacuuggguuuucaggaaauuccuaucagcagacaucaaaaacagagaaugaagggacgcaguuggcaugugccuguggucccagcuacuugggaggcugaggugggagcaucgcuugagcccaggaggugaaggcugcagugaguaugaucacgccacugcacuccagccuggguaacagcgcaacccuguguguaaaaauaauaauuuuuuaaaaagauuaaaaccaaaaaaaaauuguaaacagaguucaacguaacuuacagauuaaaaacaguaaaauaugacagaaacugagagguagucaugaucagauauggccuccuucgggugccgacaucugaacugagaccugaaugaugaaaagggccaacacugcaaaaauucagggaaggaacauuuggaacagagagaacagucaaguacagaggcucccggauguucagggacaguaagcaaugagagaaugagaagaccagaaaacuagggaggggccagaucauguagggccuuagaaagccaugguaagggugugguaagaaguuuggguuuuauuccaauagcaauggggagucacaggaggguuucugguggguacagcaaucugcuuugcacuuuaaaaggcuugcucuggcuggagguggagaggaugaauuauagaggguagguauaaucacagauauaaccucagugaggcggcuggagcgaguccagaccagaccacggaggagcaggugaagccaauggauuugggauauguuuuggaggcaguguaagcaacgcuugcugaggaccuggaugugguggugagaaucaccccaucucgagcaacauuaacugaggaaaaaauugaaaaaggggcgcccuugcuugggggcuuccuauuguggaacuguuauggaaaggagccccauccauugcuuccuccuugaauggcaaaugccuuuaugaucccuauaacuugucccauuauguuuagacccuugguggucagaaggguucuauuuagggcaguguccccugccccuccuuguccuccaaaaauuuugggaggcacugacguggaugucauggggucagcacaggcaucaacauccccagagggauggaaccaagcagccuauugcccaggcauucacuaacaggcagcccauccucagccucauagcuggccggggagaagaaaggcuauuuugggucccagaucuuuuuuuuuuuuuuugagacagagucucgcucugucacccaggcugaagugcaauggugcggucucagcucacuacaaccuccgccucccgaguucaagagauucuccugccucagccuccugaguagcugggacuacaggugcguaccaccaagccuggcuaauuuuugugcuuuuaguagggacgugguuucaccauguugcccagguuggucucaaacuccugggcucaugcaguccgccuaccucagccucccaaagugcugggauuacaggcaugagccacugcacccggucucuguuuacaaauuuaucaccagcuucauccccuaagguuauaagcuccaugagggugggaagucuguauuguucaccucuguauccuaagcaucuagaacauagcccggcacacaguaggugcugaagaacuugaaucuguuaauguagaaaggauguuucaucuagcugaagugucuuguacagaauaaacucucaauaaaugaacuguggacacauggaagggugagcuagagcucugcucagggguugagugcuccucuugugcccuugugguugucugguuaccugaacuaauuggagugcgaugcagacauagucauggagugagacagcagaacuuugcugucuuguuugugagcccacaucagggguucuagacuggcugguugacaugguggccccagccugucucuucagcagcucggcuuauaaaaaauaaccaccaccuacuggggaaaacugcuggaaccuucagauugccaaauuguucuuggugucuuuuccagaaauauuugccaaacucgaauuagccuucaggagauuugauaaagcucauguuuaagucaagagaccaaaagauuuugauggggagaauuaggggcuggauauagagggaauacuuaaccuguauaggggcagauaugguuguccauggagauucuggugugaaaaaguacgauggcggccgggcgcacugccucacaccuguaaucccagcacucugggaggcugagguggguggaucaccugagguugggaguucaagaccagccugaacaacauggagaaaccccaucucuacuaaaaauacaaaauuagcugggcguggaggcacaugccuguaauccuagcuacuugggaggcugaggcaggagaaucgcuugaacccagggaggcagaaguugugguaagccaagaucgugccauugcacuccagccugggcaacaagagcgagacuccgucuaaaaaauaaacaaaaaaguacgaugggagaaaggggagagggcaguggggccuggaaaccucaugacaaagagaaugaacacaagagggccugugguccuguagacucugugcugugcacaucccucaugugagcaugggccauccagcugcaggccauggugugacacacucugcagauuacagucuagggcuucauguuccaugugcuggagguaaggcugggccucuuggagcuuuccaauagcaccaacaagcugucagcccuggaggaggccuaaaccuccaagcaaggaaaggucaagucacagagggaggaaucacuggucuccgaaugcucauguguuugcuuuucuucacagcuugggaaacagaagaaaaaauauaugccguacaaccaccagcacaaauacuucuuccuaagugaguguccccauccaacacaggggagcugccucaggagggaaugcugagggaaugaggaggauguggcuguccaagggauuaugguauuuuaaggaaaggggcuagaggaaguaccccacucccacccccaguuacucccugcaugacagcaguuugccaucucagcugagcgaagugaaguuaggcugaugauugguugaaggcaaacuaguucuucccauccaaccccaguuuccacugggaagcuggguguuugggguguagaggggccucuugcuuuauccucaaccuuaucuuuuuuuuuuuuuuuuugagacggagucuugcucugucgcccaggccggacugcggacugcaguggcgcaaucucggcucacugcaagcucuccgcuucccggguucacgccauucuccugccucagccucccgaguagcugggauuacaggcacccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgcccggccccucaaccuuaucuuaaacuuugucaagaugggccaagguaaccugguagagcccaguccaacccccagaggaacaaagguacagauaguucuggaaggauggguccugaggagagaauggaagagcuguuagaacgaagaagaucuuucugaugacugccacauauucccagcuuuaaaagucugucccagcuacuaaggaaacugaggugggaccauccuuugagcccaggaauuuggggcugcaguaagcuccgauugugccacugcacuccagccugggcaacagagugagaucuuguuucuuaaaacaacaacaacucugcuccauaaugccuaaaaugagcuuuaaacgccuuuaaauuuucaaauuuuuuaaagaaggaagggaaggaguccacugaucuuauuuuaguuugaaggaauucauccuaacugccuaucaccaacuaucacgaauagagaaaggcgauggggcagaaggguagagcagagaccucuggaagaaauaguuuuagaauccauggcacaucaagauggaggagccaugggugagcauugucaugcuaggaguuauggguagcaucaggugccacagagaagggcuacagaaaaggaaaugaggaagcauguagaaugcaacacuucuucaacucccaguuuucuuucaagagaggccccucuguuccgucccacagcugaccuccagggcuucagauugggguggcacaagcccaucucccuaguuuaaggaagugagcuucacagccugugaaggauccacagggucccucccaacacacacacacuuuccugcuccugccccuucaccugcaugguggagcugccaggaacaaagggcagaugacuguagggacagggcuguggccaagguaaguaagagaguauuagcacccuuuuaaaagugugggauccuuggaguguguauguagaaaagagaagaaaaaugaaaaauaauaaaggugugggagcagagcaagucccaugcguggggccugaguucccaagcaccugucacugaagagugccacucgcaccccucaccuucccuggcauccucuugggaguuuuugccuuccccagacuuggauuuaugcccaccuucagugccugcugguuccaguggauugcagagcacucaagcaccuggaggggagacagaagggaugguuggaagaggcagcccccugcuagaggccaucucucccaacaucaacuggcccuuucaugaccuuccugugcucaugccuccucuuugucucgguuuccuccccaguugggcccccagccuugcugccucucuacuuccagugguauauuuucuauuuuguuauccagcgaaagaaguggguggugaguauccauggcccaagaagcccacauccuugucuccagcacccagagugggggauagggguuccccaggggaaacuugagacugacucuaggccuaauuuagaacaaaauaauagaaccagacacagauccuccuuaucucuaagugggacgaaaugauuugagcuuagcaggcagccugauucccaauguguaauuucaugcggucagugucuccagagguucuuguacugggcauaaugccagggggcugaguugggaauggggaagaugaaugagagacaauaccuacuuucaaggaaacuucugaugaagcagaaugugguuauuaaucagaaaagagguacaggcaauagguucuggggacuccaaaaggggccugacugcaccuggcuuugugaagucacuuuucuagcuggccuugaggcugggcaggguuucugacaggcagagguggagcaggggggaugaacucugagcagagaagcuggaaaugagggguaaguuugaccaccagacauauuguggaggacuagugucaggggaagaguauggugcuugguucagugaugagagauuugaucagggcacuggcauggacugagccaugguccuggcagauucauuuggcggcaugcugaaggauuuagauuggcuaggaagagcuagaggcaaagagaccuuguaggccuugguacuuuugaaggggacaugcaagaagggcuggggggugccaaugggaauggaagaaaggagcaguggcacuagauacugcaggauuggaccccugagaagcugaagaugagugagucuggauaaccaggagaauggcugcaccaugcaaacaaagagcugcugagaggaagaggaagaguuguucgugacuguuaugcucgcugcuuuucucacuauaggacuuggccuggaugauuaccuucuacguccgcuucuuccucacuuaugugccacuauuggggcugaaagccuuccugggccuuuucuucauagucagguaguauucggugggggcggauagggacuggugaaggaaauguuggggagugaccagucuggucuaggggccgugcuggggcuuuggguaacaguggguguuucaggaguuggcuugggaaaguagacaggcuggagcaguuaucugaggggggaaucagaauucugggcucuguguguacuguuuuugucuguguaauacaucuaacagguuccuggaaagcaacugguuugugugggugacacagaugaaccauauucccaugcacauugaucaugaccggaacauggacuggguuuccacccagguaagggacagucacucagaagacuggagcauaacacaacuauugaaaaggaugcguaggugaaaacagcaaaaacaaaaagucccccaaacagcauuuucucauuagccugaggcucuuguucugcaaccaugugaagggagugaccaagacagucucaugucccuuccucagccagcuuuaccuggagaaugcugggcuggccuuuccaucugauauucaacaugcucuccccugaccuuuuccgccagcuccaggccacaugcaauguccacaagucugccuucaaugacugguucaguggacaccucaacuuccagauugagcaccagugaguagggagccuggggaagcaggguccuggggaggguguaaguguuggguacaggugggagcagagaagcaggaaccacugacucccccguucucccuaaagucuuuuucccacgaugccucgacacaauuaccacaaaguggcuccccuggugcaguccuugugugccaagcauggcauagaguaccaguccaagccccugcugucagccuucgccgacaucauccagugaguaucugagaccaggaagauggcuaguagggagggaagagggcagggcaauggaaaugaugacauguaggguggggagugaacagaagguguucccagucgugugggauggaguucaccauggcaaaggcaggauucuuuauuggaccuguggccaggucaggccuuugcccucauugggguuccccucaguaccauggcccaagcuagcuuucucuaaaguagaggggaggaaaaccuccagauggaagaaggccuuaaccucacugcuccaucuccgguggguucaacucugcuugucucccucacugucugcccccauuuugucccugcagcucacuaaaggagucagggcagcucuggcuagaugccuaucuucaccaauaacaacagccacccugcccagucuggaagaagaggaggaagacucuggagccaaggcagaggggagcuugagggacaaugccacuauaguuuaauacucagaggggguuggguuuggggacauaaagccucugacucaaacuccucccuuuuaucuucuagccacaguucuaagacccaaagugggggguggacacagaagucccuaggagggaaggagcuguuggggcagggguguaaauuauuuccuuuuucuaguuuggcacaugcagguaguuggugaacagagagaaccaggaggguaacagaagaggagggaccuacugaacccagagucaggaagagauuuaacacuaaaauuccacucaugccgggcgugguggcacgcgccuguaaucccagcuacccaggaggcugaggcaggagaaucgcuugaaccggggagguggagguugcagugagcugagaucacgccauuguacuccagccugggcgacagagcaagacuccauuucaaaaaaaaaaaaaaaauccacucauauaaaaggugagcucagcucacugguccauuucucaguggcuucuccauccucauuugcaaaccucagagggauaaggcaguugaaccugaugagcaagaauuauaacagcaaggaaacauuaaugcuuagaauucugagauccagcacaacucagucugugggagcucagcucgcugcccagggauagguaugaccuaugucugccuuaggcugcugggagaugccauucuccaguuucagaagcaggcagggcaaaggucaagacugugguauuggggucuuuuggcucugaaggauccuggaaccacugauuuugguuuauucccuccagggucuaaagagaacaagaggugcuagcucuuaccaaaacagaugguagagagaguugcuggcuauuuaaaaagcucuuucaucuuuuaauucaccucuucuuuucaccucuuuaaccacuccucaggaacagaacacuucuaggacugggggucuuuuagcuccauaagcaagugagcagaugggacaaguuagucuuuucucccuagaaacaaaggggaugcccagugguuucccuuugcuucccaaccuaaaauuucaaguuuaauaaaauagcaauuagcagaagugaccaaauugggagauaauuaucagucaugaggaaagacacagauuucggucauaaagaauguaagggcuauaaguagaaacuuucuauaaccuaaaugauguuauagaauuauuuuugagcaggagcagaaagauuaaauaugaucacuucauacuucuaaaucagaaauaggaagauuaaaaccacagaacaguuugugauuucuauugcuguagcuagguaucuuacucuguccacucuuguucaaguaucuaacucuucuggaaaccaaauaggcuuuagaagagauuauccuauauuccuaucaguauaauacuaaaauguaacuuuuuaaucaucugguuuuuaaaagauaaacaguuuagcccaucucuccagagagcaaacauaggaauaugacucaggagccuccuagggcuuaucaucagcccucacacccgcuucccccuccaacccacagccuuugcuuccagguggcaggauuacuacuuugccucuucagcagcaucuacucuaggcauauugaucauuuuagacacugggagaagagaaccucaaacuaggaggaaaagacagagccuccacuuaguuuugggaggggauggcagacagucaaggagaugagcguccuaaggcauguugggauagggucagaugcaccacccauggagagguuugucaacacaaagacauggaagguuagagguuugucaacaaaaagacauggaagguuagguuugucaacacaaagacauggaagauuagagguuugucaacacaaagacacaggaagaaugggcugcagaagauuuagauguuuuccauuugggcacauuuuacuuagcuggagaacuagguuuaaaacagccuggguaggaaaauuagaagcaagcuggaugcaguggcucaugccuguaaucccaacacuuuugggagguccaggcaggaggaucacuugggcccaggaggucaagccugcagcgagcugagaucacaccacugcacuccagccuggggugauagaacaagacccugucucaaaaaaaaaaaaaacaacaaaaacuuagaauugaggaguuguaccuccauuggcuuccucacuccaaaauaggugcugauccuuccuauuccuauucuuugccaccuuuuggguguggugucaccagccuguuuagccaaguagcuuugggcauaggcugcccaaucugagcaaacaccagugaggcucuauugagccaagaccaaguccucaaagcaccugaaccacuguggccuucucagccuacagcaguguggucucuuacauggccacaaagggacacacagugacaaaaggcucggaauguuacaaugguaaaaugagugaucucaaauccacugacagauauaaaauaggcuuagagaggaaaagcugccucuggucaaguagaucauggcagcaugaauuccaacucacuuuuuuacaacuccaacuucuauguuuaucuuuguuacuuucacuuuuuuacaaccuggccagaggcauuuuuuaaaucaggcccaauaucaguauucuuuuugugugugccaauuuuguuaucacaucccuaugaaguugaaaaauaaaguuaauuuugaccaaaagacu

SEQ ID NO: 18752 - RNA, 3434 nt, Homo sapiens
uuggauguuaugagguaguugaucuaaauugugaggcuuucuuaaaggcacuccuuugaucucauggagugagagacuagaaaucuauucaacguauuaaaacuccucucccagcaaaauaaaauaaacaaaacauccuccuccuaauggcugaaguuccaucuagcugcuauggccauuuuauggagcauggugccaucuuguggccacucucaaaccacccauuguuaaucaagugcaauuacagcauguuaagagugaaaaggaaagcuauuuggagccauggucacuugggauauuuucaaauguucucaaagaacaugacauuuugguuacuuuuagaauuuuauugacuuuuuucuucauaacuuuaaaacaaaaacagcgcaugaaaaccagugucuuauuccaaagucucaacucagcugauugccaggugaacaucaccaucuuacuccucugaauaacuagacacaaauuacauagcaaguucgaguuucugcccacccaagacacagccaguaaucagucacaaacacagacacagccaacuccaggggcuccagcuuucugcccaucuucucucagcaguuccucccaucugcuaagaugcgccuuccugguggcucucucucaaggugggucaaggcugaacaagacagaaaagcacagucuagguccaccaucaccucccacuggccaccaguuggccagccaggaaaucauuucuguacaucuuuugucucccccuuuuaucucccucucucuucuccaaaacuuguugcuaucuaucacuuucauguaacaauggacuuaguguccauuaaacugccugagaagugguuugagccugacauauuuuccugagcuaaaaaaggaaaaguaccucuguggccuucuugccauuaagaucaaguaaaaaagggacuagcacuacugaaaagggucacgcuagaaaagccuuagaauccucucuccaccccgugaagguuucucuagcuguagcucuuaaggguacaagacggcaaauauucuggggugaaggagguauaauggggaaacacauuuauuuuccccuuuuaaacuucccugcugccccagucuuugccuucuucuuaguggaucccuuggguucuggcuccuugcgcuuagcugaagagagugagccggucaccuugaagaaaucauccaggcggcccugggugcugccuuggcggcucuuacucagccucuugaccccacugcggauucgcuccucagagaacugcuuuucaccacacaugaacuugaucagcucuucuucauuuggcucgcuccacuucagcuccacagacucuggguccagcaccucagguuccaagaagagcuggugagccuccuuguggagccaauuuucuggcacaggguacuuguuggggucaagucgccgcacgaucuccucgaugcucuugugcuucuggaugagguccacagcccgcuugggcccaauaccccggauacucucacaguagucacugccuagcaggaugcacagauccacaaacuguuccugguucaggcccagcuccugcagaauccggcucagguggaauuccuggauuggcagcuuuuuggcuucacuggcagucaggugucgcauuagcacagggcugccgaaggugaggcaguccauguccucgguagccgcagcauagacuuugccagccuucaccagggcagcacagcuggccucugccucacugggugcaucaagauaagggaugcccaugaggcucagcagauguuugcacucaucauugugcugcuuagugaccuucaccagccgcuuagugaauuuuuccaccuccugcucggccccagcagccugagccugcugcagcugcuucucugccucagcccgccgcucacugcguuuggccagcucgccugacuugagcuguggcggcuugccaucaaagacauacacgggcuugaugccguucuccaucaugcgaauggugcgguagaacaugcccaucagguggcugguggucucacccuccucauucugcagcacauccccacccuggcgaacagcaaucaggaacugauaaaugcucauagaggcaucaauggccaccuuacggccaaaguagcucuugaugucauucucccggauggcacugggggccacaucagcaauuaguuuggccaggccuugaauucccauggcaacacagaggagggaugacuaaaaaagaaaggcaagucagagacggaggaaaggagaaagguuauaacugguguuaucucaccaacuucaugccuucaacuaaauuccacacaacaaaaaggacaccaugucagcacugcuaaagauaaaaagaugaacaagguccccauucucaaaaaacucagucuagcaggagaauuuacucaauaguaaggcucaacgaguaccagaaauugaaccacgugcuuagagaaauaagauacuguugauauucuaagguagcagcauuauuuauuacacaaaaaaaaccugcaacauaggucuccaucaaggaccacagaaggccaggaugcuuggccuggcuugaggaguccagggaccauaauggcagaccugaaagacaggcaaauacaccagcuaaacaaacagaucugauuuguuuugagucucuggagaacccugacuaauaaggcagccuugaaaaaggauugcaaacauaucugaauggaggugauguggcuuucucacaagcuucucuaaacucucuucaucaucgccucagcacauaagaguuucuacuuuuauuauaauguugcuagaguuucaagucuuucccuuugcguuuucucgccaccacucagucugaaauguuaacuccauggcuccuccccagguccugauuuaggggucuggcaugcuguagucacugggcucaaaagaguauugcacuucagaguucaguguuucccagauagcaguguuucccaaaucacccucacgauuuuugcuacuuccaacuaaaacccguacuuucauucacuuagaauuuuuuuuaaaaaacuaaacuggaaaacucauaagcaauaauauuuguguucuauuaguuauauuuuaauauguauuaaauguauaacuauuaaaaaggauuuuuagggggugcaauuuaaaaucaucuugccauccuggccaacacggugaaacccugucucuacuaaaaauacaaaaaaaaaaaaaauuagcugggugugguggugugcaccuguaaucccagcuacucgggaggcugaggcaggagaaucgcuugaacccaggaggcagagaaugcagugagccgagauugugccgcugcacuccagccuagcaagagagugagacuccgucucaaaaaaauaaaaaacucaucuugugcccacuguugguauguguccaauacuccaagaaa

SEQ ID NO: 18753 - RNA, 4595 nt, Homo sapiens
auuuugguuacuuuuagaauuuuauugacuuuuuucuucauaacuuuaaaacaaaaacagcgcaugaaaaccagugucuuauuccaaagucucaacucagcugauugccaggugaacaucaccaucuuacuccucugaauaacuagacacaaauuacauagcaaguucgaguuucugcccacccaagacacagccaguaaucagucacaaacacagacacagccaacuccaggggcuccagcuuucugcccaucuucucucagcaguuccucccaucugcuaagaugcgccuuccugguggcucucucucaaggugggucaaggcugaacaagacagaaaagcacagucuagguccaccaucaccucccacuggccaccaguuggccagccaggaaaucauuucuguacaucuuuugucucccccuuuuaucucccucucucuucuccaaaacuuguugcuaucuaucacuuucauguaacaauggacuuaguguccauuaaacugccugagaagugguuugagccugacauauuuuccugagcuaaaaaaggaaaaguaccucuguggccuucuugccauuaagaucaaguaaaaaagggacuagcacuacugaaaagggucacgcuagaaaagccuuagaauccucucuccaccccgugaagguuucucuagcuguagcucuuaaggguacaagacggcaaauauucuggggugaaggagguauaauggggaaacacauuuauuuuccccuuuuaaacuucccugcugccccagucuuugccuucuucuuaguggaucccuuggguucuggcuccuugcgcuuagcugaagagagugagccggucaccuugaagaaaucauccaggcggcccugggugcugccuuggcggcucuuacucagccucuugaccccacugcggauucgcuccucagagaacugcuuuucaccacacaugaacuugaucagcucuucuucauuuggcucgcuccacuucagcuccacagacucuggguccagcaccucagguuccaagaagagcuggugagccuccuuguggagccaauuuucuggcacaggguacuuguuggggucaagucgccgcacgaucuccucgaugcucuugugcuucuggaugagguccacagcccgcuugggcccaauaccccggauacucucacaguagucacugccuagcaggaugcacagauccacaaacuguuccugguucaggcccagcuccugcagaauccggcucagguggaauuccuggauuggcagcuuuuuggcuucacuggcagucaggugucgcauuagcacagggcugccgaaggugaggcaguccauguccucgguagccgcagcauagacuuugccagccuucaccagggcagcacagcuggccucugccucacugggugcaucaagauaagggaugcccaugaggcucagcagauguuugcacucaucauugugcugcuuagugaccuucaccagccgcuuagugaauuuuuccaccuccugcucggccccagcagccugagccugcugcagcugcuucucugccucagcccgccgcucacugcguuuggccagcucgccugacuugagcuguggcggcuugccaucaaagacauacacgggcuugaugccguucuccaucaugcgaauggugcgguagaacaugcccaucagguggcugguggucucacccuccucauucugcagcacauccccacccuggcgaacagcaaucaggaacugauaaaugcucauagaggcaucaauggccaccuuacggccaaaguagcucuugaugucauucucccggauggcacugggggccacaucagcaauuaguuuggccaggccuugaauucccauggcaacacagaggagggaugacuaaaaaagaaaggcaagucagagacggaggaaaggagaaagguuauaacugguguuaucucaccaacuucaugccuucaacuaaauuccacacaacaaaaaggacaccaugucagcacugcuaaagauaaaaagaugaacaagguccccauucucaaaaaacucagucuagcaggagaauuuacucaauaguaaggcucaacgaguaccagaaauugaaccacgugcuuagagaaauaagauacuguugauauucuaagguagcagcauuauuuauuacacaaaaaaaaccugcaacauaggucuccaucaaggaccacagaaggccaggaugcuuggccuggcuugaggaguccagggaccauaauggcagaccugaaagacaggcaaauacaccagcuaaacaaacagaucugauuuguuuugagucucuggagaacccugacuaauaaggcagccuugaaaaaggauugcaaacauaucugaauggaggugauguggcuuucucacaagcuucucuaaacucucuucaucaucgccucagcacauaagaguuucuacuuuuauuauaauguugcuagaguuucaagucuuucccuuugcguuuucucgccaccacucagucugaaauguuaacuccauggcuccuccccagguccugauuuaggggucuggcaugcuguagucacugggcucaaaagaguauugcacuucagaguucaguguuucccagauagcaguguuucccaaaucacccucacgauuuuugcuacuuccaacuaaaacccguacuuucauucacuuagaauuuuuuuuaaaaaacuaaacuggaaaacucauaagcaauaauauuuguguucuauuaguuauauuuuaauauguauuaaauguauaacuauuaaaaaggauuuuuagggggugcaauuuaaaaucaucuugccauccuggccaacacggugaaacccugucucuacuaaaaauacaaaaaaaaaaaaaauuagcugggugugguggugugcaccuguaaucccagcuacucgggaggcugaggcaggagaaucgcuugaacccaggaggcagagaaugcagugagccgagauugugccgcugcacuccagccuagcaagagagugagacuccgucucaaaaaaauaaaaaacucaucuugugcccacuguugguauguguccaauacuccaagaaauauucuacuggggccaggcacagaggcucugggcaguaaucccagcacuuugggaggccguggugggaggaucacaugagcccaggaguuccaggcuacagugagcuaugauugugccaccacacuccagccugggcaacagagcaagacccugucaagaaaagaaaagaagacaaaagaaaagagaaagaagaaacgaaagacuccaucaggccuuuucauuguucccacucuuucuucacaggguucuuucuagagcaucaaugacuguucaauucuuccuucuaauucaguccaaacacuucagcauggcaucacgaucuuucauguucugguucccaaccuaacccuacauucugggaucucaacagaaagcuggaauaaggcccgccuuuucccacuuuuccuuagcugugcccuccucucgccauccucucacgcguccuuccagguccaucccuggauuauuaaucaauuaauaauuaauugacaaugaauuauucauuugauuaauaugaauaauuccccugugaacugcagcggcaaaagcucuggccuugaaucuaggcgcggcauuuaccauccgugugacauuaccaagccacugagguuuauuuucucgucuacagaagaagaacgauuaccaugccugucucucagggcugcugccaggguuaacugagacaacagacagaaaccucuaauguccccucuccaggccuguucaacccuucggcucuugccucaagccggccgcgcugcuggaguguggacugaggaccagaccauguagcccuugauccccucacggcgucccacagacagguaggcaggaaaggggccuaaacaacucaagugucagaaauguuucucguccaaggucuuaggaaaaauacaacacgaccccauaagguggaacuuauuaccgcuuuucuacaauggaggaaagagaggcucggagcuuacgcgacuggcccaaggcucacagggggaaaaguggcgggaccucuugacugcgaaucccgcgcacuccagaccccggcuccccacggcccccagcgccaagcggaccccgucgcucccggaggcgcuucccauggggucucaccuggccuuugggacacgcggccucggcggcuaaagcuugguucgggguugccccgggcaggcgguccuaagcucgcucucccuucucagcuuagcggcggguggccugacguucagccgccuuccaaagcccgcgcucccgucacgugaccugcucgccacgcacagccucuuggggcgcguagugcaggcugcguccccucagacggcugcucucauggcaaccagucccuccagggagaacagagucucucagcgacccuggcguacccuucuccaccgcuuguccccacuccacccacaccagguccccgcaggccccugcucccucuacacccgaaaucgcaggacuacaagucccucaaugccacuugcgccg

SEQ ID NO: 18754 - RNA, 1273 nt, Homo sapiens
gcggagggagaaaaaccucugggguguaucagcuggaaaagaauaggagucucaguguggccccucuccccccucucagcccagccccugcgggggcggugagggagcugcggucagcacacacagcuggggccuccagcaaaaucccauucuauauaucuaagagcaacagcucugagagcggcccccagagggacaaaaccucauugugaggcacccgccggccucagcacccccucccccaaccccagaacugucguggcauugacccuuuucggcgggccaccaugggccugcugacugggccacaucuggggcucaggcauuggcugccccucccccacggcuggccacugagaacugacagggaggcuggggugggagcggcuuccaggccucucaccccauccccacgggguggccuggcuugugccccacccucccuggggaugcugcaaggcagaggugagaguccgaagcuggcuacguuggcaucuugaucugccagcagucccccacaccucuggccucuguuuaguggcuugucaaacagugguugggugggguagguuuuuccagcuuuuacgugcugccuugaagggucccgagaggcuucaaguugagccacucugaagcgggaugauucucuaggucugggauuccagaauuauccgcucccaagguuucagagguccaggauucuguagauuuuuguuuguuuguuuguuuguguuuggagacaggguuuugcucugucgcccaggcuggagugcaguggugcaaacauggcucacugcagccucacugcagccucaaccuccugggcucaagcgauucuccuuccucagccuccccaguagcugggaucacaggcaugugccaccgugccuaguuaauuuuuuaauuuuuuguagagacagggucuugccauguugcccaggcuggucucgaacuccuggccucaagcaauccuccugccucaaccucccaaagugcugggauuacaggugugagccacuggagccugacuggauucgguaguuugaagaugccaccauacauucauucaacacauuuauugagcaccuacugugugccaggucauguucuugguguugaagcuauagcagugaccgauacagaaaaauaucuugcccucguagggcuuccauucuagagcaagaaggauaauaacagaaacuaaauaggaaucuuuuacauggugagcaagaaaggccuagguagggagaacugcuuuagguaggcugguugg

SEQ ID NO: 18755 - RNA, 907 nt, Homo sapiens
uuguuauucauuccuuuaguaaagguaauucaucagccugacucgaguuucuguugaagaauccaugagcuucccaguugguaacuucugccuuauggcugucagaucucaucccacagaauccaagugcuggaauguuccauugggcaggagugcaaagguccuuuagcuccugcaugucagugacguggcaccuggucuaccaugcuccauucugaguccaaggcagauauugccagcgaaccacagcacccccuaccacuggauguggccccagaaucccgagcaacauacaaucccuucagccacguguucuagcaaccagcgucggcacuggauugggaaugauugcuauucuuggacaaguccagucuguuaucccggagauggggaaacugagagcugggguguauaauuuacagaagggaugcaagguagguuagugaagugcugggacccggggcuucuggcucucagguaauccucuucccaccugggcauaggcuuggggagcucugagaagggaaaggugagagaaugcucaauugcagucccugcugccagcuuccguaggucacuuucgggggucugcaggugccagagcugaaguuccuuccucuuucuccuuaaguccggcuccaguucuguugccagaccugccaucuuauggcagcaggaaagcaauauuggaagcugccagacacagugggggcagccccggcuggaguggcaccaggaagcaggaggcaguggugccgguuagugcuugacuugugcccagcuuggcagccccacagcuuccccuccuuguucauaacacacugacccuuguaaguuggugugacacuggccuguauuuagaguaaggaacaucuucuggucagacuucgacaauugaaacccaaug

SEQ ID NO: 18756 - RNA, 19612 nt, Homo sapiens
uaggagccgccggggacgagcugcgggucuccagcagcugggcccugggcaggcuggggccgcucagcgcugacggccagucccggccuccccgcccugcaggccugcggaacccgcugcagaggcgucggaugaggccgagcggcgcgcccguggcugccaccugcaguaccagcgggccggugugcgcuuccucgcccccuucgcggcccacccgcuggacggcggccgccgccucacgcaccugcuuggccccgacuggcugcuagacgugucccaccucguggcgccacacgcccgcgugcuggacucgcguguagccucucuggaggguggccgugucguggugggccgggagcccggugucaccuccauugagguaagcagcuggggaccaggagaguagacccccugagaaggguggaggggcccccaaaauguucgugggugggagugaagagugugccaggagcccagagugugugggggaguugugcggucuaggucugagugcagugggauuggggauaggcucagaaugggguggccgcauaaggggggaagcccucuagcuaugaagggcugagguguggguaguguggggaccgggucuugagggaaaagggaacugcccccuaggugugggauugggguccagguaugcaccggggugcaaagaguagagggauaguagcccaugagccugcugggaguacccgguucccucugggugggggcuguccguggcgaagaccucccccaccuccggagggcagcccgugagggugcugggagcacccgguucccucugggugggggcugucuguauggaaggccccccaccuccagcuccuuuccacccucaggugcguuccccacugucugacuccauccugggggagcaggcgcuggcugugacggacgacaaggucucagugcuggagcugagggugcagccagugaugggcaucucgcugaccuugagccggggcacugcccaccccggggaggucacagcuacgugcugggcacagucagcccuucccgccccaaagcaggugacaguuggggggucagggggaugaggucaacaucuccagaugggggcucaugguagaggggaaugggaggaagggacccugguaccucgaccccuuaggguuuucagagugaggacugacucugugagguagugagcucucugcagcuggaggugaucaagcaguggcuggaguauggcagugggagguugguuagauggcucuaacugaggacccucccaauaacucagacccuagggcugaguggcagacaggugauugacacgcguccccucucucccuguguuuugucuaucugccugugucucuguuuucucucuggucucuccuccauguggccuaucucugugggagugguuucucugugcaugcgugcgugcccucgcaugucucugccugugucugugugccccacaggagguggcccucucccuauggcuguccuucucugaucacacuguggccccagcugagcucuacgaccgccgugaccugggacuguccgucucagccgaggagccuggugccauccugccagcugaggagcagggugcccagcucggggugguggugaguggggcaggcgccgaggggcugccgcugcauguggcucugcacccgcccgagcccugccgccggggccgccaccgugugccucuggccucuggcaccgccuggcuggggcugcccccugccuccacuccagccccugcucucccauccagcccugcuuggagcccaccagccacagaagccaccaugggugguaaacggcagguggcaggcagugucgggggcaacacaggugugaggggcaaguuugagcgggcagaggaggaggccaggaaggaggagaccgaagccagggaggaggaggaggaagaggaggaggagauggucccugccccucagcaugucacugagcuagagcugggcauguacgcccugcugggagucuucugcguggccaucuucaucuucuuggucaaugguguggucuucguccugcgcuaucagcgcaaagaaccucccgacagugccacugaccccaccuccccccagccccacaacugggucuggcugggcacugaccaggaggaacugagccgccagcuggaccggcaguccccuggcccgcccaagggggaggggagcugccccugugagagugggggaggaggggaggccccuacccuggccccuggcccuccugggggcaccaccagcuccucaagcacccuggcccgaaaggaggcuggggggcggcggaagcgaguagaguuugugacauuugcgccagccccuccagcccagucaccugaggagccuguaggggccccugcugugcaguccauccuuguggcaggcgaggaggacauccgcugggugugugaggacauggggcugaaggacccugaggagcuucgcaacuacauggagaggauccggggcagcuccugacccuccacagccaccuggucagccaccagcuggggcaacgaggguggaggucccacugagccucucgccugcccccgccacucgucuggugcuuguugauccaaguccccugccuggucccccacaaggacucccauccaggcccccucugcccugccccuugucauggaccauggucgugaggaagggcucaugccccuuauuuaugggaaccauuucauucuaacagaauaaaccgagaaggaaaccagagcugggacugcugccgucuguccgguagagugaagcaagggggcuggaauagggccuguucagccccugucccugcugaaacggcugugggaggcugggcccugggacgcccucucauagcguccagcgauccagacaaauaggagagccgugacggccugaaugccagccagcaggaagaaguagagguccauccggcaauuguugauguucccuggggaaaggagggguuagauuugggucaggacagggauccucugucuugcgcccugugccugccguguccuagcccuggggcuggcaacugaggccaugugggcaguggugggaucugaagacacuggacagauacccacuaauguuugacuuccugaagaucuccaggggugucuacaauuccucuucagcuauucagaagggggcgugaaauauaaacaccaugagaaagguaacccuucagccagagauggcagaguuccagaagcagaaaggagccuuggagguccacuaaguucaacacuuggggaaagaaaggcccaaggagggaggccacgcugugggugacuggccaagcccgggcuagaaccccauucucccaagucuagcccucuacuugcuucuccccagagucaaagcacuuuagcaguugccaccuccuuuccaagccucccuccauccaugucccacuccuggggaggccccauacucaccaaaguccuuggggcagugcagccagcccccgggcaaggacagcagugccacuaggcuggagcccaacagugagcccacccccgacaggcagaagaagaugcccaugauggcacccugcauggagcgcggggccucugaguaggcaaacuccaggccugcagagggggagcagagacgaucucaggggcuggugcaggcgcagagaacaggcccaggccccugcuugcugccccugacccugcccccaccaagccacccuccaggcuuccccuggaugccuguccacucaguggcaaugacagcacccaugcaucaaugccgccuuccccucugcccugcucaccugccuccuggcugaaccccugcaccgggguacuccaugcgcugccccaauagcucugucuccccuccuccccuuccugccaggucuaucauuucagugacagcaccaucuuuaccuccucucucuccccacccucucugcccaccuucaacgucaucgucaaauuguuuugauacagccucugaaaucuauucuaaauauauguccuucucucuauucccucugcccuggguccaaccccagcccuggucacuuucugcaaaugccucuuaaacuccccugacuccuguccuccucacacagccaggagcaucagucuaaaggaccucggaugggguccuuucccggccaaaacccccuggagaggaggggcgcuguugccuucaggagaaaucccaaggugcaggcucagcgcacaaagcccuucgacacuucggcucccugcaccucccaugccucuccagcccuaucccccacgcuucccaaaggcuugggccuuugcuuaugcuguucccucugccuguaagaccgcuccuccuacccacucaccugcccgccuccucuccaugcuuaagggcucccacugcacucugcccugacuuccacagcacuccacuggcucacuguuugccugacucucuccccaucugagugagcucccagggucagucuuuucuuuaugucugacccagccuagcccugggcccgcagcugaggaagcccuugcuuuuuugcugacugaagggccugccccagccuugcagcucuagcucccagcccggggaaggggguugggaggguggggagcgaaggacauagaaauccauuacuaugacccagaguacugugugcuaugauagagagaugaacacggggcgggaagggaggaccccuucugcccaaggaccuugguauuuaggcucagaauugaaggggauauuggaguucaccuucagucuaagguagagggaacagcaacuucaaagacacagaggguggagaaccuggcaccaggggaauacguggagagcuggugugggaaguuucuugcucgccuccaaauccccagugccugucacauaggggcugacuugaaccaggugcuaauuauagacccccguugggugaaugagcccuggucagaaaacacugccuuccuccaugcagaugggcccugggggcugcaucccugggguaccugacuuugaggugccaccgggcagagcccaucacuggugcaggagcaggggaggggauccaggguaccugggaugcuggcaaagaucucacugaucccaaugagcagguacugagggaucugccaccagauggacaguggugccgcguuguacaggaccuccccaaucugcugggacacggucucguugugguggauguaguguaagcgcuccaucuccaggacuccugguggaggagcagagggggauuauagucaggcccaccccaggcagcuuagcccacagaagagcuuguacaugguggggaugggguacucaugaagcagccaaagauugagcagcaggcaaggaaaagaaugcuggacugggggguggaggagggggccaagaugugaccaacuccucccuuuuggucuuggcugcuagaagcuccaagcugaguuuugcacucaauaacacuaacaacucucauuaauggagaaccuguuaugugcuaggcauuuaccaugcauccuugcugcggaagaaagugaaauaacuagcacuuucaagugcuuaacuagaaaguuaagcaacuagcccacagucacacagcugauaaguagucagggcuggauuugagcucugguaugucugguuucaaagcuggccuacuuuccaugauaucacaugacuucucuacugcaacgucaaguauugcuguaguguuucuaaccuggcuuucaaguuuaacuauguuaucuccuucuccuguguugcuugggagauagcugugcucuaguggaaugaacauuggacauggaguugggggaccuggguucccagccuggcuagcugugugaccuugggcaaaucacuuaaccucucuagacucaguucccuuacucaagaagcaggaauaacauucccaggauuauugugaggauaaaauaggacaaacugcuuuaaggauauagcuggaauaaaaucuaguuggguuuucacacuuucaacacaauaccguuuauggagcuuucauuucuccagcucauacuugugauccaggcacacuacugagugcuuuacagacuucaucugcuguaauccucacaacaccccccaucagacugaguuccacaagggcagagcccugcucaggguccgaaugacaccuguccccauuuuaaagacauagcucagagacucuaaggaacuucagggucauaaaguuacuaaguaaaaaggguucagguuugugcaacagugugaaagacuucuuuagcugaucccccccacugcccccaccaacccccacuuuguaacaaauggcuucagauccuuuugaaauggaagaaggaagauaauuuuuuuuuaagucuucauuugccacuaaguggaaaauucauucaacacauuuauggagggcccacgugcauguucauagcagugaauaaaaaaagaaaaacuaucucugccuucaaggagcugauaauucacugggggaaaauauuuguuccucucucggccugaguuucuucuucugucaaaaugaggggcagcuggauuagauaggagggucucuuucagcuugcaccucugggaagccaacacugacgcccacugggagaggcugaacuugguccaggcuaccacuucagcaucagcccaugguggaagcagacuuccccaagcccaaaguucagcccccugccccacaccccucugcacaccugccacaaugacggagguaaaaccaaagaacauccccagcgccaucuucugcagagcagagggaagcagcuugcaccgcagcaguaaagggucgaucaagcgguccuucagagggaccagaaucagcaccaccacaacauuggccaggaggagccaggcuuccgggaucugggcaggaggaagucaggagaggcaggcuagcagagugcaaggagccuggcugcagucaggagaccuggacucuagacuggcccugggugacccugggguccagcuccuuucccucucuggaguucaugcuccucagcuguguaaccagggagugggauuauguagagauggcaaauagguuccucuuguauucuaacuuuuaucaauugguaguggcugauuauggaacauuuaugggcucagcauaaaaaaagucaugauugacuagugaugucugccaugggcaaggaaauggacuacaauggcaaauuucucauauaucugccagcucugcagaucauucauuucaugagucugaaaugccaaggaacugguuuagaaaguucugggaaaggcagagaucuagguaucuaagggucccagagaaagaggggacaaggaagaguugaaaagggaccuaaguaugcuugaucugagggugcaaauuaggcagcgagaccugcuucagagcagcagcaugggggugugcagcuggccugaauuccuucaagcaguugagcaucuuggcaggaucccugcgcugugacacaaguccucccacccuccaggugcuuuuccuguauccugagguugccuugcaggcaggaaaggggagugugaaggcaguuucauuuccuccucuucucagaggaagccgcuaccuggcugaacugggugccgaacacaugcuuuaucucucaccguguagcugcugcccugggcucucagggccacagagauguuggccggguuggcugggaaaauguuugggauguggaggugaagacccugcaggacauagguggacugcaucugccaagagagacaggggugaggcuggaacagaaacggccaugcccccucccaacuccuagguggcauuccucagcgccguaccacaggacagcugggcagcuguccccucucccagucucagggagauagucaccuucccacccuccuuucuccuagguagcugggcugggcagggagcuuccugugcucugcucucaggccuguaggcagugcgugcagccuuaucccagagcccaggcacagcuggucugacuaguauuuguguccccagggcccagcacaggguaagcauggauaaauguuugcugaaaugggaaagauaauggcugcccccacagggaguucucaucugacacugaagccaagcugaguccacagguugacacaagcacugcauagacauggacuugccagaauggcucuggacacagcugcaggagcagggcccaggggccaccuccaauaccacgcacugccccuuuaguugcuauauaauggaguaggauccaggagacucccacaggaagggcuggggcaggggagagcauguggacugcucagggcagcagccauuuaccaacugguauggaaggaagucaguaucugauugguaugacugagaaucagccauggacacccucccaccacaugccgccaucucaucauagaaauacugugugccccuaaguagcaggcugggagcuccaacaaauguuccugugaaggggguauggaaggcaaugaccuuauggccugggggcuagcauuaagcugcugcccacccuccuaucacacacacacacacacacacacacacacacacacacacacacacacacaaacacaucacuaaccuccccacugaggaguaauauggugaguggaagacaauaguucucaacucugaguaucuguaucaucugaaaaguuucuuaaacuagaaacuuccccagcaauucugauucaauagccugugguuggacuuggaaucuguuuuuaaaacagcauauuuuuaaaagcucugccggugauucugaagcacagccaggcuggggaaccacuguugcaaaguacucacuuuugugagcuugccccugaccugccugccguggggccuugggcaacugacacacccucucuaggccucagcuaccaagucggacaaucugaaugcagcagagcuggaaaagccucucguuuaagccacccauuguacacaugaggaaacaggcccagagagaugaggugacuuauucaaggaccuagccuggcacaaagccaucccaguaauucaacucccgcaggagguauagcaggaggaagcugucuccagaguuccucuugccguaccaccgagggaguuggauugcugagacggcuuugugccaggccccaugcuagcugguacggggcagcaccucacuuuauucccagacuuucccccuuuccacaugcccugggccucugugaugagaaaugaggccauucagauggugaguggggagccaggcccccagagaaaaagggcagguaugcucaccuggaaguagaccauccaguagggcaccagggucaccaugacgggcaagaucuucaccagcaccuggaaguuggcgauguccucuugcggggaagccccuggcuggggagaccucucgucggccagcacgcgggcacauugacggucucugugagaccccagaggcagcagauaaaacaacagucaaggcugggcuugguggcuuaugccuguaaucccagcacuuugggaggcugaggcggguggaucaccugaggucaggaguucaagaccagccuggccaagaugaugaaacuccgucccuacuaaaaauacaaaaauuagccaggcuguuuuggcgugcaccuguagucccaguuauuugggaggcugagacaggagaauugcuugaaccugggagacggauguugcagugagccaagacugugccacugcacuucagccugggcaacagagccagacucccucucaaaaaacaagcaaacaaacaaacgcagcagccauaaucuuccccaccaccucagccaacguuuucacuucuaccaucacccccuaauuuaauccuccucccaguaucagcacgucucugaaaucaguacccucaucuccuccaccccgcuguuagcaccaccuucgccaucaucaccaccaucgccaaggccagcauccuuacuaucaucaccuuuaguaaggugacugcugucagcaaaaucguccucuccacgggguuuccauucacaucaccaucacucuuuuucaauguuggcaccacuacugccaauauuauucuauccucucuuuugcugcaaaagugccuagccaagacucauuccgcucuagagcuguggccccucugaguccugagggaaguaagaccagagacuguggaaaacagucugaagggauuuuuuggcucguagcaucaauuugccacgggaaccaggggagucccaguccaagccugacucagagagagacgcugucacagauuugauacaccaaaauuccccccccuugcugucucaaguccauccuccucaacagucaacauggcaacccucucccuccaugacaaggcauagagaguggagagguggggguagagggaauaucaguaggcgacaagauugaucaaucacugcugcagccuuuacccuuugcccuuugcccuuuguccugagagcuuucugaccucuuuuuguccaagagccuugcacuguccuuugagauuccaaaagggacaauauuaguguagucaucuccaaagacagccacugucaacuccacccuucccagcgugugcugccauuuugccaccaacagguggaguuuacuuucacugccauuguuucccugcuggccuugugacagcuuugaccuguuagaaugaagcagaagugguggucugggacuucaacgccucuuaaggaccuuaagaagacccauaacuucugcuuucuuccuccccggaacauucauucuuggaaagcucccuccucuuggaacccucacacgacgcugugagaaguucaagccacaugguaagaccacacgaaugggaaccaaggugcucugguccacacagucccaucugagcucacagccaacagcccacauugacugccagccauguaagugagcagacucagaaguucuagcccuuuccaggucccaaaugacugcaaccccagugccaucacgagaagcagaacggcccgacugagcccagucacucagaacugggagaggagauaaaaaggucauuuaaaucacuaagcucuggugugguuuguuaggcagcgauagguaaugaaaaccaccacacuucucggcuccugacaacuuacaaaccucuagcaauaugccagacuggggaaagcauguucuucaccuuuuucauuuagauccuauugacaggagcuguaacuggcugcaaggucuggagacagauuugcuuggcauaaguagacaguuaauuuaggaaggcgaggggcaaaaggaagccaugggaccuaugcaaggucauucagaaccuuccuccuuuggaugucagcuaaugaggagggagcgaguuuggccgauuuccuaagacgcugugaugguuaguaacaggguaauguggaauuauuuacauuguauccuaacagccuucauuggaaacaucauccccaucauccucuccuuuaaugccacugucauccgcauugccaauguuugugucuucaguguagauaccaacaccaucauccuuauccuuacuaccaucuucacugucaagacccugaucauccucacacuuccuuuuuuuucauuuuucuuuuuuuauuuuuuuccuguucugucacccaggcuggagugcaguggcaccaucauggcucacuccagccucaaccuccuggacucgauugauccuucuaugucagccucccaaguagcugagaccacaggcacaggccaccacaccccacuaauuuuuguauuuuuuuguagagaugagguuucaccauguugcccaggcuggucucgaacucccaggcucaagcaagccaccagcuucagccucccaaagugcuggaauuagagggauagccaccgcccccagccccauccucacacauucuguacguagauggcaaccaauaauaccaccaccacuaccaccacuaccuugaccuccauccucagucacagcgggcagcucuggcccacuggagagcagaucaucauaaaaagcuaucacuguagcugaaccagaaugucugcaaccuggaccaugccuccccgggagcgauccagcgcuucuccaggcuuggaggcucccugcacccagagccccuccuuaccuggccgagugucguugccacagcugggggcagcaguuuuggagagcgagcuuaagcauagaggacacuuggcugcccaucgggggcuuggugaugaagacggggguggcaaagaggaagaugaaaaaugccaggcccacacagcccacagggaugcuguagcccagcaggaagcugauguucugcugaauaaacgccaccaccagcagcgacagcacagcacccagguugaugcuccaguaaaaccaguugaagaagcggcggguggcgucgcggccgagauccaucaccugccauucaggaaggggugacagugagggccaaagggguccggggcacucucuguacccauaccccucccuccuacagagacacuucuugggucaguggguggugggcguuccgacacuuucccagucucugaucacaaacagaugcucaguaaauauuugcugagugaaugaaugaauccuucucuugggagucacuugcuaaagaucaggacauuuggcccagcugcuuuugcauacccaugacacacacugcuuuuuuauugucgcagaggaacacauacaacagaugucucagauggacuuguucauuucugguugauuuaucccuuuguuuuucacugagcaaccuacacuauucauuauuuuuuuuuuuuugagacagucuugcucuguugcccaggcuggagugcaguggcacaaucucggcucacugcaagcuccaccuuccggguucaugccauucuccugccucagccuccugaguagcugggacuacaggcaccugccaccacaccuggcuaauuuuuuguauuuuuaguagagacgggguuucaccuuguuagccaggauggucucgaucuccugaccucgugauccgcucgccucggccucccaaaguucugggauuacaggcgugagccaucgcgcccggccuauucauuacuuuuauaaucagaaaaaagccaauaagaucucaguuuuauugcacauuauuaaaaauguuguaugcauguuaccgaaagaacagaagucugagcgagaauuuccucugcaguucggagaggcaagcagagaagccuacugugacccauccuuucaccccacuuuugucccucugauauacagcagagguggucccaggcacagccccaagagugaguucuggccuggugaaaaaaacguuuuuuuucaggccucccagcaagggcagaugggcugaaaaucuuuacccagaauuuggaucaaucagcaacagccaggccccaggccccuucuggucuguuggcuccagucagcugcacuagcugcuuccaaaucucccaggcccaggucccagauucugacucagcaggucuggggcaggaccugggcaucugcauuuaaaaaaaaagcagugaggacuaggggccauuucaauggagagaauaaauacuucucuacauugcuaaaccagucacccuuuccaugccccugcaaaucucaggauccauuacugccuuucaaguagagauuuauauuuccacuagcuagggcgauuuugucaaacuuuacuuucuguaguugcauuggggaaaagacaaguauuuauuuuuccuuuuucaaauguaaaauuauaguccacacagaugcacuuaaacccgcauuccauuggagauucugcgggguccuccuggaaguggggagggaggggcauaccagcucacugauaauucucgcucuagacuuucaagcagaaaauugaauaggucccauuagaagcagccacuuccauuuauuaauuggaaguaaaugaaugugacuauuguaacucuaagggggaagaccaggcagcccauucaggauauaaaugaguucuuuuagaaugagcagaugcuuugucgagagugauggauggcccuuucugaaaucagcaaguaugugaaacacgcagcuccugggguauagcuguugccagauggugccagucccacccacccccacauccccaucugacugccccccugaauucugcagccgcuuccugccuguugugaaguacccacucuuguuaacccauaugcuaucuacacugcagccggagccauuuuugaagagcucaaauccagugauguccauuccugccucaaaucauuuugguguuucugcacuguccuagggaucaggucccgacuucaugaggccuuguggccugccuuugcuccacccaaaguucgugcccagccaaggggagaacguacaggagcuucuggcccuguugaugccacgggaggcucugcucaguggccuggccuccagaagaucaguuuugccacaggggguacuagaugggugaggcucucuggaggucaauagggucaaugacacagguuaaggguacuggguugggggugcuagugggaugucaaugaaauaauaggauuaaaggaagaugagagauucccauugacaaauauugggggucucuaggucagaaagaaugucaacaagaaguaagaaacggucagggcuggccggucgcaguggcucacgccuguaaucccagcacuuugggaggcugaggcagguggaucaccugaggucaggagucaagaccagccuggccaacauggcgaaaccacaucucuccuaaaaaaauacaaaaacuagccagcgugguagcgggcaccuauaaucccagcuacuugggaggcugaggcagggagaauugcuugagcccgggagguggagguugcagugaucugagaucgcaccucugcacuccagcguaggcaacagagcgagacuccgucaaaagaaaggaagaaagaaaggaaagaaggaaagaaagagaaagaaagagagagagagaaagagaaagaaaggaagaaagaaagaaagaaggaaagaaagaaagaaagaaagaaagagaaagaaagagagagagagaaagagaaagaaaggaagaaagaaagaaagaaggaaagaaagaaagaaagaaagaaagaaagaaagaaagaaagaaagaaagaaagaaagaaagaaagaaaagagauggccagggcuggccugggggcaugaagucaucaucaaaggauccuaaacaagcuggacaagugacuccuugucaaggacacuggaaacugcuaggugcugaauugugggugccaauuggaugaaacgauccuuuugaaaaauguccccuuuaugaguauaauaugugcaaucaaagaacauuugauaaacugagacaagaagaaagugcaauuaguccaguggccugaucauaccacugugacaaucuuuuuccaguuuccuuucguugacaccucgucuuuccacauggcugcaguccuaucuguaugcaguccugccuccugcuuuugcucauuuacaccauaugugguuauuuuaauaauauuacauuuuagucuaaauuauugucuaauaucccacugggaacagcuaucaaaauauagccguguuguugggcauuuacucauucauuuagcaaauacuuauuaaauuucuucuacgugccaugcucuguucaagggggaacggagaaaggcucagagguugagcuaagggagaagaccaggcagcccauucaggauauaaaugaguucuugcccauguggcuccagcuagugaaaggcagagcugggaucugagcaagucggccugacagccucuagcacugcugguaggaagaagcuggcuugcuccugcccugcccgcacauccccauaacacacagagaggagguucauggugggaccuggaguccagcugccuuuacucggcuccucgacccuccaugucaccuugggcaaguugauuaaugccaugaaaccucucagugucuuucucuguaaaaugggcauaauaauuccuacuuccuggguggugaagaguauuaaaucaguuaaacagugaaagugcuuagcauagggccugcaaguagcucaaaaaagaccaaccugccuggcgugguggcucaugccuguaaucccagcacuuugggaggccuaggcagguggaucaccugaggucaggaguucaagaccaacauggugaaaccccaccucuacuuaaaaaaaaaaaaaaauuacaaaaauuaguugggcgugguggcaggccccuguaaucccagcuacucuggaggcuaaggagggauaaucgcuugaacccgggaggcugagguugcagugcgcugagaucgcgccauugcacugcagccugggcgacagagugaaacuccgucucaaaaaauaaaacaaacaaaaaaacaaccaugguuauucccacugcgguugccaucgguuuugcaagggcuagccccccucuucuuucaaaucaggaaacuagugcaggcaggggaccugguuugucccaggucacgcugggggccagcccuccuucccuccacacccgccggaguaugccggggcaggccuccugccacucaccuggucggcaccgaaggaggugagguugcuccggacggagcuggcggccaggccgaguagcagcaggcccgcguagaggacgggcgcgcaguaggggcugggcgaggagcgcgggcagccggccgaggggcaggcaggucccagcggcgacgcgggcaucucuccgcagaaggagcugcggccgucggggaaggcgguggcgggcagcaggcccgaggcggccagguagagcagcaggcugagcgcgaccgcgcgguagcggcccagguacacgucggccagccagccgcccacgggcgccagcagguaggaggcgcccaggaauaccagcgcggcgcgcgucgccugcucgccgguccaguugaaguuggugcuguugagguacagcacgagguuggcggugacgccgaagaaggcggcgcgcuccagcaucuccaccagcagcacggccgcgcccgccgcccgccgccaccgucgagggccccgcgcaccgcgaggcagcagcggcuggcgcuccccgggcacgcggggcugcucccgggcgcgcggcgcgggcauccuggcuccgggcugggccccccgcggcucuucucuccucuccucuccccgccucagagcccugcacuccugcccccgggccucggcccucucccccacccaacuggcuggcccuccuuucucaccgcuuuggcccacccuucccuccuguccccucucccuuucuugcccuacccuuccugucccuccgcucacuacccggacucuaccaccuccucccuaauucucaacuccccucucccuucccccaccccuaaggcuuccuccccgcgccucuccugcagcuguuucucccuaacucuccccucuccucccuccaccuugacccuuccucgcacucuuguucacacugcgacccucccugcuucacuucgcugccccuccgccucccuuuccccuccccguuugucgccccuuccuguuguccccucuccuuaugacuccuggccugcccugggcguggggugggggcucccucugccccagucacccugcugccccuugccgucuucuccaccuccucccugucccccucacccccacugccuacacuccccucucaguccccugcagcccuccccccaggcucagccucugucccucucucggcuucuugagaaacucugggcuccccucgcuuccccuuucacaggcccuauccgcaguccccugccugcaucacauggcgcuacuggguguuuaggagaagugaaagccugggucacagggcuccugcccggucagcuuucuaaaaaccucccuccuucucuaccucugccuccuaccccaaacccccgcugcuggccuccuuagagccaaaaaauuccaggaggaauuuuuucuuucaguuucauuucucgccaggauuccacuuuugcuuuacccucuuccaaucaaacuccacgccuccacccgaggcgccacggguagaaagaaguggaaaggcuaccugcaucauuuggucacacucagccauuucacagaugcagagacagacccaguggggcuagggcaggaagguggagaaagauugguuccugguaacugaacuaggggugaagcccugccccgggcuccugaguggcagggaaauucacagcgcaauucggauugcacagaggcugcugugaggaaggaaguggggcacuuucaacaagccugcgggccauagaggaccacaagugagucgggauugagagggacaccgaccucagacuaaaucagagucagccucagaacuccuaagcaccagccccacccugaccuaggagcccgggggaucuggccucugcucuccucugaucucaucucagccccauguucacucaaguccagccagccggccucccagguuccccuuccaugcuaagcuccucccugccucagggccuuugucuuugcugaccccucugccauaacugcucucccuccauauccuugcauggcuggcugcuucucuuuauugagguuucagcauauaugucuccuuuguagggaccuucccugauuuucccaucuaaguaguuuccuacuggauucucagcaucccccaucacauugucuuguuuuaaugucuucagagcacauauuacuuguucaguuagcaccaguagaauaggcccuccaucagaucagagaccuuuucuaacucuucacuguuuuauucucaauggcuucccagugcuuggcaaauaguaggugcucaauaaguauugccugaaucaaugaauggaaagagugucccaaggcaaaauuuguaagaauaauaauaucaggaaagcuaaagcuaaauaaacugagucucacaaaagcuauagauaccagcaaaaaaagcacuauagauaccagcaaaaaagcgagggauuuuuuguuguuguuguuuguuuguauguuuguuuugagacgaagucucacucugucgcccaggcugccaugcaguggcacaaucucggcucacugcaaccuccacuuccugaguucaagcaauucuccugccucagccuucugaguagcugggauuacaagcgcgugccaucacgccuggcuaauuuuuguauuuucaguagagaugggauuucaccauguuggucaggcuagucucaaacuccugaccucaugauccaccugcuucggccucccaaaguccugggauuacaguugugggccacuguaaguuuuuaacauguuagagaagccaggccaagaggauggugagaaagcaaagcccuccaucccaggucuuccugcagucacugcagucaggaccaugugcucucgugaggugggcagagccuggaggagagaagaggagacuucaauggagcugcaccaucccucgacuuggaggaagcuuaggucaucagcugugacgguauggugacgaaguucagaucacaucagauccagcuccuuccucucuuggcaagaucacuaggcuggcagauga

SEQ ID NO: 18757 - RNA, 12843 nt, Homo sapiens
cguccucuguugcuuccagggacguggcccucuucccgaccucggucgccugagcgcgcagggauuggggauccguagggcacuaggacccggcggggcggagggggcagcccaugugcugcgauucgcucccucccaccccacugcucccgcuccauugucugggaauugcagccgcggggcgggcggcggcggcggcggcggcggccgggacccagcgggccagguggggacggcgcggagcgggugcgggagaugccgugcgggacuggggccaccugagccgcccgccucguccccgccuucugugggaaggaugugcgcgcggauggccggucgcacaacagcggccccucgggggcccuacggccccuggcucugccuccugguggcccucgcccuggacgucgugagaggucagcgggaggggagggccggggcgaggggcggccgggcccggccgagugggagcgagugaugcccgggagccaccaaccuuuggguucucggacugaacccugagcggggucgccccgcagcgcccugaaggucggagaguucuugcccucgggaaccugcccccagccacucgccccuaaggcuuccuucaccuugcacgacccggcaacuccuuccugacccggggcagcccggcgcaggggcuuccccgucccgcaccuucugcgagggaccccucagcccgggcaucgaacccggcggccccggucccgggcgcacuagcgucauccccacucccucacuguggucuguagcgcugcacccuccuagccuccuuccgccgccaccaacccaccccccucgggaguggaaagcagccccuuugccugggaccugcaacagacgcaagcccucccucccccuucccccagggcucccugaccuuggcgucuccagggauggccgcauccuugccuuccagaaccuuugagaggauuccugucacugcgggaaagggcagcaacuucccugugcuucggggugggggucggacucccuuggccugggcuagcugggcuguggcugcaaggcaaaggaugccacagaagacagagggacagugaaacauucucugcccuccccaccgagagagccgagcgcugggugaugggaguccgugggagucaggcuaagagcaucuuguaauuauggaggcaauggaguaggaggcgaaccugaagccaguggcugcccccagagagcaguggucacuuguuacgcuuggggcagggggcagggagagccugucagucauaugcuccuugguggggagggccaggaaggagguugaaaccaauucccccacccccacccacaguccagcuguggggcugagagggagcuagcugugggguugcuuucagccaccugcuccccaucccgagggacgccaugggaguccuaauagagagaggaggaaaaccuugucaaauccauuaugcagcagcaauaaugccugcucccuccagacagcacuccacaguuuacacagcccuguccuguccacagugccaccuaaugcuccugccccuuuuacaagugaggaaacaggcuucaaaauguuaaugccugacccaaguuucaucaauuuaaauucaggucuccaggcucccaggaaauccucucuagggagcgcuuccuaguuugggggaauuccaggaugagcaagacagggucccuuguuuauaggaagauuacuaauucagaggaggcacccaggguugcaaaagacaggagacuggugggaaggugaguaaccaaggagggcuuccuucagaaggaggcaguauucacucauggcccugaaugaggagggaggugccaccgggcagagcagaggagaggaggugcgcuccagggcaugaagccugcagggugcaccguggcaguggagaguggagagagaaguggcagguggagacgccggauggucuaguggcuaauaccugggaucaacccccagcuccuucacucuccagcuguggaaccacaggcaaauaccuuaaccucucggccucauuuucuacauccacaaaaugggauucaucauaauagaaccugguucacagaauuauuacaaagacucaaagaguucauauacauacaguauuuaaauucucaccugcauauagcauucacaaaaugcuaauuauuauuauuagugcucauaguuagagcaaaccaauauggcuuagugcuccuuuguccuucugaugauugacuauuuugacugucuuccccaggcuccugguccccaccccacccccagggcaagcaagugccuucacagaccucuucagcaccuuccgcgcccgcccaucccacacuugcacucgauaccagucgguucagggaagaagggagcaagcuuggaaagauggugcagguugccauggcaaugaugggggaggagggguggaugcccagcagagccuggccaaggauucagggcagagaaagcucacuucauuaccauauuuuacuacacuggcccagucugccgacgguugcaccccagaagugccuugguaucagaggcgaguagauggagggcaggaguuggggaaaaggagacauugagaaggcuguuggcgagaagaaggccaaggucuguggaaaguagaaggaauagcugggaagcauccaguccuggacucagauucgaauccuggcuuugcuacauacuaccugugugaggcucuuuaagccucagugaccucaucugugaaaugguggugagaggggaagggacauuuacagcccuuuucucccucccuugcccacaacuacugugccccagcauggcacccgggucagccccugccagcucuggagcugucaucaucucucccucuuaugccucuucaguggacuguggccaggcuccccuggacccugucuaccugccggcagcccuggagcuccuagacgccccugaacacuuccgugugcagcaggugggccacuacccaccugccaacuccucucugagcucccgaucugagaccuuucugcuccuacagcccuggcccagggcccagccacuucuccgggccuccuacccaccuuuugccacucagcagguaaggagggggcaccggggacucucaggcuaacaggacucagggccugaggucugcuggguacaaauugggagccuuccccagccccggcugugcuccccauauuccagagggggaaacugaggcccauaaagguucucuucugccaagcugggaucccaucuuccuagaucuuccccucccaagcuccucuuuuguuaagcccucucauucucccuccaggugguccccccucgagucacugagccccaccaacggccagucccaugggacgugcgggccguuucaguggaagcggcugugacuccagcagagcccuacgcccggguucucuuccaccucaaagggcaggauuggccaccagggucuggcagccugcccugugcccggcuccaugccacacacccugccggcacugcucaccaagccugccgcuuccaggugaguagacaggccccaccuaggcugguccugcugcagcugcaucagccagguggugggcccgcggcagagaggaaacccccacuccugggaagcgcggggguuguggaccacccgacuccauuucugcccccacuagcuuucagugcugugaaaagguuauuuagggccccagagggaguucaguccuuggugugugacuuugaguaaguaacuuaaucucucugagauucaguuuccucaucugaagaaugggguguuaagaauuccuaccccaucuggaguuggaguaaggaacaagugagaugaauguaaggauagcuuacggcagaguaaucaaucagccaguguguuugcauuauuaguaguguuacuuuuauaauugcuauuuccacuauuuuggagucuagcacaggaauccaugggagaggcgucucuugagcuuuaggauucugagaagaagacuggauucuaggcaggauaguccugggcuugguuaggguaaggcccugggauuggcuuacuuuguaaugagaccuaucccaagggcugaagaguggucugcggacaugcucugaaaccuagaccugguuugaagccccagccagguugcugguuugcugugucacucaggcugugucuccggcccaugcugggccucccuuucaugagccccuccagcucuggguuuccugccaugggugcugagaauccuguuccucgcccugcacccacccccaugccaauuacugcugucgugucuucacagccaucccugggcgccugcgugguggagcuggagcuucccucgcacugguucucacaggccuccaccacacgggccgagcuggccuacacgcuugagccugcagcugagggcccugggggcuguggcuccggcgaggagaacgacccuggggagcaggcccucccagugggggguguggagcugcgcccagcagaccccccgcaguaccaggagguaccucuggacgaggcugugacucugcgggugccugacaugccagugcggcccggccagcucuuuagugcuacccuccugcuucggcacaacuucacagccagccuccugacccugcggugagcaccaggccacggggaugggugagggugggaaccucugugggaagacuagggacagguaccugcuccuccugggguccuugcuggaauccuugaccucugcaaaacauguguccaccaaacuaaacuccuuccagguaaaaagccaugacugugcugguaggagcccaccaugggcacagcccuggaauuagagucagaaguaggaagcugccccuuccccuggcaccucccugagauuccuuuguccaauggggcuaacgguccaccuucagggcagcugcaagucuccagggaggggaacccgcaaagggcuuagagacugcaguaccuaagugugagcucuugcuccagugcuccagagagggauauuugccccaaucacguucaccuacaugcugucccuccuugccacccucgccguaggagucuagccuuuggacagagcuugcucuuccccauaggaaggcccugauucuuuguguccuuuuccguaauaaguucccccaaagcagcccccacccaccuacccaguucacccggcaagggcuugcagaguaugacuugcuucuggaguccagcgcaggaauccaugggagaggcaucucuuaggcuuuaagauucugagaagccugaguucuaggcaggauaguccugggcuugguuagggugaggcacugggacuugcucacuuuguaaugauaucuuuccugaggaucgaagagcggucuguggacaugcuuugaaaccuagaccuaguuucaagcccugccuggguuugugcaugucccgucucugugucuccccaucuccuacgcccuccuaugcucacucuuauuaagcagaucuuuccuagacacuuacagccugccaagcccugugucuucacucugcagauccaaacacgagcaagggccagucccuaucuggcagaaaggggccccagugguagggaagggagcuggaugggcaugaauuggauuagaaggcauguggguguguaagcacugagggagguucaaagugcggugggagcucaggugagugggugcaguaagggggaaauucaucccaccacuggaaaagcuuucuaaaggaaauggucugugaguuguuggaggcuuaaagcaucagcagguaaaguaagaaagggcagagcaggcugaaggcacagacugggcaaaggcuuggagucacgaaugggugccgugugugugggaaacuuguguguagcugaagcagagagugcauggagagaugucacaaccgaaguuaaggcuggaccagacccuggagggcccccaaaugcccggcuaagcuuugaccuuaugggcaguggggaggcguaaguggucuuugggugggggagagcuguaaggugugagcugcacugaggcgggguccuucuggguuggaggauggugaagaggagauucagacuggagccagggaggucagauggcuuuggcuccuugucuuuccccuucaauccagcccacaguucagcaugcaccuugccaaacugagccuauacucucuuccccaggaucaaggugaagaaggggcugcaugugacagccgcccgcccagcccagcccacacucuggacugccaagcuggaccgcuucaagggcuccaggcaccacaccacccucaucaccugccaccgugcugggcucacagagccagauuccaggugggcaguuucccuccacccagggggcaaaggagggagggcugguuauagagugcaguugagcagauuuggaggcugccaugcugccucuagauccccaggugagcagacccaaggacagauuuuuucaaggaagcagcacaaagcaggcauaauccauuccuucauucauucauucggccacuaucuucccagccccagccaugugccaggcauagcaagugucugugagucuuauucuaagagaugccaaccaauccugugccccagguagagcccucauagccacuacuccaucccccugcuuccaccaaaugauccuuucucugggccguucacauucccccaaaaagcccagcugcaguucugcgguugugaacucuucuuauucaugcccugagccugggucaaggccauggacucaguagccccaguucgaauucugguucugaugcuuuugggaugggcaaaaccuugggcaagccaguuaacauuccccuacccaagccucaguuucuucacuugugaaauaggaauaauaaugcaucccuuagcauuuuugaaaauaaaauacagugcuacauaucaggcacccaggacgguucccagcacauagguuuuuguuugaucaaaggaagcuuaucauucagagggucaagugucugguccugggaccuggaagugaaucucccgcaugccaccucaguggcuguggaaagcggaagucugggggaagcgggcccgggcaggcaggggagugagccaccuugccaggugggaggugguuaaauggcuucauggaucuuagagaggccaagagugggucagaguuuggggucuagagcgaggaugcuuggguuuagaucccagccccgcuacuuuuugcuguguggucuuaagugagcuauguaaccucugugccucaguuuccuccuguguaaaauggggauaaucaugaaugcaggaagugcugaggccaugccuggcagcuagcaagcauuuggcuucucugucuccuuuggccagcaguccccuugaacugucugaguuccuauggguggacuuugugguggagaauagcacuggugggggcguagcggucacucgccccgucacguggcagcuggaguacccaggccaggccccugaagcagagaaggacaaaauggugugggaaauccuggugucugagcgggacaucagagcccuuaucccacuggccaagguaaggagaccuccaucucugccugggaaggcuggaggccaagucccaggagccccaugagcugaggggccuggggcugagccccuccuccacccccaggcugaggagcuggugaauacagcaccacugacuggagugccccagcauguccccgugcgccuugucacuguggacggcgggggggccuugguggaggugacagagcaugucggcugcgagucugccaacacacagguccugcaggugaguggcaggugcccagcucaugugagucugcauuugugugggcacaguuacgcacacacaccuuuccuccuuccucauguggguccccaagagaacagcuucuucuugagacgagaaaccucaugggaggaaccacagcuucaacuucuuuuguuccagccaccucucucccgagucaaguaacccuaacagccccccgaccuuagacacuuucacgcucauuauugcacuggcaagugcgcuggccugagagagucgagagcacauacucugggaucagaaaguuuuaguuugaaacacaucuuuguugucaaccagcuuugugaucaugggcuggucucuuaaccucucugagccucguuaccuaaacuuuaaaaugagaacauaucuucggguuguuguaagaauuaaaagcacuuuaagacaguauuuagcagauagcaggggcugaaacaauggcaguuauugcuguuauaauaugauguaauaauuauacaaugguaaaaauuauuauuauuauuauuaccggugauugugaagugaaauaaaagggagggugguagagcaacuuccucuaucuugaaguucuaagaggggaagcauggagucugcauguaugcaaaucccagccaccugaagggggaaggugccuuuccccacuugugguccuuugcucaaaugugugugguuccugcuggagggccuuggugggagaucugcuuugucccaccucugccuaccuggcuguagcugguugccagguggcuccaagagcaaugucaaaggccagcaugaauaaggagccaaaguuuuggguucacaccccugcucugccaggaggaagacugguaugcaauggccaguuccccugacugagccccagggaaccucaaggaauggccccuacaguaaaaucuuaaacaaagaacaggggcuuaaccaacaauccugcugcaacaugcauuccagugacacacagagcugaacucagugggagcccguccuacggccugaggucagggcugcucucuucuggcccaugccuuuuuuuuuuuuuuaaucuauuuauuuugaaacagagucucacucuguccccaggcuggagugcaaugguacaguccggcucacugcagucucagcuacccaggcucaagggauccucccaccucagccuccccaguagcuaggacuacaggcaugugccaccacacccggcugauuuauuguauuuuuuguagagagggaguuuugccauguugcccaggcuggucucaaacuccuggacucaagcgauccacccaccucggccucucagagugcugggacuacaggcaugagccacccacccggcccagccucacaccugucuuuaguggcuuagcccgcccaccugcccucugcccuuccauaggugucugaggccugugaugccguguucguggcuggcaaggagagccggggcgcccggggggugcgaguggacuucugguggcgccggcuccgcgccucgcugcggcugaccgugugggccccccugcuaccgcugcguaucgagcucaccgacaccacccucgagcagguccgcggcuggaggguaccuggcccugcugaagggugaguggaggccugaggaagcuggcaggccuuggcgagucacacugggacggagagggcgcaggggacacagccaugggcccaagucggggucagaaaaacugcccuguugcuugcaguuccuucugcccaccuccacccugggccgcccagccaaugaucgcuuucugugaaauugcugacuuccgcaucccucuccuccuucccugccucacuucucccguagcacccuccacuuccuaaucuacgucaguacugguuaauguugccuguccauccuuuccacgcuccucccccgagaaugucagccccuugaagcugcggucugucuaugcuggucguacccucagagccuaagaugacacagagcucaggaaaugaacacccucggagggggcuccccaaaacccagggagagguggcccacgccucuggaaucuagcuuccaggcccuucagagagugagcgcccccaggguccccguaagagagcgucuccccugcgguccacuugggagcaagagcggugaucgaggcacagcgccagucgggagugggcuggggcggcucgccugcagguggaagggccugaccccaagaggggcggaugucugcguuugagaaacaggagcugcuggugauuaggagccgccggggacgagcugcgggucuccagcagcugggcccugggcaggcuggggccgcucagcgcugacggccagucccggccuccccgcccugcaggccugcggaacccgcugcagaggcgucggaugaggccgagcggcgcgcccguggcugccaccugcaguaccagcgggccggugugcgcuuccucgcccccuucgcggcccacccgcuggacggcggccgccgccucacgcaccugcuuggccccgacuggcugcuagacgugucccaccucguggcgccacacgcccgcgugcuggacucgcguguagccucucuggaggguggccgugucguggugggccgggagcccggugucaccuccauugagguaagcagcuggggaccaggagaguagacccccugagaaggguggaggggcccccaaaauguucgugggugggagugaagagugugccaggagcccagagugugugggggaguugugcggucuaggucugagugcagugggauuggggauaggcucagaaugggguggccgcauaaggggggaagcccucuagcuaugaagggcugagguguggguaguguggggaccgggucuugagggaaaagggaacugcccccuaggugugggauugggguccagguaugcaccggggugcaaagaguagagggauaguagcccaugagccugcugggaguacccgguucccucugggugggggcuguccguggcgaagaccucccccaccuccggagggcagcccgugagggugcugggagcacccgguucccucugggugggggcugucuguauggaaggccccccaccuccagcuccuuuccacccucaggugcguuccccacugucugacuccauccugggggagcaggcgcuggcugugacggacgacaaggucucagugcuggagcugagggugcagccagugaugggcaucucgcugaccuugagccggggcacugcccaccccggggaggucacagcuacgugcugggcacagucagcccuucccgccccaaagcaggugacaguuggggggucagggggaugaggucaacaucuccagaugggggcucaugguagaggggaaugggaggaagggacccugguaccucgaccccuuaggguuuucagagugaggacugacucugugagguagugagcucucugcagcuggaggugaucaagcaguggcuggaguauggcagugggagguugguuagauggcucuaacugaggacccucccaauaacucagacccuagggcugaguggcagacaggugauugacacgcguccccucucucccuguguuuugucuaucugccugugucucuguuuucucucuggucucuccuccauguggccuaucucugugggagugguuucucugugcaugcgugcgugcccucgcaugucucugccugugucugugugccccacaggagguggcccucucccuauggcuguccuucucugaucacacuguggccccagcugagcucuacgaccgccgugaccugggacuguccgucucagccgaggagccuggugccauccugccagcugaggagcagggugcccagcucggggugguggugaguggggcaggcgccgaggggcugccgcugcauguggcucugcacccgcccgagcccugccgccggggccgccaccgugugccucuggccucuggcaccgccuggcuggggcugcccccugccuccacuccagccccugcucucccauccagcccugcuuggagcccaccagccacagaagccaccaugggugguaaacggcagguggcaggcagugucgggggcaacacaggugugaggggcaaguuugagcgggcagaggaggaggccaggaaggaggagaccgaagccagggaggaggaggaggaagaggaggaggagauggucccugccccucagcaugucacugagcuagagcugggcauguacgcccugcugggagucuucugcguggccaucuucaucuucuuggucaaugguguggucuucguccugcgcuaucagcgcaaagaaccucccgacagugccacugaccccaccuccccccagccccacaacugggucuggcugggcacugaccaggaggaacugagccgccagcuggaccggcaguccccuggcccgcccaagggggaggggagcugccccugugagagugggggaggaggggaggccccuacccuggccccuggcccuccugggggcaccaccagcuccucaagcacccuggcccgaaaggaggcuggggggcggcggaagcgaguagaguuugugacauuugcgccagccccuccagcccagucaccugaggagccuguaggggccccugcugugcaguccauccuuguggcaggcgaggaggacauccgcugggugugugaggacauggggcugaaggacccugaggagcuucgcaacuacauggagaggauccggggcagcuccugacccuccacagccaccuggucagccaccagcuggggcaacgaggguggaggucccacugagccucucgccugcccccgccacucgucuggugcuuguugauccaaguccccugccuggucccccacaaggacucccauccaggcccccucugcccugccccuugucauggaccauggucgugaggaagggcucaugccccuuauuuaugggaaccauuucauucuaacagaauaaaccgagaaggaaaccagag

SEQ ID NO: 18758 - RNA, 9550 nt, Homo sapiens
aggaggauuagcuuccacuccgauuucaaagauccaguuuacccacucuacagcccagauauagucacuuauuuccccuuuccagccagagacuuccguucccugcuggaacuuccgaucccauucuucucucggugggaaugcuuguggggggaaaaagaaacgcaauagauaaagcggggcgcaugcgcucccggcacaggcuucgauugugaggaaggccggcuagucuccgagcucaucccgccuugcgcaugcggagaagguaaaccagcgccccgaguugaggcgcggguuugguggcgcguuucagcgaagucgcacgugaaggauagcaguggccugagaaaggugagagcgggccgaggucggaauguggggcagcgcacgggaaggggagacagcagccgcugcaggcggcaccaggcggagccgcgaggccuggagaguccgaguggggagggguccgcgcgcccagcgugcgaaacaaaccggggacccggauccccguugcuaugcaaccgggggcgucguuuccaggcaacccgggaggcgcacguuuccggggagaagaggguugcggcgagguuccgagguccggcagagguggagcggcucccgggcguggggaccaggccagcgccaagcccgagcccccgaaccccgacccacggcccagccuccugcagccucggcucgagcccuucggggggccccaaacucaugggucgcgccacguuccuugccagcgacgcuaccccucagcgcuuggcaggggacgcgccguucgaaauagcacaugccacugacacccugucuccgggaggcugcgccccgguuagggcgcggagcggcagggaagcugccccuuugccgucgcccugcccccaaacaguugcugggcagcagcugucagggguuuagugggagcugcccccaaccugccagggcgcugacuucauucucugcaguggcggcuucgccuuguuuaggaccuuccuuuagacucagcugugcuucucguguggcugcuguauauuuggaucuacuauuaaaauaaccucccuccucaccucuccauggcuuucucguucgacccucacgguuucuuggcagguugcuaauauucauuuaauaaacauuuauuagucaucuuuccuacuaggcgcuggggauuccaacaugucaagucuaaccgggagucgcucggucuacuggggaaggcagguugauaaacugcuaaauuaugcuacgauauauagucagugguaaugugugugcugcaacauuucuauagauguuuaguuuacaaagcgcuugcugcagaaauaucuuaacuccuuacagcaacucuucaccuggguucacucccuuuuacguuugaggagacugcaacucaggcagguuaaguaacaggcguaagguaguagcuucuaguccguggcacacuugagccugggacggaagucagggguccuuuguacacugcugcacuuuugaagcuuugcuuagacuuuucccugagcugcuggcuaugcauccgaaauuccugaggagcuuugcaaaacaaagggcugagucccucucuggaagagucugagugaguagcccuggguggggcagacguccuuguuuaacaggcugcacaggcaguuccgaugggcagccaaaguugagaaccgccgcuccuuaggggcagcuaugagcagcggcgggacagucagagccgguagagggcacuuuuugccgccccuccugccaccuggugauucauagcaugaaaugaaacuaacaaaaggaaagagaagaggaggaaggagccuugauugggaggggggggcgcgaaaugccccauccuacccuuguagcaaaccacagcuaaacauaagcaguggcgccuucucacuaacacaauaaguaaagcuguuuccccagccaggcugggcucuccagacccaccugagccauauugcagcugccgaacagaaguggcagguuuugucucccaccuuuugcuguccucucauaccucuugguacaaaaccauggccuguaagcccagaaggcagauggucuccugguauguguucccucggaggagucuggauguccuuccacuuugagcuuguuggugaacuucagcuccaugagggcagggacuauguccacuaucaaggcagcaugcggguaugggacaagcaaaaaggcaagauugagauccuggguacuggagucaagucccagcucugcugugugaucuuggauaagucacucaaccucucuaagccauacuuuucugaguaagaugaagaggguaauaauaccuuaaaagauuguuguuagaguuaaaugaagugaugaaacaauaagcacucugugaauuauaaagcaccacacaaaaauuauuauaacauauguauauguauagauauguauaacauuuguauuauuaugaguuguuaauugagugccuauuauuugucugaggccaggcauugcagaaggugaagaaguuuuaagacaugcuuccuccucucagaggcugagacuguuuccaugccuuuaguaaaacuauuugauuaggccaaagugaggaggccuaauagcagugaguccauacugccugagauucaccuggaaaaaaaugagaaggaauccuauuaaagaaaacaauuugaaaaagcagaccagccagccaaucucugcacucauuaucuccaaaggauacacuacacaauccuguuagguuugguaucuggugcacuucagaacaucagucugcauaacgaugccagccucacugcagagggcuuauuucaaggucuccuagcuccccuuaacuggggcagacagccacuggagaguuggggcuggcacagaacaaggcaggcugcugugggaggagcagcuuauggcacccugaccuccuagggcugaggaaacgauauuugaucccuccugguggagguccuuggauaaaggauccaacccaagauagcaacccugcucuuuuaaguccccaacaugguuaugacccagauagcucaggaacucaccugugcuuuccucaucugcgaccacuggcaggcaggaaccaucugguucuugauuugugccaaagacaguagaaggcuuucccagccugagggccuucuacaugaauugcauguuuuucagccuugcuugacccuccaggcuucuggaagggcuuagagcagcuguuucuggaccaaaaaguacccuaaauguaguauuuuuagaacccuuuccuagacucuccuccuucccccuaagcaagacuaggacaucauucucuuccuucuccaucccucauggcucuggauuuauugucaacucccugagugccuguguaacugcaaaaaguucaaaaaccugacugcuccuaccucaggggcauggcuuagccucugaucaucaggucugaaucaugaaaacuccuggagcuacagguucauuucugaaccuggaggggaacagggaauuugcuggcgcugucugacauuucucaagcacaguggcaaguagaaguugaacuuguguacuuuuucuuggcugauccuuaccugcuucaaugaguuggcacuuguugggucuuaacuugucuguggcauuguguuacaagaccagagcacaaagcacaaaguuguuagguaauuuucaccaguaauucacugagaugauugguagaugccaaguuuauuuuaacucaugaauaaucuguugugugacuuuuuuuuuuaagcgucuugcucucuugcccaggaugggauacaguggcaugaucauagcucacugcagccgugaccuccugggcucaagugauccuccccccucagccucccaaauagcugggaguacaggcacgcaccaccacaccugacuaauuuauuuauuuauauuuauuuuguagagacagggucuccuauguugcccaggcugcucccaaacuccugggcucaagcaauccucccaccucagccucccaaaguguugggauuacaggaaugagccacugugccuggccuguaugacuuucuaaaucacuucugagacuuaguuggagacaauacagcagaguuguuguguaugagggguccaaugucagaaguaccuacauucaaaugcugauuuccccaguuaauacuuaaccugccucaauuacuucaguaaaaugggggauaauagcaacaccuacccgaugggcuguugugacaguuaaaugagcgcgguggugcauggcaagaccuagcugaauguuagcuuuuuauuaauaguauuucuuuaaagguuguucauuauacccuugcucacuguccucguccauuuucugcuuccuauaacagaaugccacugccugcguaguuuauaaugaacagaaauucauuagggucacaguuccagaggcugggaagucuaagggcauggcgcuggcaucuggcaagggucauccuauggcagaaggcagaacccagcacaugagacagagacaggaaaucaggccaaagucauccuuuuuaucaggagcugcauuccugggauaacuaauccacucccaagauaacggcauuaauccauucaugagggcugaacccucauaaccuaaucaccucuuaaaggucccaccuuuuaauaccaucaucauggcaauuaaauuucuuucuuuuuuuuuuuuuuuugguggagaaggggucaaacuauuuuacugaggggaauggggugucaaagaaguacuuaggaccaugagauccaacauccuuggcuggacugggagcucccaggcucugcaggaggugcaagaacaguuaaauuucaacaugaguuuugcucuucaaaccauagcaccuccauuggggguggggaggugaggucacucuguaucagugguucucaacuucaugcaguggaacugccuagggagcuuuugcagauccaaggcuaggccacacccagacaaugauaucagaaccucugggcuggggacacagacaucaguacuugggaagcuuccaggugauuccagugagcagccaugguugagacccacaguauaacuugacuccuaaugaagauggguggaagcagaagcuuggguucaaauccuggccuuucuguguagcccagugaccaugggaaaaugcuuaacuucugagucacaguuucuucucgucuguaccaguaggggcgaggaggauaaaagccaccucacaugaugguccugcagagaagaugacauaugugcaguuauucuuguuugagcacauaacugagcacuuuucuuuauaccauuauauggcaguaauccuacuugugugcuauuuuuaaguuguuuuuuauaccagcuguaucuuaaguagauuauaagcuccuugggacagagccuuuauagagucuuauaauacuuuuaugccuauagcaccuaagauacagggacaggccuucagauuuuuagaacuggcacaaaccuuagagagaucuucucgccaacucuaaaguguugaauaauacuugcugguuaauuaauaugcaagugguaaagaaugugaaagaggaaccugugagucagaugguugugcccagcuucaguuggaagucccaguccuuccucucccagcuaacagcacuuucuuuccaggguuaguuuggugcuugcuugggguagggguggagaaggauguugggauaaucagagcugagagggugagugugucuaccauggcacucagcucacugugcuucucuccuggcagacccagucauggcagccuccagcaucaguucaccauggggaaagcauguguucaaagccauucugaugguccuaguggcccuuauccuccuccacucagcauuggcccagucccgucgagacuuugcaccaccaggccaacagaagagagaagccccaguugaugucuugacccagauaggucgaucugugcgagggacacuggaugccuggauugggccagagaccaugcaccuggugucagagguaaggaagguagucccugugugacuacacacauuaaggaaaaauaaaagaagaaagguugguaauggccaccucaucuuaguuccacauccucucuggugcagagagccccaaauuccacaaaaagaagccacacagcacuugucuuugaauuccucguuauuugauugcuguccuagggccuuuuagcuccaccccuauccuuuccuggcuccugcccuuuccuugccagaaaggcugggaaaugagccaucuuuauaagcccauguuacugggugacuguagagucucacuuuggucuaaaucugaccuagaaucucgaaauggcaaaauaucaaguccugaauccauuccuucaccugcagaaguggguugagcuuauugggagccuaaggcaggguuaucuuuuuuuaccugguggcaucccaagcaugguaucacauacuuuugauaggcuggacugaagggcugagacaaucauuuauuaaauccauaauauaguauagcugauagacuccuuuuucacuggaacauccuaucccuuuacagauguucuccacgcaccuucaugacucccuggacagcuagcaggccuccaguuuuauagggugacuacuaaaaguauuugauugucuccgucauucacacacaaguacaccuacuacucccuccaaaguaucccagcaaagcaguuaaauuaugucccagaugcccuaguuuccaguucaggaaggagagacagccuguuggccaucccuguagacuagaagguggauguggaagggaccccucagccaggcccaaggccccuacccucugacccaggccugucaccacugggugagaaacaggucugagacauuccugcaguucuugccuggacaguggugaucaggcgugaaggcgaggaccguuguucauuaugaacucaucucgcuccgugcucuuuccacagucuucgucccaaguguugugggccaucucaucagccauuucuguggccuucuuugcucugucugggaucgccgcacagcugcugaaugccuugggacuagcuggugaguguucgagugcuggguagucagccagagcuuugccuguacuuuccuacuugugggaguucaucuuugucagggucuagccuuuuccccaagcugcuuaacccuucccaggauucugcagagacauggccaaagagcaagccaagaacuaccauggccaggugugguggcucccgccuguaaucccagcacuuugggaggucaaggcaggagggucacuugaggccagaaguuugagaccagccugggcaauauaaugagaccucgucucuauaaaaaauuagccaagcaugguggcgugugucuguugucccagcuacuugggagcugaggugggaggaucgcuugagcccaggagguagagguugcagugagccgggaucacgucacugcacuccagccucggcgauggagcaaaacccugucccacccagacccccuaaaaaagaacuuccgccaccacgugccaguuguucacuuccuaucaggcaucgugcugagcuguaguaucucauuuaauugccagccacaguacagggaggcaguagaauuguucccguuuaguaaaugaaacugcagcucaacagaagcaaguaaucuacuccaggccucacagccagcaagaaacagagcugagauuccaacccauaucacucugagucugcgagaacggcuuauuccuuugcaaugugccuagcaccucccacccuuuuagcucuugccccgcucuccccucaccacuucuccagguuggcugacucugugacucucuuggcuuccaggugauuaccucgcccagggccugaagcucagcccuggccagguccagaccuuccugcuguggggagcaggggcccuggucgucuacuggcugcugucucugcuccucggcuuggucuuggccuugcuggggcggauccuguggggccugaagcuugucaucuuccuggccggcuucguggcccugaugaggucggugccugacccuuccacccgggcccugcuacuccuggccuugcugauccucuacgcccugcugagccggcucacuggcucccgagccucuggggcccaacucgaggccaaggugcgagggcuggaacgccagguggaggagcugcgcuggcgccagaggcgagcggccaagggggcccgcaguguggaggaggagugagccggaugccccacacaccgccagugucauaccaaagagcugagcugcuucggggccaugcagcccuccugccagcccccugcccuuuucuugcccugucucugaaccuucagaacauugauccuugccgcagccccacuagccaagagaaacagagaaagaccauucccccugccuguccuugcggcccugucuucugagguucucugucugggguuggcucucuuaacccuuucucugcucccagccugccucaccagggaagguuggaggggccucccucuggcuucugcaucugcgccagcaaacaucacugccguuggucucucaugacuuaacuggcuucccucugcugcugccuuggcuuccuccuaaugcucgugcucuccuguccuucugaaguugcuccuuggccaaaucuccagcucccuucuuguuuuccucauccuccuacccuguacucccaccaaaccaugguccuuuaaggcacgcuccuguccuccucauugcccagcaguagggaggggcagggguaaggggaccugaggauaaaggguggggaaacaggguccccugaggccugugggggcugcaggggaggaggauguaccuugugucucuuucaagugccuuaauccgagccagcagggccuucugcuugccugcugccauacuguauguaggaaaguguucuguggcugcuuugugucaagaaaagagcagucacucucagaaucuugauuccccaucagccaaagcaaaagauggcugcugcuuuguaggcaugugccugcaagugggaccuugcugggcauuauaugcccuguggggguuucagagacccugaaagaggagggaggacccgccuccuugucugcacaacugcaugcacuucucuccccaucgcuccacaaccugaaaccgagaaggaguugcugaccagugcccaccccggcagcccgggaggaacacaggcagcuccuuucccuucacguggucugcagagagcagggugagcugccagcugccccucuccaccaggguacccugucuuggugguuaggggccacuuuuccuuugaggcucuaguggagguggauguccuucucugccaggcuuggcacaugaugugaagaauaaaugcccaauucuuacuguucagguuugauguggaaucacagcugcagugauauauauuuuuuaucagugcuugguugguuuuaaauaaagugcacgcuauuuuauuaucuuguucugaauaaaauguauuuacuccaagucuggauugcuuccaugucuccu

SEQ ID NO: 18759 - RNA, 10342 nt, Homo sapiens
uaaagcagugcuucucaaaccuugaugugccugugaaucaccuaggggucuuguuaagugcagucugauccaggaggccggggccggguacugagagucugcacuuaacaagcucccaggccgagaagccagugcggcagguucacaggcgaggccuggaguaacacaaagugaaacucauaauagacuucccacucuagggcaguggagucggaagggcacacggggugcgucuccccggaguucaguuuuaccagaugaugggggaggggggaaggaguuuuauguuaaaccauccauguauuuuuggagaagagagaggaaagguuugagaagcacuguuccagccugcccucuucauuuagccaaugcuuacugcgcuagacgcuucaucccacaaucuuaaggggcagcuucuauuagccagucuuuacagcugagcacauucuggcucagggagguuaagugacuugcccaguuucagggcuaacgaccacagggucugcacucuaacccuaggcaucacaugcucaaugacucucuggugagcgaggacauucucugaccuacucgagggacuuaagaugcuaccuugugacccagcacugcccaaagugcuuccaaggcagaagcagcaggggauggcguggucaagcacucgggaaaccuggggcuaaucaaauccaaugggggaaaugacuaaaagucuucggucguuagaaguugaaugggcacagcaacucuaagacuacagcacacgucauuucuuagcuaagcggaccagccucccugucggccugguguucugugggaucccucugggcacugguaaucccaagaucugugcagccccgccuccaggccacauggggcugggcagcuaccauuucccuuuugcggaugggagggguaacuugcaccucugaccuaucacuuccacugcaccccgucucauuccuccaccugccguggacuuggggucagagacugcuguguuugagcucugcagcccagggaccgaaaaguuggugucaaugaauuuugcuugguggaugaaaugucaguggaagaagcagaugagaaacucuugagaucuugguccuguguuuuuucugccaccaaaggccagggucacugaaggccuggcccacagcaggugcugagcaaagggaacagugaggugcccagcuagcugcagagccacccuguguugacaccucgccccugcucccucccaucccuucccccuuuacucauagcacuucccccauuggacacguggugcauuuugcuuguuuauuauguuuucucuccaucagaaugaaagcuccucgagggcagggacuuuggucuauugucuguauuugccggugccuaggauugugccuguaugcaacaggcacucaauaaauauuuuugcuguagacuggacaggcaugaguuagauucucuggggcuucugcagagacugguuugggaaagugggugcuagggaaaagcucugcucccugcaaccuccccauuuuaaucuuucaguauugaaaaguggagaggaaccggauucagucugcuggggacagaggcagugggguguggaggugcucagagcagccuuugggaaggugugggggaagcuggauucccaacugucagccuccaggccugggauggaccuaggaugcugagaaagggcauacacugcugagggagucaccugccagucaccagcucacugaggaaccagaagaauguacaguucuugguuugaaggcacuuggagaaggagaggaaggagggaugggagcugaaucucuucccgcccccaucucugccaggucccaggcccccucugggcuucugucccacacagaccugccuggaagccuucaaaggccgaggagccccggucggggugggggucccuguucuggagccauggguuuggagugccagcuccagcagaggcaucugagcagcggccugaggugcugugucugacaugguuguuggccauggaaggccucgggccguccugagcucagaucuuggcugccggcugcuggggcggcugcuucugcagcagggccagggugucccgcuucucaauggagcgcagcugcuucuucuuugcccgcuugagcuuggcgggguuucggaucugggggugguaugaggggaggacauuagugcagcugcagccucgguccaaauucccaggggagaggaaggccgccccacaggggccugagaucguagcaugagaguggggguacaugaggcaggggucgaggcccugguuugcacccccaaguggggcagaagggcagagggggaaaacgagacacucaccacuuggacgaccucugccuuccgcucauucuccaggcggcguuucagguucucagcccggcgcuguuucuucuccuggaacaugugggagaaggggauuugagucggggagcagaggcagcccuggucucucaggccccagaagagugcgagcgggcagaauucccaggaggaaggggaaaggcccucucugccaggcuccagguuggugauguguggguggagggcuagcaauccugugccacggucuagugccaggggccugcugugguggaagcuccugauagcauguugagagguggguaugggacaggcaacugaggacaggggcugagacacugggggugcccaccuggagauucacgcacaugcagacagugaccccucaugccacccucaucaacugccaagggagaaaggggugcuggcccuucccccauucccacccucuccgacagucucccccucuuccccuggaguccugcugcugcagaaugccaggcuaggggugagggcugggucccugagauuuucacagguguggggcugggcaggggcugcacugcacagaaaaggcucuggagcuaucugggcuggguuucaaucuggauccuguuauuuccuaaacaggagaccuuagcuaagucugugccucagcuucuucaucuuuaaagugacagugaccacaguaucuaccucguaagauaguuuugggaaaucaaugagggaaugcacgugcaggacuuggagcagccccuagcuccuugggcacacugagacucuagauggagucugucuugggaggggaagcccagugcucucuagccaugcugacugugucccucagcaaggccaggguggggacgucagcuccaaggcugcugcaugguuaggagucucugcuggcuuuggugacuugggguagcagggguggcccaggccccuggggaggaaggagaagugagccuuggccuccuguggucagggcaggcccgggcugggggcugggcaggagcaccuccgcaguggacggugagaagugagacggcagcucugucuugcccaagagggagccagggccacacaggaaaagagauaaggccucagcauaugguggcggacacacuguuccucagaugucagcuguaagcugagcuggggugacuuagagcaggggacagaugacugagugacuggcccaccccuuuucucaguggccagccugggaccacggacuauggaugaguugucugaaucccguucggcacuccuccuacacgccugggucauuagaggaguggaggaggaaucucccacugacugcccugcccuggggggcaggagcugaccaaugccacuccgcuuucucugcaugcugccugcugagugcccucuuccccccgcuuaaaagucccuggcagaugugggugaggcugugacccuuuacaggggcuuccuggcucugggaugggugacaggggacagaaguggaggaaaggugcgggggccauccacguugcuggugugugggcugcuucuuggagaaugacagcagccauaccggggacauggaguucaaaucugcaagcccuucccaacugaguacgucccagcaaagggcccucgaccccaucucacugacugcccuaccacccaggacuuccucccgggcuucuccccaaggcccgcuucugguccucccccuccgucccugucccugaggcucuuucagcagcccaggcuaaacuguaugguccccugggccucccugcccuguagucccagauugcacuucugcuucuggccaggugcccuuccucccuccggccuucagauucaagaacguuuuuuaaccaagucggccucccccaggcacccguggaggcccucgccucaggucuguaccaguagacacuagcuuaguccucugagccccagccucagccuggcuggccccucaccuggcggcgccucuccuucuccuccuccaggugacgggcaaaguccuuggccagcuuccucuccugucguuccuucaucuuccgcugccacgaugugcgcaggggcuuguccugaagcaucugggagaaucugaaagggggagagugggugcauacagggucuguggggcaagcgccacccaugcccugucuccucucggccggaggcucuggaccuucuuccccagagcccaggcagaaccaccuccuugcuggccugacaggcggccuuccagggcugcagaaacuuggggcgggagggaacccugaucgugcuggcugccauuucucaagccuuggcuacaugccucugagguggguacuccuauccucuccacuuacagaggagcaggccaaggcgcggagagguuaaauagcugccuaaagauaccuuguggcagucaggacuugaauccugucagcgacugcagaguccaggcuacgcggccccugcuguaaaguucuguugcuuccgccaagugcauuuggcccgggugugaaugccucuggaggcggggcgcucacccccuagggagguggcccauuccauuucagaacagugugagugguuaaaguucuggguaaugauucaggaucuuccccgccaagaccggaugcaguggucaugcuuguaaucccagcacuuugggaggccaaggugggcagaccacgugaguccaggaguuggagaccagccgggcaaacauggcaaaaccuacuaagccuacuaaaaccuacuaaaguuucuacuaaaaauacaaaaauuagcugggugugaugguguaugccuauagucccagcuacuugggaggcugagguacaacaauugcuugaaccugggagguggagguugcagugagccgagaucgcgccacugcacuccagccugggugacagagcaagacucugucucaaaaaaaaaaaagaaaaaagaaaaaagaaaaagaaucucuucccccaguuggagaugaagugggcaucagggcucucagggaaaucugaaaagagcaacgaugauuuuagaguuacaggagaacugagcucaucucuguaaaaaugcauacuacaaggauuuaugaaugggaugauaugucuaggauguacuuuaaaauauuucagggaaaaaaaaaugccaaagaucagccgggcgcaguggcucacgccuguaaucccagcacuuugggaggcugaggugggccgaucaccuaaggucgggaguucgagaccagcuugaccaacauggagaaacccugucucuacuaaaaauacaaaauuagcugggugugguggcacacaccuguaaucccagcuacuugggaggcugaggcaggagaaucgcuugaacccaggaggcggagguugcggugagccgagauugcuccauugcacucuggccugggcaacaagaaugaaacuccgucucaaaacaaaaaaaaagaaaaaaagaaaaaaaagccaaguaucaaagaugaagcuacacuaguaaaaugcugagcuguguugaugcugauaauggggacuugagagcuuugcucuuucuuuguaugcuugaaaauuuccauucaaaaaaaguaaaaacaaaaugcaaagaagucucucgguggccuccacaugcugaaauuaggucuuucucuuuuaaagauucaaggcccauuuuggugucccuuggcccugccgacuucuggccccagcucccugauuuccuucuccccuucccaaggccuugccacugaaggccuggccuccuaagcacuaagaauggggugccacauggacuucccccauaacuguaaagcugggcuucccaagcugggguacgagaacccugaagggacaagguguugggagccuagagacacacagaaccacaagacacagugcugcaucuguguagagcagggcugucaaacagaacguucugugaugguggaaacauuccacauugacacuguccaauaagguagccacuagucauggguggcugcugagcgcuagaaaugugguugguguugauagagaaacugaaucuuaaauuuuauuuaauuuuaauuaauuuaaauguacauagccacauguggcuggcggcuaagguacugaggcagggcaguuccagaccauugguucuaccuggguauugaggaaacucaggccuggguuccaaguccaaccugggugaccuggagcaagguagccucucuaagucucagcauccuguccaguggagaugagaaucauuccuaacccaaaggguggugggagauuuaaucgacacacacacguaauaggugcuccauaaaugcuacuccucagagaaggcagacagcaugcccaagggcacuauggagaaaguggcguuuggcaugagcacgaagacagggcugcagccaggucucccucaccacauacacuuucccagcugcggcugucuuccucccugcagcaggagcugcuucccacccaucuccaggcucacuuacuacccaccgaagcugcucccucaaagaucccaaacauccauucaguggcccugcugggccccucgccacagacuugccugcagcuucggaagcuguuuuaguucucuugagacagccuccuuguggguuuuccugccuucaccccugcccgccuaugucuguguucaguagccaggcugaucucacaagucaggucauuucauuccuuugcuugacacccuuccauggcucccaagcucacucaggaaagccgggagucccuguaagggucaccagguccugcugucucucugaccucaucuccuacuguuccccuucucccccucauuccagcagcgagaccucuggaaagccucucaaacgggagcuugcucccgccucaauaccucugaacaucccuuuccuguugccuggauacuguuuccccagaucucugcccggcucccucugcucagaccuguuuaucugcaaggccaucucugagcacuguggcaauacccugcccucccuguuauucucugguccccauccugguuuauuuuucuuugaagucuuuauuacugacauaucauguguguacuuguucuuuaucuguuucccacauuuagaauguuugcuucaggagagcagagacuuuuuguucacagacauguuuacccaagaucugagcaacugguugaugaaugaaugaacuaccuucuguccucaauucauccacuuguucagcuuagugcccuacccugcacugggcucuggggcaucuagucaugauagguaaguccccacucuuacacucucacggagccuccgguuuaaaggaaaacaggcagucaauaagaaucacaaauaaauaagcauuugugcaaauggagguguuacaaaagagaaguacagcacacaaugauaacauaaagcauggggacuuaacccuaguuggauaagccagagaggcuuuucagaggaggugacauuugaacugagcccugaaacaugagugggggacuggccagggaaagagccuuucaaacagugggaacagcacgugugaaggcgcugaggaaggagggagcgucacacaugggaggaacauggaggggacaacaguguggaagcucuagugauggaggggagaggagggugggccugccggccucauuaaggagucuggagugcaugcucugagugagcaacagugagucaggacgggucugcaguugggcagggagcuggaaccacacacccucucuccagacuucuuggucaagugaucuguggccuccuacucugcuccagcugcugauccugugucuugugugggccccucccuucuccccaccucugcaugggcccagcccccucuagcucagcaagcccaucuccccaccugcagcgugaguaccaggaccccaagcuucacccgcucaacuugcucaucacccucuucccaccugaaccagccuccuccaguuccacauggccaucaacggcccugccauucuccugugacccccugggacagggcagagggguagugccaucauccacuucuccaacaguuacagucacucuagccucaaagucucucccaugggagacuugcaguaaauuacucuguaagccucaguuucuucuguuucaucagggguggggggauaauauccacagccuaggguuuuaaggauacaagaaaagggccuagcacgaagccuggcacagagucagcuucuuccuuaaaaacacccuccuuccucauggucccucacaggcauacaucccugacucuccccugugguucccauuagcucgaauuggaacugaaucccacaccucuccuucauggcagccuacacucuuccuucuucagaugagcuacuucguuccuucauuaaauaagcauucauugggcauuuacuaugcccuuggcacagaaagacaagaaagaucucgugccugccccuuaagaaggucgcaauccaauucaagguggaucuacagggauuggguaaagggguuuuuugcacacaggcuucggaaucagaucugugcucagguccugugccuaccacucauuuagccuugguuuccucacacaaaaaacaggaauaauaacaccgccugcuucacagggcugacgugcagauuaagcgugaugacacaugcuguuccauguuugaaaggcuguugacugguaaauccuuauuaaggcuguugacugguaaauccuuauauaaucagugcucaguaauacuuuuuaucuuaaaggcaaauaacuguaauagacuauauuggaugaagaccucacugcuuugaucaaguaauggcugguuuacuugcuucugcuucucucacuagagagggcagacaacgguaaaugucuguugaacgaauacagaccugaggugcuacaggagaggcccauagggacccugaggaggaaaggcaucagagaaauugaucuuugagggccuggccccacccucuccgggaucccagggcauuuuaccacauucugauuguaauuaccuguuugcuaacauccccacuaacgugagcucucucuaacccuggggcuauucuccaggcugcagcagggcaaaggcggggucccaacaccauagagaacgccaccccuguccaugcugucccccacuucaccuuuucuuggagcgguccuuccacacucgccccgauuugggcuuccccuucgggauuacaggaagcuccucuuuauucaacuucuuggacgcuggggccugggaugaagaaccuuuucgcuucuuugccccgaagccgccugucaccgucuccccagcuggagguggcuugcucggcucaugcugaccccggggggagccaggugcccugggugucagcuccaguaguggcugagagggcuccggaccgggagcuugcugaccgggguaaggcucuggugauccugggaccggcgguagcugaugcuggggggcccccggggucagcuccuccuuauucugggccaacuccgaggccaguacucccugguccugagaacacuuuggugccuccucacuuggcuucggcugacaucguggggauucaggacuguacucuggcugucuuugaggcgacuccagguguaggucuugcugacgcuggggggacgcugcgccuggcucuggcugcccuuggggugacuccaagccugcacccugcugcagacggggugauccugggcuugucuucggcggccuuucgggggaccccaggccagcccgcugcacacucggaggagacccgggcucccucguuucuucuggguucgacucgaacuccacaagggcccgucucguccgcgaaacugaggugaggcucucgggggauucgggccuuaggccucccagccgucggcugcgccuuaacgguguauccauggcucagccgguaaguuuccacaccccugcgcacgugcagcccccgccgaaaccggcgccuuccuaugacgucaggagucgccgcguccgugacgcacaggag

SEQ ID NO: 18760 - RNA, 4687 nt, Homo sapiens
ccggccccacugagcgguguccugagccgauuacagcuagguaguggagcgccgcugcuuaccugggugcaggagacagccggagucgcugggggagcuccgcgccgccggacgcccgugaccauguggaggcugcuggcucgcgcuagugcgccgcuccugcgggugcccuugucaggucagaagucccuuuugguuccuaaagacuuuaccccucuuccucccccacccuccagugcuuuuucucccuaacccaaaaggcggcucugcauaugcuuggugaagcacugguuaggaacuacgcuaucgcaccgccgaccuccaccguagggguucgugcaagagggucacagcugcgucugggagucggcgcccagagaucccggcuggccuuuugcggagccugagccuuugaguccauuuaguggaauccgcaucccacaccucaagacuccuccggcggaaguacuuuugggcgggcgcgguggcucacgccuuuaauagcagcacuuugggaggccgaggcgggcgaaucacuugaggucaguaguuugaaaccagccuggccaacauggugaaacccugucucuacugaaaauacaaaaaaaauuagcugggcgugguggugggcgacuguaaucccagcuaguccggaggcugaggcaggagaaucucuugaacccgggaggcggagguugcagugagccgagaucgcgccacugcacuggauccugggcgacagaguaagacuccgucucaaaaaaauaaaauaaauaaaaauaagaaguaguaccuuuggcccagguuguaucggggucccggccuguuaccuucgucguuuaacuugauuugucuuuguagauuccugggcacuccuccccgccagugcuggcguaaagacacugcucccaguaccaaguuuugaaggugagagcuugucuuucuccuguucguaaaucuuuucucugauggaaaccaggagcgggugggagaugacauaggaauguucucguguuucccauccccguucacucuuucaauaaauauguuuuuagagcuuacaguuuugccaacuaauauucugagcacuagaaauaaaucaaagacaaaggaaaccaaaaaaguuccuugcucuuacggagcagcgucuaaugagauagcuccccuaaaaccucccacuggugugugucccaugguccacucagccaguagucauuggccugaaaucuggauuuuugagcgggcaugguggcucacgccuguaaucacagcacuuuaggaggcggaggcggguggaucacuugaggccaggaguuggagaccagccugccaaccuggugaaaccccaucucuacuaaaaauacaaaaaauuagcugggcgugguaguuuacaccuguaaucccagcuacucaggaggccacugcacuccagccugggcaacagagugagacucugucucaaaagaaaaaaaaaaccugaacuuuugauguucuuuccaaauaaguuuacauauaugcagucaucuaacgauaugugaaaaagcuuuaauuuguuaaauuuaagccacaauaucguaaaacuaguuuacuuuuuaaaaaagaaauauacuggaacccucaaaaaaaaugaauagggucuguacaucugagggucuucuguacagaauuguuaaaccacguuuugaaaguacauuuugacuuguaggugaaagaaagcauuacuaagauucucuguagcuacauauagaaguugaggggcagcuucugaaacucugauaguaauaauuugguauuuccucaaacucuucuauuuuguauuugucuccauuauaaagccauacuugguucauuuaagaaauuuuuaaaaaugauuuguauguuaacuuuuuuccccaaaucgucaaguaaggaugauaaagaagaugucacaugucuggccugaaguuuugcccacccaccaaaaccuggcacacugaccugugcaggucucagcaugaaaagucccugcauauaugagagaaagagcauugaucaaaggauuccuagguuguaaguuucucaacaagaauguggcagagcuggagaacuuagauauuuuuauguacaauauaguauucuuccacuacccccauuaacauccagagaggcagggaaauauauguauauauuuuugugacaugguauguagcuuugcuguugaacuggauggcauagaccagauuauaaaguguuuuuagcccucggguuccucuucuauaaaauggagauuaaaaauacuaccugccuaauauccuguuuguugaucuggguaauagugguguguguucauguguucacuuucugguaauucacugagcuguauauuuuuaauuuggcccuuugauauagcuguguuaaacuuugacaaguuuaaaauuuuuaaaaagagagcccugaaagaauaccaaggcuauaaaguuauuuuaaagauuaagugaacuagugguuuccaaacaaucccuguuacaguguuaagcacagaguuggugauuaauaagugcauuuggauucagaggauaaaacuuugcuaucuuuaaaguuuuagaaacauuugcauuagccacugucacagccagaagauuccagugucacuaaaagcaucugcaaaaauguaauauaccuuuacaguuacuguucagugguaacuuuaagacuuucaggcuggauaugguggcucgcacuuguaaucccaacacuuugggagguaaaggcaggaaaaucacuugaggccaggaguuugaaaccaaccugggcaacauagugagacccugucucuaccaaaaaaugaagaagaaagaaauuaagacuuucaccuguuauaaaucuuucuaggaaaauagaucuuuugagauguauaguuuuacuuuauccugguugucugugcuucuuuuagauguuuccauuccugaaaaacccaagcuuagauuuauugaaagggcaccacuugugccaaaaguaagaagagaaccuaaaaauuuaagugacauacggggaccuuccacugaagcuacggaguuuacagaaggcaauuuugcaaucuuggugagugaauucagcaucgagcagcaaugggauggaagcuagggaauaacaaaaucucauacuccuugagauaauuuagucucuuccuccacaguuuuuauuagaacugccaccaguugcucuuuaaacugguauguacagaggcuacuggguacccaguaaacauuuggguuauauaucuuuuuuuuuuuuaauguagagugaaaauaacguaaaagcagaaggaaggggcuagcuaaugugccccauaaucagaucaugagaucuuuucaagcccugguaaaaauaaaaccauccacaauauaggauguggaagacagcuguuuccuuacuuguugaguagcuuccaugaagacuugaugucagcagccacacaaaugggugugcacuaggauuuguuuuccaccaggcagccagagugauauuccaaaguccucuuccugcagccuacauaaucacccccacugaccucucagaaccuccugcccacucuccccauuccucacccuacuccagccacauuggcuucuguucaacuugccaagcccucugcugugccagggccuccacauaagccuuucuuaugccuggcacacuccucucuuuucccuuggcuaguucuuuuuauucuggucuuagcuuuagaugucaccucuucaaagaagccuuccuggcucuccacugaaaugggucccccuucacucuauuacuguguacccuaggcuuuuccuccaugggacuuauuagaacuuagauuuuuauuuucaauuguaucauugaagccacaguuacuagaagagacaaaauaaugagcccauagaugaugucgaaguccgcauguguuucuaauucucccauucacuuuuaggcauugggugguggcuaccugcauuggggccacuuugaaaugaugcgccugacaaucaaccgcucuauggaccccaagaacauguuugccauauggcgaguaccagccccuuucaagcccaucacucgcaaaaguguugggcaucgcauggggggaggcaaaggugcuauugaccacuacgugacaccugugaaggcuggccgccuuguuguagagaugggugggcguugugaauuugaagaagugcaagguuuccuugaccagguugcccacaaguugcccuucgcagcaaaggcugugagccgcgggacucuagagaagaugcgaaaagaucaagaggaaagagaacguaacaaccagaaccccuggacauuugagcgaauagccacugccaacaugcugggcauacggaaaguacugagcccauaugacuugacccacaaggggaaauacuggggcaaguucuacaugcccaaacguguguagugaguguaggagauaacuguauauaggcuacugaaagaaggauucugcauuucuauuccccucagccuacccacugaagucuuuggguagcucuuaagccauaacuaaggagcagcauuugaguagauuucugaaaaacaauguuauuuguugauuuaaaaagaaaacuguauuuuuauuaaauaaaauuuaaacaucacuucaggauauaacuucucauuggucauucuuaaucccuuaaaagauuaagaa

SEQ ID NO: 18761 - RNA, 928 nt, Homo sapiens
gaauuuucucaaugcuuuccuuagggcaucuuucaguuccuuguuccucaaacuauagaucaagggguuuaaaaugggagugauaaauguguaggccacagauaccacccggcccaucucaggagaguagcuggaacugggggacaaguauauaaagcuggugcagccauacugcaggaggaccacuaagaugugagaagagcagguagaguaggcuugcuggcgcccuucugcugaccggauccguaaaauggcuaccacgaugaagacauaggagauggagaucaaugagagggggaugcuaaggacgaugaagcugaugauauacagagcagucuugugaacgcgugugucugcacaagccaggcgcaugacugcaggcaugucacaguagaagugguagaucucaucauuguggcagaaugggagauggaagauuaaaauggugaguggcagugacaacaggaaccccagcaccaaggagccuaccagcagcuccacacacaaggaccagcucaugaugagccuguaucgcagagggugacagaucgcuauaaacuggucauaagccaugacuaccagcaggacacaaucagccccacccaagaagacaaagaaaaacaucugggugccacaucccgugauggaaacaggaguuuugcccauugaaaggagguuugccaaggccaauggggugauggaagauguauagaagauuucuagaacugccagauuagccaggaaaaaguacauggggguguggagggaaugauugaucugaacaaugacugcaauuguagcauuuccaccgaggcuggucagauacaucaucaggaagaccacaaaaaucagcaucuggaccucagggucaggugagaauggacgaaagaaaaacugcaucuuugcaguuuuauuuauuccuuccaug

SEQ ID NO: 18762 - RNA, 12069 nt, Homo sapiens
gauauaauugcauuuuagcauggcuaucuucugaccucuuccagcaguucgucugccaucauucucccuucugacacaccuaccaaaucaaauggcuucugauccucuauauugcaguauaaaccaacccuauaguaccccucuggucaugauacaaacccagaaggaaagucuguaaaucucauacaaagguagaaagugcaauucaacccaacacgcugguuaugguauaugugcugucaauguacaugguagcaacuugaaucaaaccagagcugcuaccacauguaagcaaccucuuaugcugcccuguagugaugucaauguucucaguuuacuaaauuaucaauguggaagaacgcauuuuugagcuccagaccuucuaaacauuuuaaacaggcuaucgaagaggauguaacagaacccuauuucagaaaccuaaggaucagggaggaaggaacacugaccgguuuuucugggauguuucugugggggcaacagggaugaacaaaagaaauguuagcaugucagagcauaugacaagugaggggagacagagguaggaagaggguguucuagccacaaggcuaaugcauuuguguucaaagagaagucugggcaaaggaggggaaacccccccuccccccuaaaaaaacaaaaacaaaaaaccaaaucaaaggacaaaaggguuucauacaacacaguaucaaaaaguaaaaggaacacacuaaaugcacaagcugguggcaaguaaguccacagccuauugugauagguccauccagcaucaaucagauuucuucucaucuguuaucucaagguuauuuacagauguguugacuaacaagagucucucaugggaggaugggcaggcuucaaucauugguuucgggaucugucugcgccauguaggcauccaacucagcauccagguguccuuuuguuuucgacauauaugcauccaauugguuguccagcugcuccuuggucaauacagggcgagcaagggcaccucucccucguccacggccucggccucggccuccaaagcccccucuuccccgaccuaucauaccccgaccuggcccaaaggggaaaaaaaaaaaaaaagagacaguuacaaguaaguuuaauaggugcuguaguaaaugccccuuagagcaguggggccuagcugagaaaagcugaagggcagggcaaagaggagaaaucuggaaaaaaaggaaacacaauggguagaaagcaacacauggaaagcacacauaaugaauccucuaucacaugaucaucucuaaaugcuauuuuaacaaauuuuauucuaucaauaaaggaaaauaauuaacuggcaacuauaauuuuaaaaaaccuuaaucaauccuaagauaaaauuaccuaacauuugagauucacuaaguucauaauuaaaauacaugacagauaaccccauuugguaagauagggaggugguaacaagagcacagagcaucaggggugugaagacaagacaguuuucaaauuaaguuuauuggagacccuucuggaaagucaucucaccuguccuuaaacuuaucaagucuaaugagcuagcugaccucaugugucaggagacugaguuuuucugacacaggaacaauguaggggagauuugaaaaaauauuuugaguuguccuagcuauuucuaccuuuaauucuaguuaccuuaugacaacugacaauugugguuaucugagaagcagugugaauucaguuaacaaaacaaacucagcuuuuugaaaagcuauuuuagucucucccacccucgugaugucucucaggauccaagucaagauaauuuggaaacauguuauuucauccugaaacccaaacuagcuugcacuucacucaguaaguaucauauaaugggagagaagaaaacaagcccuugguuaucaacuuuucuuuccuaacaguuauuauuccuuggcaacuucaaggucauaaguuauggaagacccaagacaccuuuuaagagaaccaaagcaaauauacacaggggcuucaauaguguuuuuuuucuggacagguguugggaguuuuccacuaagcucuaaaccagaaggcucccaugagauuuaguauuaacagcagcaacaucauuaaacucuuucccaaucugggucaugaggucacaagacaaacaucaauaaauuucaaaggcaagauuaucaauaagagccaguuaguuaacugauaauaauuccaucuugcucucuaccuuaagcaaaaaaagucaucucugguucuccacaggcaccaaaugugacauugaauuuauuugguuucagagccaaugcccagcuccaagucucaccacccucuuaacucuacuucaucuuuguaucucucucucucuucuauauucucaugugacucaaaccaggauuuggagcuacagggugguaugugguggugaugguggugggacaggggcagagaaaggcaaaacccuaaacugaccauuuugggggguauuuucaacuauacaauuuaaauuugcaagagcuuggaggaagauggcauauaaucuggcucuauaauaugcacuugauugauucuuggaaaaaucaugagacuuuugcacuaccagcaugguaauuugaaaaauaagccaguuucaaauaacaaaacaagacaaacaaagaagccugccuaugacuugaagcugugcagaaagguggcucugaguuuuuaagggaggaaaguaagggggagcuacucucugaaguugguagcugacuaaccucuaccaccgauuccgccacgacccauagcuccacgcccuaggcccccucucccaggaccuccacgaccucgaacaccaccucuucuuaagcccauucggggagcuacggcucguccaccucggagcagguuuugaccuuagagaggaggcauacaauguauaugcagguaaauccaagagacacaaaguagauucuaaccaaaggaaggcggugaggguuaaaugaagguaauucaguuaguuuuuagguuggcuggggcaagcugcauacugugaacagauuaagcuacucuuuauucaaucaauucaacaagucugaccacaaauccauuuuuggaaguugggaguuaauucaauuaguaaguacauacauuuaauaaauaucuacugaauaaucagauagaugccuagcauuaugguaaauuuaaaaauaaaugcuaugguuccugaucucaacagauucuucuagggaacaagaacuauacagggaacagaguaauagugccccaaaugaacauauauagguaagugcugugggucaacuuguccucuuuuuccagcuguaucaguguuuuacuagcaccaggaacaaagagauauaggccaaaagaccuauaaauuucuuauguuugacuuguuucuagaacuugaaugugcuuugauucaagcaacagcaggguguuuuaaaauggaauggagaugacaugaauuaccuguuguuacgcaggucauagccucucaccauugcacauuaucagaaaaggaaugguauugauaaaagacaugcagcacuauuaaaaauaugugauuucagaaguuauuauauuaauacaaauucaggcuuaaagauguuaaacaaacguguccauaagcagcccaagagaaaagggaagggaguagggcccgacaauuaucaggguacacagcacugaccucggagugacaucccgccccuaaguaggguucugguggcacgucccccacguaguccuccucugggcaagccucucuggauuauggguaggccucguccuccgauugcuccccuggccagggccccuaugggucggccuaaccgugccuggauguuacucuuacccaggcgcugcuuuaagcucuucuggaagaaaagguguuaggggauugagaucaaaaaagcaauccaacaggauuuggcaacucaaagugcagagaaaaagaagcaagugagaugcuggugugaagggagauaaaccuguugugggugucaaaaggaucccaaaccagaagcaagccuuugccucagaacauguuauacaagcagcagaauuuugauccagagcagaaacuccaagaagcucaaguguggucccaugaaaugggcaucuccacaaauuaccucacuaguuuggcuacagaagucauacacugccaguugaaacuuaaguuuucguaagaacauucuauaguucaauccuggauuguacugcuuuugaacuacagguugacaauuauaugacuugauucauaccugcccauggacuaccacugucuucaaaggcuuacucaaacaccauaggaaguucaucacacucugggcaaaacuuaaauuacaaguucacuugaguucuugugacuuaagaacaagauugauuucucaaaaaggcccgugugcuccauuuuuccucugagaaucuauuuccagacgguccacuuuuuaccuuaagauguaaauaaacacaagaaagucaaaucuccuuuccuuacauuucuuaaaaaucccuaauuccaugccugcacuugcaaacagcuccuuuaaaacaaugaugaccuuaaauuaaaaauaaacauguaacucaaauguaucuccacagucagccagccaaacguauguuagaauuauucaggugaucacaaaacucagggccauauauaagaacaaggacacacuacagagauaggguauuuuuaagaaucuguucucaaaagaaaaccauuaagacuacaucucagagaauuaaauuccuucaaaggaaaaagggacagcaauagcccugaacacaaccaagcuccuaguaagccuggcuguccauaaagccaucagucaaucugaaagaaaauaaauuguauagccccuucaggcuucacccacaagugacuaccaacguguauguguguguuuucuaaucaaccucucaaaaagaugcugugaagcauuauuaacuuucuagcacaagaucauaaauugcuucucaucaguggggaaggcuccaaacauuaugcaucuagcauaaguagguguaaccaaccguaacggccuguccuguuacucccgauuaacacacaauuaucagguuagaacugcauuccacaagucucuugcguucaguuauccugcauauauuaauucucccaagcuuugugcuuuaaaagaacuguacagugcugggaaguucuuuacccauuccaauccuuaagugccaccaauaccggccuuuaauauuaacagggaaguuaaggaugucaacuauaccacuuaguuucccuucuagaggugugcuguguaaggcagccucuauagcuacauguggcuauuucaauuauuuuuauuuugagauacagucucgcucuguugcccaggcugaagugcagugacacgaucuuggcucacugcaaccuucgucucccagguucaaacaauucuccugccucagccucccgaguagcugggauuacaggagcugucaucacgccuggcuuauuuuugguggagacggggucuugucauguuggccaggcuggucuugaacuccugaccucaggugauccaccugcccaggccucccaaagugcugggauuacaagugugagccaccauacccagccuaaauuaaaagcaaauuuuacuuauuuucuugagacagagucucacugucacccaagcuggaaugcaguggugccaacuccacucaccgcaaccuccacuuccuggguucaagagauucuccuuagccucuugaguagcugggauuacagguaugcgccaccaugcccggcuuuuuuuuuuuuuuaguagagaugggguuuugccacauuggccaggcuagucucaaacuccugaccucaagugauccgccugccuuggccucccagagugcugggauuacaggccuggccuaaaauuaaauuaaaaaaaauuaagcuccuuaauugcacuagucacauuuaaaguuuucaauagccacaugugacuaguggcuacuguaccggagagcaaauacagaacauuuccaucauuguagaaaguucuggcugggcacgguagcucaugccuguaaucugaacacuuugggauacugaggcaggcagaucacuugaggucaggaguucaagaccagucuggccaacaugacaaaacuccgucucuacuaaaaauacaaaaauuagccgggugugguggcgggcgccuguagcugagacaggagaaucgcuugaacccgggaggcggaggcugcagugaguugagauugcaccacugcacuacagccugggugacagagcaagacuccgucucaaaacaaaccaaaccaaaccaaaccaaaaacauaaaaaaauucuauuuaauaguacuacucuggauagggacuacuuccugcagagccuauacuuaaagcuucuuguugaaagguccuuuggaaugaucugucagagauucaucuucagcaacuuccauuuacucuuggaaaauggugccuuuugcugcuuuccugagucagggaggaauccagucacuccaaggcuuaagguagccgaagcagacacccuuguuuauuuuuggucagugagcccaaugguucaggguggggguguaaggguguuauauuuaacugcugaauuuaugcauagccaugcaaugcuaccaaagcccuuacaguugcauggcacugcccuccagacgcccagccacagcuuggacauauccuuccacagccacuguccggacuugcauauaaauucuaugaauaauaaagagcagguuuuauuucaggucugaauaggauuaucucucacuguaaauuugaaaaagagaaccccuaacucaaauuacucaguauucuugcuccacuuuacugguaaaacuuuaggugcuguggaaaugagggucacucuacucuguauauuuuagcauugaaaaccuuugacugcugggcgcgguggcucaagccuguaaucccagcacuuugggaggccgaggcggguggaucacgaggucaggagaucgagaccauccuggcuaguauggugaaacccugucucuauuaaauauacaaaaaaauuagcugggugugguggcgggcaccuuuagucccagcuguucgggaggcugaggcaggagaaugguauggacccgggaggcggagcuugcagugagccgagaucgugccacugcacuccagccugggcgacagagcaagacuccgucuaaaaaaaaaaaaaaaaagaaaaccuuugacuaaggccaugcaaacucccugcacuaugggaaaaagaauaaaauuauuucccuguuggguaaaucauuuaacagagaguaaaggaugcugugagauuaucuaaagcugaaauaaaguuucuuuguggaauaagccauuaaucuauguuaaggguuaaggaucagaaaacaaaagauuaauacucauugguaacagaaacaggccacauagauggcaaacucccuaaaagagaaagacaguaaaaaguuacuuauugguaccugccaaaauuggaauucucugaacuucucuuucuuccagagaaguuucagcuuuuugcccugagccacuuugcaaucauccaucacguccugacagccucaguggacucccucacagagaucaccagcugcuucuggagcauuaagacccauucucucaccugcuuaaguuuuaaugcugccuggacagagggucuauucuccaucugcugggccagucuucuguuucuggcacuggcuagcugcuguuguugcugcaucgaagcccgaauauucacuggcgucggcuguuuguucuucagcauauuaguaaagcuucaaggucgaacaaaauggauguuuaaauaaaagcuuuauuacaaacauuuauuggcauuuucauggcuugcuagaccaggagcuccagaucccacgaacuuuuaaguaaagugguacacuuagaucaaggcugauguggguuaaagacuccucuguuuccacaaacuugcaagaaucagaaacuuagaaaugcagcuaagugcagcacauucaaccaaaagugauaacgagggcucagguaacggcuuuuagagagguggaagguaugaaaaacacgcaauaagcagauaugacaagagacagaagauauaguuucaaagacaaaugaagaaagccuaaaccuugggggauccgaggugcauucuaaggccaaauaugaggaaggauuagagcaccuucaaagcucacagcaaugaacauacucucauaaauuacaggaguguaucacauuuuaaaauauaugucacuaacaugcaaacauaaauauuaugcaaacauaaauaauuagcuuaucauagccaaagagauaaggagagaagcacauaugccucagaagaggcaaaaauagacauuaaguaaauuucaguggucgaaagucaacuuaaugaaaucacugaucaaaggcauucuuuuuuuugaaacggagccucacucuguccucuguugcccuggcuggagugcaguggcaggaucuuggcucacugcaaccuucgccucacggguucaagugauucuccuaccucagccuccugaguagcugggauuauaggcacacgccaccacgcccagcuaauuuuucuauuuuuaguagagacaggguuucaccauguugggcaggcugaucucaaacuccugaccucgugauccgcccgccucagccugccaaagugcugggauuacaggcaugagccaccgcgccuaaacaaaggcacucuuaaugaacaaaguugucagagauagaaacugccuuugaauaucuuuacuuuucuuagucuccaaucaucacuuuuucugacuccaaguaguuacuuuucaaaguuacaucaguuugaucauuuaugagccugugaagagacucauuauuucugucaaggaaguauaauggaauggaagagaagaacacuuaacuguagaagaauccaaaacaaaaccaaacuaaaagcagaauggaaagaaagugaaauggagcaaagcgagugccucuuacaaggcccaagaaugacauucaagggccuuuggacauauucauggcuugcuaccugccucuuacaggccagacacaacacugcuggccuuggacugggcagcaagccuacuguagccaggguaccaugcuaccgugcugcacgaccccaguaucaacguaaaaaaaugugaaaaggaagaguguuaggagucuuuuaaaauacaucccaccaaauaaauacuucagacagcuuaacauaaaagucuacugauaagggguuuugaaacaaccgcccaauuuguuuuguguaccacaugagaugcaacuaagaacagaggucuguagccuucuguugguauuuagcuuaaaauuggcuuugugcauuggaccccagggccaaguuaaguaauguuuucuuaggaaggaguugaaguugcuguuggcugccucaccgcucauuuagagacaucuugguggugcuuuuuagcacaacuuucggcgcugacugugcagccaucuucgaaucccgagaaucuacaaagaacaauacguaaaaugagcaaaucacaauagugacaucauuucuauaaguggcaaggcccaagccaaaaauaaauaaaaaggccuuaucacugaugacuaaagagcacacgagggcacauuucaagugcuuaaauuucuuuuuuuuuuuuuuuugagacagggucucgcucugucacucaggcuggaaugcaguggccacugcagccguaaucuccuggccucaaaggauuuucccaccuuggccucccaguguugggaucacugggacccaacgcccagcaaaaguucuuaaguuucuauggcaauuaccucagauuauuauaacuucaagguggcuggguauggugguucaccgccuguaacccuaacacuuugggagggcaagggcacaggaugguuugaagccaggaguuagagaccagccuggguaacaaagcgagacccagucucuacuaagaaaaaaaaaaaaaaaaauuagcggugcaugguggccagcaccuguuguccuagcuacucaggggagcugaggugggagaaucgcuagagcccagggguuggaggcugcaaagagccgugaucaugccacugcacucuggccugagaccccaucucuuuaaaacaaacaaauaaccccaaacaaacaaacaaacuucaaggcccacaaaauacccgggaauuucucaaaaacggcagaagccaaucuagcaaucaaaguauggagucuggcuuuuuuuuuuuuuugagacagagucuggcucugucgcccaggcuggagugcagaggcgugaucucaguucacugcaaccucugccuccccguucaagccauucuccugccucagccuccugaguagcugggacuacaggcacgugccaccaugcccggcuaauuuuuuuuuauuuuuaguagagacgggguuucuccacguuggccaggguggucuugaacuccugaccucaccugauccacccaccugggccucccaaagugcugggauuacaggcgugagccaccgcaccgggccgaguuuggcuuuuacucuagagcagucauuuucaaccuugacuacauaugacuuauccaaggagcuuuuaaaacauagggccggacagggcgggcgcggugcuucacgccuguaaucucagcacuuugggaggccaaggcgggaggaaugcuugagcccuggagcucgagaccagccugggcaacaugguaagaccccguuucuauaaaaauauaaauuaauuaaaaaaauagaaaauacagacaucugggccuagaucaauuaaaccacaaucucugguaaugagguuuggaaaugaaccaauuguggggucgggggaaagcuaccuaggugcuucuaaugugcagcuaaaguugagaaccacugaucuacagugaaaauacaggcagggccgggcgcgguggcucacgccuguuuucccagcacuuugggaggccgaggcgggcggaucaccugagguugggaguucgagaccagcuugaccaucauggagaaaugucucuacuaaaaauacaaaauuagccgggcgugguggcgcauggcuguaaucccagcuacuccggaggcugaggcaggagaaucgcuugaacccgggaggcggaaguuguagugagcugagaucgugccauugcacuccagccugggcaacaagagcgaaacuccguccccccccaaaaaaaaauauauauauauauguauguauauauauacauauauauaugcaugccuaguuucaaaaguggcuuucaacuccagaaucaaguagggacuuuaacaagaaacugacgaucugggggaguaggaaagguuuucuaaauucaccugggaauuagcucgcaaagagcccuccacaaaacuuaacccuaaagccgccauuaauuuccaacauuccucaaagucuuguacuucuuaaucucccuaccauccucaaagcccugucaagacuuccacuucugcucuacccgccaaguuuccuuuuuauccuaucaaaccccaaccuccaucaaucccgccaccagguuccaguucagccccucccccgccccuucgcaggggcuccgccuccuccccggggccuccacgcuccaacaccguagcuauguccacaugccaccacccccuuuccgcguccgccggccccuuccgcuccucaagaccgcaccucccccggcuccuucucacuaccgaaacucaccgaaggaaacagacgccagugcuccucccggggcugccaccacggcuccggcaggcgggccggggaccggccgaaccugaguugacgguggaggggcucggguuagcuagaugggcgguugguuagaugcguaagcgguaguaugcgagcucaguucguuguugcugguuggcugucuagucggccgauccgucugcucacccggccugcccuuuccugccuuucgucugcagcggccgccagcuccugcucgguguccaaaacaaaa

SEQ ID NO: 18763 - RNA, 32434 nt, Homo sapiens
ugaggcgcgccugcgcacguccccacgcacgcuccggcguacggcggcggccaggggucgcgagccgguggaggacccgcgcgcggaggagccggggagucagcgcuucuucccucccucccccucuccccuccccgcucccugccccccuccccaagaauguuccgcuacgaggugagcuguugcgaccggaagugaccccucccucccucccgcgccccucucccucacucucucuccgcgcgccgguccuguguuccugcggggcagggggcgggcugggggagucgcaggacuuagcuggacgcgacuggucuggggucgcgggucuaauccuagggcugggagcuggcuucaugggucgagacagucccauuaguugccgcuggggaaaguuggccuccguuuugggguggggagggcccguuaagugcuguaaccagaccacacccccgcccccaccccuagaggagccacggaggguagagcacugcaucuccccgggugcuuuucuuaaguaggugucacccgggaauucccagagccgcguuucccgcccuggacccggaaccaccccccacccaccuccacucgaauuacacugacacacaucccauucacacaggcuaccuucaggugaagggggccugggcuugccguuggauuagggccccagcccguuuacuaaagagggcuccgaguugggaggggggcguguccugcagaaguuccuucugggcuagugcugggagacgcggguuuggagaaggugccgggaauguagcaauagcagcagacaguacugacccugucaccaacucacugugugaccuugagugacuccuaaucucuggacguaaacuuucugaauuuguagcaugaaagaacugauguaaaugauccuuaagaauuuuuaauuuaaaaaagcagcgauuugguaaaguagauauuugugauuuggaagggaguacugcuggaaguugccucugauaaggaggcaguggcaugccuauuggcaugaguuuggaagggcucugggguaagaagaacgcccuuugaccuaaucuuuccauuguaaacaggguagcuaagagguagccaggcaagguguaucacaaacguaccuacugauagaauauggaauucugauucugaauuuuugaaaauugaggacagguauacuugauaggaaugaucuaagaccaaaccaaaaggaaaacuuggagaauaaaucaguugaguaagauugaaguaaagggggaaaauagaacacaccuaggaugugguggccucuagccuuuguucgauaaucuguaaucuuugcccacuuugaucaucacaacucucugccauaguugguauugucccugcauuacaauguaagacauugagccuuacagccuagcacagaaccuuagacgcaauagguccuuaaaagguauuugaugaauuaauuagaaauuuucugaguugcccauguucacacugauuguaggaauggagccagaacuugaacuugucauaccacagcuuuuccagaguucauuuuauugugguugaagaccuaauuuucuguuucaucacuagaguuuaggccuauagggaagauaagaaagauggaaaaugaagacaaagcuuuaaaacggaauaauaguugaaaagaugacaugaauauaaugagaaagaugagaauuuugcuggaaaagauacauaaagauacaagaaaauaaaggguucauuauuaauugucaucaguauuccaaccagugauguaaggaaaguugugggcuuaauuucuugguugcaugaggaacugcuguucguggauucuugauaaaauagagaaauggaaugcugugagguggggcaagaauuaaaugaaauaaggauuaggaaauagaaagugaaagaaagaugaugaaaucuuccagugucagggaaauugggaaguagaaaaaaaaugccaucuuuacaaaaagucauaaugaagcaauuauguucauugagaagguaagaugaacauuuuuagaacauuuuuaaaaugagggugugaauuucaugaauaacuaaugucuuuucuuuuuuuuuagucuuuggaggauuguccucuggaugaagaugaagaugcauuucagggacugggagaagaagaugaagagauugaucaauucaaugaugauacauuugggucaggugcaguugguaagugacaucuuucgcuuauaauaucaucuuagccuccugcucuuuucaagugcugucuuuuagaagugcuuuaucuuauuagggguaaccuuauucacuaacuuggcaagauauucuucuauuccucaucuuagaauaguucauucuucacuggaaacagcaccuauccugcuccucugggucucuuuuugccuuaccuauaaaaucagguauucuguaagccuugccccuuccagcuauaugaucgaugacuacagguugccccuaugagggauucaaauguuuagagaaguaaacauuuaagagagauuuaaauuaauccuagaugagaggaauuuuuauuuguauaacauauaacuuauggaaaacuaguguacuaguagaaaauucagauucuaggauguggguauauguguuucaaaauuuagucuaucacuaguauauaacuuugcaacuuauaguaucuucaaaauauaaagcuuuuuauagcaagaauuuugggggucaagaaaggacucauaaguuagaaaaguaugcacagaugaaauuuuguccaucccuggguauagauacauauuauuuauuuauuuauuuauucuuuuucgagaugaagucuugcucugucacccaggcuggagugcaguggcacgaucuuggcucacugcaaccuccgccuccugaguucaaacaguucuccugccucaggcucccgaguagccgggauuacaggugcccgccaccacaccgagcuaaccaggcuggucucaaacuccugaccucgugauccgcccaucucggccucccaaagugcugggauuacaggccugagccaccgcgcccagccuauagauacauauuuuaagaguuggaaaaaguuuaaaaacugaagagccaaacuaagguuacaggccacgggguuauaaaugccaagauggaaaauuuaggaaguaagcuuauaugauaaaguuugagaacacauguuacuuagaacagguguagaacaaguggaguaauaaauugaaauuuaaauuuuuaaacuguauacauacacauauauuuguuuugagacagagucuugcucugucaccuagacuggagugcaguagcaugaucucggcucacugcagcuucugccuccccaguucaagcaguucuccugucucagccucccaaguagcugagaacacaagcgcccggcuaauuuuuguauuuuuaguagagacaggguuucuccauguuggccaggguggucaugaacuccugaccucaagugaucccuccucagccucccaaagugcugggauuacaggugcaagccaccacgccuggccaaaacuguauauuuuuaagcaaaugaauagguaagagucaaugcagauauguuugcuuagacuuggugcuggaaagcagcaauaacagcguuuauguucaaauguauaaaugugugugauucuuuuguagucgcaacacuucugucugugcaacaaauacuccaaguuaagucauaaggaaaaagagaaaauuuagcaauagucaguaaucccaagauguugaauaucaaaaacaaauaagaggccuuaaaguauuauaauggucacugguuuugcagugaccuaauacauuuauuaaagcuuagacugacuugaauaaacuggcaaaaaugaagguguuuuaauauugucagucauuuguaaaauucauuagagaacuaaaacuuuguuaugauuagaagcagcaagaaaaguguugaaaguagaagcuagacucaugauggaaaggaaucaaagaccuuuuggauuauaggcauggguuaggagaugagauuguccaggaggauaacaugauccaagaugcuauuaucucucuccauggagaucacaggcaaagagauguagaguggaauuacaaaagcaggaaacugaugugaauugcaaauuauauuuggaagauaguuuagugauaaucaguaggacacaauaagcuauuuguggugguucaagcccacagcucucagcacuuugggaggucaaggcaggaggaucacuugaggccaggaguucaagaccauccucggcaacauagugagacucuuucuccacaaaauuuuuuuugaaaaauagccaggcaugaugguauguaccacuuaggagguugaggcugaggcuggaggaucccuugagcccaggaguucagggcugcaucagcuaugauggugccacugcauuccagccuggguaacagagcgagaccuugucucuaaaaaguuaauuaaauacuuuaaaaauagaauaccauagaagcuaccaacaugugcuuguuucuagaacucuuuuucuauuaaaauacuguacugaauguuaaccauuuuuucaacaaauucuucaguauuaaaaugaauuagcuagaauugauuuauagacauuaaaaugaggcagcauuguaccauguucucaguuuucaaccuggacagaagaggaagagucauaccuucucauugacuuccagagugcuauggacagucuuuuuuuccugaguuucuauuuuuucucauaagaugggaauaauauugccuuaaaaggauguuagaguguccggaacgguauuuuauaugaugggaaagaagaaaaguguacacgugcugaaaaagccauuagguuuacacaguaaaagaacagguaguacaaaguuaaggcaauuaaauagcauaugauuagcccacuuuguaccuuagggccaaagggugauuagaaaggauuuuuuggccaagaaaguuuauaauaauauagagaaaagauuuccaaaggugagcccuuucccuugagaguguaauguacuggaauuguaaagugaagaucuuaauuccucauaacagcuugguguaaauacuauaaaaagaaaauuguuuuccaagucaaccugugacuucuuugauacuccucugcagguugauauaaagcugguauagagaguuuaaaucaagaggugaaaugucagaccuuugacauuuguuuugauuuuaugauuuuuaauucauauagcgggcaucuggaauaauaccugcuauuacaguagacauuuuaggucacuggcuacaaauggucaccuuuccuuaagaaacuagucuucugcaugaaaaaauguuugcaucaucuuagagcaauaaauaguguugcaguaaucccaacuccuucucuaaaaauaaaagcuuacacuuaacauggugcuuauuaugugcuaggcaccauucuaaauauuuuacauauauuguuaauccucauagcagccuugugagauagguacuauuauuauccucauuuuaacaaaugaggaagagugacggguuaaguaacuauagacacaauuacuguaaacuacuaguuauguuuaauaguuuugggggagucuuuggaaaucuccugccuccacuuggaaggaaucacccuccuuccuaccucccuuuuauugauagcuacuauagucuuuagagauugagauugccuuaaaauuaaaucacuucuuccuuuuuauuuuguuuucauucaaaacucccugagacaggcuucagggguuauuacaaguauaaguuuauagaagcagccaggaauucaguaacccguaucagaguauagguuaguucguuauuacggauaaucucuuucccuucauuugucuguuauucuuuugccuaccuuuuaucauuuugaccaauaauggacucaggucaagcacuggcauaucuaaguaacuauauuuuuaggucauuugaaaaagauacagggugaaauauuguuuuauaguaagggcacaauaucucuaaaauacuacuucagauaauuuuuuacaagaguaagaaaaaucuaaaaugaugaugaugguauuuuauggcauagauuccucugguuacauguuugaaaauguaacaaucaauucaccagagaucuauucucacagaauauggcgacuuaaccaauauuuuuaaaauauuauuauuaaggggaaauagauuauccauauuugauaggauuugguaaaguuagcaagcaugaauacuggaaguagugauagaaaagcaugcaaauuagaacucuacugcauuagaacaaauccacuaacaaauuaacuucuuaaauuugggaaguaaauguuuuuacaaaucccucaauucaggaugauagauucccacucuuguggcauugcuaaguuaguaaaguugcaaaaaacaauuuauccugucccagcuuacuguuccuuaccaaggaugacacaaauaugaaugucacauuugguuuuuaauuacauuauucuuuaaauauuuucuuucauaugacuagucauuuaaauuaacacuguaauuuucauuuaaaguggauuuuuccauuuuuuggagcacaucaggauaggcuuaucagagaccaucaucauaaaauggcuaccuuaaauucuuuucuguaagaugacaguuuagaggaagagugccaccugacuagucacucagguaagaggaaacuauugggugggaaagaaaauaccacauaauuauaaagaagacccaugucccggaggcuuaaguaaggauauuuuuauagcuuuugcccacagucuuuaucccagugauggcacagugauccacaacuuaaggaaucccuuaccacaacuaauacauaaaucaaccaaacuaggcaguggguccuaugauaccaaaauuauauauuugaaagucccacuucccucacucuuuggaucacuaguauuaugugauacaucguuguaugauuaaaaauuacauauauauagcaaauuuuaacuguuaauguaaucugauucuaaaaggaaauuaguuuauuuaaauagucacauaaaaugcuaagauauguaugauguuauuacaguauuaauuauuauauuggaaaauuguaaauaauccaaauguuuaccaguaggggauaaauuacauuauaguuuagcaauaaaaugcaaucuuauguagguauuaaaaagaaugaguuacuaucaguaguuaugccugugugcaugcaugaaaagauguccaagacauauugcuuaaauaaaaagaaacaaguuaacuuuauaaacuuaacacagcuuaaaacuguuuaaaacuuaacacagcuguggaauuguggggaacuuucacuuaaguuacauguguuuaugguguuugaauuuuuuaaacauguauuuucucugaaagcagaaaaaagaaagucucuguuucuguguugguuauaaccuguuaucccugucuguugaauuuuauaaaacauauaaaggauguaacuaaaaaaagaauaccauauaacauauacaaaauaauacuuuuuguggguuagaaaguaaugcauauagagaugagguaaaggaagaaauaaaaugaaaggauuauuuaggaguagcuccauugaggaggaggaagaaguuucacauuugaauaccugaaaagaaaggccagaggcaguggcucaagccugugaucccagcucuuuggaaggcuguugcagguggauugcuugagcccaggagcuuaagaccagucugggcaacauggggaaaccccgacucuacaaaaaauauaaaaauuagccugguguggugguacaaaccuguaguuccaguuacuugggaggcugagguugggggaaucaccugagcccgggagguugagacugcagugagccagaucacgccauugcacuccaaccuggacgacagugagacccugucucaaaaaauaaaaauaaaaauacugaauggagcaaaacugugaguacagcuuucaugauggaagcagaauggaauaagauuggagagaacuggagugagaugcguuggaaguaaggucuagcuccagagcagcugauagaggguucugaagauuguaaucugugcuguaaugggauuccaaaacagaaaaaaugaugccaacauaccaaaugcagaaacaaccuuaaugucagugcuacagacuuuauaguagugugcaguaauagcagacauaguuaagauaaaagaggaaaugccccuuccucuucccuagccuguuuucagcacagcagccagagugauucuuuuaaaaguuaagccaaaugaaaauuuccauuggcuucccauuucaaucauaguggcccagaaugagcucccuccucaugacuucuugaccucauuuucuucuacucuccccacccugcucauuccauuccagacacaguccuccuugccguuucucaaaaccaucaaucucucaccuuaaggccuuucuuuauacugacugucccucugccuggaacccucuucucccagauauccaaauugcuaacccucuuacucuuuagaaucuuugcucaaaugucaucuucucaaugaggccuaccucugaccaucuauuuaaauuuucaaucugccuuucuuccuuuauauuccuacagcaauuucaucuucugguauaguaucuaaucauuaugcuuauugucuaucaucucucucuuuccugcuugcaugaaaguguuaugaaggcagaaucucugugucuuuuuguacaccaauguaucccaugcgucuaaaacagggcuugucacauaauagaugcuuaccaaauauuaauugaauggaacgaauggauucaaaagcauguaaagaauguggcacuuaaaaucuaagaggaaguuguaugcuaaugcuaugaguuuuaacuucccuuuaaaguuuuugcuugaaaugucauagaaucucaaaaccaacuaguaguacuauacauaucuaucaccaauuugggaaacaguuucagaauauaguuuggacauuauugauaauguuuuaagcuauuaauucacauguuugaauuuuauuccugguauaauguuauuugcuuuuacuuauaaaaagcaugcuuuacgugucccuuaguuuaaaccuuauuuccuguuucuaaguguaaacuuaacuuucuaccuaucuucuggaauuauucauuugcuuagcagaagaauuguguaggccgggcgugguggcucaugcuuguaaucccagcacuuugggaggccgagauggguggaucauuugaggucgggaguuugagaccagccuggccagcauggugaaaccccaccucuacuaaaaauacaaaaauuagccaggugugguggugggcgccuguagucccagcuacuccagcuacuugggaggcugacgcagagaauugcuugaacccgggagguggagguugcggugagccgagaucacgccacugcacugcagccugggcgacagagugagacucugucuaaaaaaaaaaaaacaauaauuguguaaaacuuuuuuguaccacuaugaacuauuucuuacaugaacugugucaucuuauagaugaugauuggcaggaagcacaugagcgccuggcugaauuggaagaaaagcuaccaguggcaguuaaugaacaaacaggcaauggagagagagaugaaauggacuuguugggugaccaugaggagaaucuggcagaaaggcucaguaagauggugauugaaaaugaacuagaagauccagcuauuaugagggcagugcagaccaggccaguuuuacaaguaaguaaguuacugugauuugagaacuauagcagacuaaaaauuaaagugaaguauugaacuuugccauuuuauuuuaucuauuauaaugagagauuuacauauaccauagaaaauugauaauauauuuccugaugauagaaguucuagagauaaacuuggggaauaauguauauucuggagcccuauaauuucguauucuaaagcagcuugaggcucuuuuggaaccuuguuccccagcagcagauaagucacccagagaguauacaacauuucagacucuguauguuuuccuuuuuuguuagccccaaccaggaagucugaauuccaguaucugggauggaucugaaguucugaggcgaauccgaggaccacugcuugcucagguauuaaauauuuucucuuuacauaaaauuuauaauauccaaaaauuuuaaguuccugucgucauccuuuccuuacugaagggguuuauaggucuuucauuugcuagaauuaugucgacuacugcauccagcacuuagcuaugccuuucuuuagccuccaggguaaagguugcaagggagccauuggaauuuaaauuuguuaguguaugauugugauuugaaucacuuaaaaagucauaucugagccaggcgugguggcucacgcguguaaucccagcacuuugagaggcugagacagguggaucacuugaggugaggaguucaagaccagccuggccaacauggugaaaccccauccuuacuaaaaauacaaaaauuaaccaggcgugguggugggcaccuguaaucccagcuacucaggaggcugaggcaggagaaucacuugaaccugggaggcagggcggaaguuguaguaaggcaagauugcgccacugcacuccagccugggcaacagagugagacucugucucaaaaaaaaaaaaaacucauuucuaugcaaaacuauagggacagagaggucaucaguguuuacuagugguuggacauggcaggaggcguuaacuacaaaggaacaauacaauggaauuucuggggagugaugcaacuguucuugcucucucuuucuuucuuuuuuuuuuuuuugagaccaggucuugcugugucaaccaggcuagagugcacugguacagucauagcucucuguaaccuugaacuuccgggcucaagugauccucccaccucggccucuugaguagcugagacuacaggugcaugccaccaugccuggcuuaguuuuuuuauuuuuguauagaugaagucucgcuguguugcccaggcuagucucaaacuccuggcuucaagugauccucccaccucacccucccaaggcgcugggauuucaggcaugagccgcuuaccaaacucagagaaccauauaccaaaaagugaauuuuacuauaugugaauuaaaaauaaauaaaaaguuaaaaaaauuucuuaagguauuuuuggcaucuguagagauuacuaaaacauaccaaguuaguuaauuucuauuuuauuuuaccacuuccucaauuaggaaaugccuacagugucuguauuagaauaugcuuugccucagaggcccccccaggguccagaagaugaucgggaccuuucugaacgagcauuaccaaggcggucaacuucaccuaucauuggcaguccuccuguuagagcuguccccauaggcaccccaccuaaacagauggcuguacccagcuucacccaacagguaccucucauuaacaagcacacagcccaggauauugggaaucugggcaaaauuauuuggaaaauuggugauguuggguggaggguggaaauuuuggguaggcauuagauuagaaagaaaaauagcuaguuagaggagaaauuaguacaaauaagagacacauucccugauacccuuugcugcugcuauugcugcugccuuuuaauugggggagaaaaaaggguaguuagccacauuuagcacauauauccuuuuugaaguguuuugcuggcugcccaaaacauugucagagagauaacugaaagccggggggagugggaacacacagcauuguccacaucccuuuuuaccuuuaagauaucccugcuuucccuagagccugugcaguccuguuccauagacuuuccuccaccugaaaccagcagcugaaaaggaaggccaauuuggaagguauggggggagggugguguugguauggccuaguuaggcucaaauccuaugaaaugguggagucacaauguaucacaaaagugcugagcauggcggccauaucacaggggcuucagaauaggacuuaguuaauccuccagcuuucuuaucauuccuucucccucagugcuaccaaaauauauccucuuggagagaauuugcaagucagaauaucugcugguaucucccucagacagcauggaaggguggggauaacuggagaauuagcuaaaucuuccucaguuaaugcugacacuuuacuugauuugugagagaaaguggcccaagguucuguauuugaaccuguagccauagcaauuugcuuagaaguagggcuuugcauugaguucgugucucuaccaguacuugaggggagggaguguagguggaagaaaaacugauuucauugaguguaguuguauauauguuuguccugauagauucuguguccgaagccuguccauguucggcccccaaugccaccucguuauccugcucccuauggugagaggaugucuccaaaccagcucugcagugucccgguaugucacuuuaagccuaacaaaaaugugcaguauguauuuucugaucacuauuuguaagaucacugccaguauuuagauuugcugacaucuccuaaauuauaccuauuuuuuauaaucuccuuacuuaaauugcuggaucuaauuguccccaggucagaggacaguuguuucuuacaucagcucuuuucuuaccuuuaaaaaucuaaacucauugugaucaucugguuccuaccauuucagucccauguucuacugcuucuuuuucaugucacauggucaugguguuuuuauaauuucuagcauuacucuuuuuuucuauuccagagcuugacucuguaauuugagaguuuuuauauccaaguuuauacugcauuucugcugaguuuccuuauuaugauguacccccuguuuuauagcauauucuuuuuuuuuuuuuuuuuuuuaccuuagaacucuucccuccugggucacccuuuuccuccuaguguuccuccuguucucagcccccuccagagagcacagcuucuuggaggagcacagguaagccugugauuagcccuacccauaaagaacucuccuacuuuccuaaaguucauuagauaauagccccuuuuuuugcuguuaaucacuacuuuuauuuuugccuuuacuuuuucaaacaaaguuauugauggaaaaccguauucacuuuucuguagacaaaagcaaggggacuugcugauugucuaaaucuaagaucuucuuccucuuuguagcuacagccuggacggaugucucccagccaguuugcacgggucccuggauuuguugguaguccacuugcugccaugaaucccaaguugcuacaagggcgaguugggcagaugcuucccccagcaccaggcuuccgugccuucuuuagugcuccacccuccgcuacaccaccuccacagcagcacccuccuggcccaggaccccaccugcaaaaccuaagguauacaaaaucaacgccacuguuuaucaguuaucagccaagucucuugauuguggauguguaguuuuauaagucucuugauauuugcuaacuauaaauuuuaagauguuauuggauccucaaguuggcaaacauggaaauguuugacaaucuccaggcuuucuugugaaucacauuuuucucacauuaccagaggguauggaauacagugacagaugccgaaaagucagcuaaucgucacacuagcuaagcuguuugcuuuuauccucugguuuuaugacaaaagggguucaaguuccuguuucagugaaguuguguuuuauuacauaucauauuguggcagucaggauuuucaagagacacacgagaaccaguagaggaaagagagcaagaauguucaugugagcagguuuuauuuuaagaaauuggcucgugauuauagaggcugacaaguucgaaaucuguaagacagaccagcaggcaagaaacagguaaaagcucaaguugcagucuugaguuugaaauaaguauagcaggucagcagucaagacacucaagcaggauuucuguguuccaguuuugaggcagaauuccuucuucugggaaacuuuaguuuuguucuuaaggccuucaacuggcuggaugagcuccacccacauuauugaggguaaucucuuuuguaaggucaacugauuauaaauguuaaucacaucuuuacaaaauacccucacagcaacaucuaaacaguguuugaccaaauaacuggguacuaaggccuagccauauuaacugucacacauauaucuuuaaugacauucccacauaguugaagcugaguacguuaaaccuacuuagagacuucuguuaaacagaagcaaaaagaaaaagaauuauacugcuuuacuccuaauucacucagauuucaugaucacccuuuuagaacuuggucuuuguagaagauauguaaaaauaugacuaucuuuugcuucuaaaaggucuccuuagaauagacucuuuuuuuuuuuuuuuuuuuaauguuuuugagacagagucucacucugucucgcaggcuggagugcagugacccacacgaucucggcucacugcaaccucugccucccaggcucaagcgauuccacugccucagccucccaaguagcugggacuacaggcgccugcuaccaugcccagcuaauuuuuguauuuuuaggagagacaggguuucaccauguuggccaggcuggucucgaacuccugaccucaaguguuccaccugccuuggccucccaaagugcuaggauuacaggcgugagucaccgcacccaucccgaauagacuuuuguagucccuuaaguuaaccuguaugaaguuauccucuacugacaacauucuuuaaaauuucaagucaucaggaugaccaaacugagaaccucuuuuccguuuuucuuagaucucaggccccaauguuuagaccggacacaacucaccuccauccacagcaccgucgacucuugcaucagagacagcaacagaauagaagguaaguacucauccgauuccuuuauggcuucuuaauucagcuuuuaauuuuaacaguguaacaacaugcuauuuaguuguuuuguuuuuuuuaguaaguuuacuucauauccauaaaccuggauguauuaucaacauguaaauaugaaaagcauaauauugaguaaagaagcaaggaacagaauuauauguaccauuuauguaaaacuaaaaggcacacggaauaauacuguguaauauuuaaagacagacacacaaguaauaaacguagaaaaacauuucagggaggauacauccauaccaagggcauaauagugguuccucuaugaaggaagagaagcuggaaacugggucuagagggguacaacagggccucugucaguguagcacuguguuauuuuaauauuacuuuaaaauauuugaagcaaauucaaccaaauacauuuuuuucuauugggucuuggugauggguaaauggauauuuaugauaguauuugcugggcuuuuucucugcauuugaaauauuucgugauuuuuaaugaguuaaaacaauuuauguagacuucagagcuaaaucgccuguguuaaaaucccuuaguccaccacuagauguauggcuuuggacaaauuacuugaucucucuuggcaucgauuuguugucuuaaguggggaagagaaaacuaccuaccucacagaguuauucuagagcuuauacaaaaguccauaggugaauaugcuuagcauaugguaagguacucaggucuuaguuuuauuucuucauuauuuauuacauagcucuuuccucuuaaauucuauuaagacuuaguucuuuuucacuccccuuuuaagaaaagcaaacgggaaucuuuaaaaaaaaaaaaaaaaacuggccugguuuauuccucuguuguuaaaaagcguaauuaauuugcccacauggaaugaaugugguguauguuuuucagucagcaucggaaucucaauggugcgggagauagaggaagucaccggagcagucaucaagaucaucuccgaaaggauccauaugccaaucucauguugcagcgggaaaaggauugggucucuaaaauccagaugaugcaacugcaaagcacugaucccuaccuggaugauuuuuauuaccagguaaauacucugugcuaguuuugaggauaauaguuugguccccuacacuggugaggguauucauuuaaauauugguacaauuaaauauuuguaaaauuuucuuuugagguacuuagcaucuugcacuauucacuaucaguauauuucuagagcugaacuuguguuacugucacuggcauaaauuauuugaugguaaacaacagucguguucugugcuuguguuacaacugaaaucaucuucucgugguagaauuacuuugaaaaacuggagaaacugucagcugcugaagaaauacaaggugauggcccuaagaaggagcgcaccaagcuuaucaccccucagguggccaaacuggagcacgccuauaagccagguaagguccucauaagaaaaaugcccauaauaaaagaaauuugagaagcugcugaugugauuaaauauagacaaguguauauguggaaggauaugcaaagauguuucaaagugauuuuaaaaguaccauuguucuuaauaaaugcaaaaaucagccuuuauucacgucuggacugaacgcuuugacaugugccuuuuuagguccuuuucuacuugagauuucaugauuuuuuaaauguguuauaauuuucaguaccccuaaaauaaauaagggggaaauacuucagauuuuuauugugauaauuauuguaacagagagaaaggauagauuuugauaagggguugcuuuaaauaauacauugauuuuuugucuuuuuuuuuuuuuuuuuuuuuuuuuuuugagaaagagccuuacucuguuguccaggcuggagugcauuggugccaucucagcucgcugcaaccuccaccuccugggcucaagcgauucucaugucucacccuccugaguagcugggauuacaggcgugugccaccacauccagcuaauuuuuguauuuuuaguagagacgggguuucgcuauguuggccaggcuggucucggacuccuggccucaagugaucuaccccccucggccucccaaagugcugagauaacaggugugaguuaccacacccggccuaaaugauacauugaguuuugcaguaaguuauuagacuaugaguaagggacagaggaaaguaaaaaucuucuuugaacacugccugccugcauugcugacuuuuuauuuuguuggaauuuuuuuuuuuuuugucuuugcagugcaauuugagggcucuuugggaaagcuuaccguuucuagugugaauaauccccgaaaaaugauugaugcuguugugacaucucggagugaggaugauguaagugucaacacaauugucuguuuaagaacgucugauuugugaccacuucuuuuggggucaccauggaaugagaucaggcaugguagaguuguuuguagucuaacccggggccucccaccucgucaugcauucuaguuuuccacagaugugcugcaguauuaacaccuucauuucuaaggcagccaggcagggacuaggguggcaggagucuuuggauuggguagcucuggcugcaaacagcauguauuuacuccaguuugauguuaaaaaaauuaucauuuucuauguguuuuaagauuuucaggaagaggaucagaaagaauaauuauggggcacuaggcuuaguaccugggugaugaaagaauuuguacaacccccaugacauaaguuuaccuauguaacaaacacauguacccuauaaccugcacguguaccauugaaccuaaaauuaacguuuaagaaaaaaaaaagauuuucauauuucauaugauuuccuuauccucuacuaagguugcccuuugccuaucugugaauggaauuuaauaguuuguggauugauucagucaacuuugaccuuuguucauacuaggguuguuuuagauuauuaacuuucagagaaucaauuaucuucucaaaguauugucacaaaugaaccuacaaaugcgcacuugguaaauuauuuuaacagagauaaagaauuugcauugaauagucuucucuuuuuuaggagacaaaagaaaaacaaguucgagacaagaggagaaaaacccuuguuauaauugagaaaguaaguuuagaauuuguugcuguaguuaguuucaaauacggaacugucaaauguauguauauacuagaacugaaacagugagcaaucagucaauguucuuugguuuuaauucaugaauauauugcugguaagugacuauuguguaccacauaacuuuggaaaggauuaugguauguuucaccuauuggcaucauggaaagaacacugcaguuaaaguuggaaguguauuggguuuuuguccaagcuuauucaguuaacagcugagugucugggcaagucaccuuucuaagccugauaaaaugggaaugaaaauuacauuguccuaccuguggauuaauuuaguucacagauauuuacugggcacuauucugggugcugaggaaaauaauggauauuaauaguugauuuguaaaauguaaauaccacauuguaaggccauacaccauagugguugaaaguauggacucuagaaccaagcugcaaaucaugucuuuuuccauuucugagucuguaacuuaaggcaaguuauuuaaccuuucuaugcuguccucaguuucuuuaucuguaaaaauggagaugauaguaguaguuuucucuuuggauugcuuuuuuuuuuuuuuuuuuuuccuuuugagauggaguuucacucuuguuccccaggcuggagugcaauggcgagaucuuggcucacugcaaccuccgccuaccggguucaaguaauucuccugccucagccaccugcguagcugggauuauaggcaugugccacuaugccuggcuaauuuuguauuuuuaguagagaugggauuucuccauguuguucaggcuggucuuggacucccaaccucacgugauccgcccaucucagccucccaaagugcugggauuacaggcgugagccaccgcgucuagacuauuuuacugucuuugccugcuagaauagaagucagagagagacaaagaauggugguuugaggaauuuuuuaaguuauuucauaugguuuucuacauuaaaaaaaaaaaaaucucagucuuucuauaaugaguuugucuuuagcuaguaguccuaaacugugaaauuguuuaacuaauacugugguucugaccuagcaugcuguggccugcuuuugucucccuucuuagaccuacagcuuacuccuugauguggaggacuaugaaagacguuaucuccuaagucuggaagaagagcgaccugcccuaauggaugacagaaagcacaaaauuuguagcauguaugacaacuuaagggggaaauugccuggacaagagagguaagcaucgugcaguuugaggaaaacauuaacuggacuccuuccucugucauaacuggauuucauacauuuuugccuuuuagguacacuucccuaccaucucuguaagcucagaaucuauccuuuuagccuaacucaaaugccacuucauuuaaaauacgaauuaucuuuuccagugaggaaagaaaaaaaaagucuuuauccugaauuuauucauucaacaaauacauaguaucugcuggggacagugcuaggcacuagagauauaguggguaacguuauuggguuuuugugcuuacagauugcaccugauuuaugauuacuagcauguuuaaccuuguaaucuuuauauauuuccuuuauuacuaagaucagauguacaaacauuuauacuuccugggauuuccacaaaauauuuauauccuaucgaaacccuucagucuuccaauggggaaucccucaccuaccccauuaucugcaaaagaaucuugcugauguuaaauguucuguaaauccugaauacuuauucgauguauucaagagaacuacaacuucuaacaacucccuuucuuuuuacccguucaagagaauuacuuauccuucuaagccaggacauacacaaaaccaaacauaagaauaagcacuuuguuuucaacacaccgugucuggaguuaggcugacagggaacugguuaaauaaaugguuuauccauagauuggauguuaugcagccauuaaaauguauguaguugaaauauauuuauugacauggaaauaaguuguugagugaaaaaagucaagguacaaaaccauaugaauuauaugggcccauuuuuuuaugaaagaaaaaauauauaauacaaagcaaaauguuguuuaaaaugguaacacuaauuaacucugaguugacgaauguuuuuauuuucuuuuuucuuuuuuuuuuuuuuaagcuguugcuguuaaccauaugguauuugugugguuacuuaaaaguuaagagaggaggccaagcacuuugggaggcugaggugggcagaucacuugaggucaagaguucagagaccaaccuggccaacauggugaaacccugucucuagaaaaauauaaaaaucagcuggucaugguggcgggcaucuauaaucccggcugcucaggagacugaggcaggagaaucacuugaacccaggagguggaggcugcaaugaaccaagauagcgccacugcacuccagccuggguaacaaagcgggacuucgucucaaaaaaaaaaaaaaaaaagaaaaaaaguuaaggaaauuagugcauacaguuggccaaguuuuuuuuaaccauauaauuugugaaaugauuauuuucuacauuuguaagaccugaaaauuuacuuuuuauuugguugagauuuggagaagugauuccuacuguuuuauaguacagguuauuagagaaugaaaaugaaugcaguauauucauucaguaacaucuaagaggaaaaaaaugaggguuucuuaauuguucuugcugaccuaagcuggcauuuuucuuccuugcaggccuagugaugaccacuuuguacagaucauguguauccgaaaagggaagagaaugguugcccguauucuuccuuuccucuccacagagcaagcagcugacauucucaugacaacagccaggaaccucccuuuccuuaucaagaaggaugcacaagaugaggugacuaugcaagaugggacaucuuucuuuugagucuuuauaagugauaagauuucuagaaugcaaacuuauuuuccucuccucuucccuuuuguauuuuugucuaaucuuuggcugugugauuugauuauuuaaaacaaaaccuuuaguauuucaggccuauauuuuuaaucccauauuugauggaacagacuauguuucuaaacaugagaaaaacaacaauucccucuuacuugacauaguuguaaagauguggucuguaucagaauuacuugcguagauaauucaacuccaccccaaacugcugaaucagaauuuacagaaggauuaggguuuuuguaucuuagucuccagcugaaucugauguucacugaaguuugaaaacuuauagucuugguuauuuugcuagauaugaaguaucauucauuguucuguuaucaguagcuuaacauuagccuguagacuuaguuaaaugguaucccacagcaacugagcuaguccccuuuugguuuuuuuuuuuuuuuuuuuuuugagacagaguuuugcucugucacacaggcaguagggcaauggugugaucucggcucacugcagccuccacaucccaggcucaggugauucugccaccucagccuccugaguagcugggacuacaggcaugcgacaccaugcucggcuaauuuuuuuuuuaccuuuuguagagacaggguuuugccacauugcccaggcuggucucaaacuccuagacucgugcaguccucuugccuuggccucccaaagugcugggauuacaggcuugagcuacuguguccagcccgagccagcccuuuaaauaauuuuuaucaugaucuagacuaggcuggaauuuuaacaugguuaucacauguacaaguuaauucuugguuagaguuuuucucuccuuauccuugucauagcacaccugaaagaugagcaaaauuuagaauagucuuaagaaguucaaaauaagaaacugauaaaagugggacaaaggaugaauauuaguacaagauucagaauaguagaauauaugggagugaaccuguuauagacuacaaguugaguaauaacgaucuaaguaaugaguccccagaaaacacagaauaccuuauaaaugguaugcuaugaaagggaaauuauucuuucauagauccuugaaauguuagcaucugcagaagaaaugaaugagaaguuuaggucucauugaaaaaagugaaguggguugggacaaguauauauuuaaaagauuuggcugggcacaguggcuuacgccuauaaucccaacacuuugggaggcugaggcaaguggaucgcuugaggccaagaguucaagaccauccugggcaacauggugaaaaacugucccuacuaaaaauagagaaaaaaaagaaaaaaaugagcuggacacaguaguauaugccuguggucccagcuacucaaaaaaaaaaaaaaaaaaauuccacaaaugaaaaaugaguuagggaaaaguuccaguauuugagguuuauccuagaaaauagaagaccagacuaaaaaaguaacagcuaccuuagagcauauaauuuguaagcaguguaaugggcacucauaaucccaccagagcucuuguguggaaacaaguuugggagauaauuugcugaauacuucuaugugccaggcauuauuuuaccuccuagaaauacaacaccuaguucuaggugcuaaaagauaagaaugcaaaaaugccugcuuucauggagcuuaccugcuaggaggaaagcuuggcuaaauaccuaggcugauuuuuaccuguauguuuuaaggaguaauaaaccacaucucuaaauaccauuuucuugaaguaauagcugguucuaggucugaaucaugaaauguacaagauauccuggaauaucuagugccagaaagcaaggaaguuaauagauuacuagaguccugucuaaaggauacacaaaccaacuucaagagacucauacuggccaaaaguggaauaauuuucaucagaaagaacaguuacagcaguagauugaaauauaucaaauauauuuaaugagguaauaguguuaaacauauauugaucaccuuuggagacuacuaggccaucaacccacuauucagaaaauugguaaauaaaggaaaagcauuuauccuaccuuuccauuacaaccaaaugucaugguaaucagagaguugauaauacaaaguucuuuguagaagaauuuuagcuaauaaauacaaaagaaaugauaaaauuagaaaauaacuguuuuugcaagccucaacagagaagcagucaaucuagacagcacucauuacuggcugcuaaaagcaguagguaaaaaguggauggggggggaagugaggggcaccucugccuggccgccccuacugggaagugaggagccccucugcccugccaccaccccgucugggagguguacccaacagcucauugagaacgggccaugaugacaauggcgguuuuguggaauagaaaggggggaaagguggggaaaagauugagaaaucggaugguugccgugucuguguagaaagagguagacaugggagacuuuucauuuuguucuguacuaagaaaaauucuucugccuugggauccuguugaucugugaccuuacccccaacccugugcucucugaaacaugugcuguauccacucaggguugaauggauuaaaaaaaaaaaaaaaaguggauggggaacuuuacagugguuggagcagccuggcaacaccugaacccauuaaugaacucuuaacaccucuaagagugggacaaccaagcacugugcuuuuuuuuuuuuuuuaaaaaaaaaaaaaaaaaaaggaaacgaagucucccuauguuguccaggcuugucucgagcuccugggcucaagcaguuuucccaucucugcuuccuaaaaugcagggauuacaggcaugagccaccauaccuagcucuucuuggcauaaugcaauggaaaauacacaguucuauccaugacguuuucucacaugucccucccacauccuacugaaccugaaucaaauaaaccuguuauucuaacuaucuguuuaggagggaaacagaggauagcagaaccugcuaagugacacugccaacaugcaguuugccaaauucaaacuauagaacaaaugacccaguuucuuuaacagauaaauaacaagagaaaagggccaguggcagaagaccuguuagagagauuuuaaaaaccuuaccaggcaaaugcaauguguggaucuuguuugaaccauaauuagcacaauaaugguucuaauacaaaguucagcugcuaaaagauauuuuuaaaggcauuugagggaauuugaauuugaaacagauacuagaugauauuuuaaaauucuuuccugagaaauggucuaugaagaaaaauuauuguuuauuuuguuagguaugauauugugagagauuuuguuagaaauacaaacugauguauuuugggaugaaaugauaugauacagaaggaacauagauuuaauaagauuggcaaaauguugauaauuugguugauguugaaauuggguggugaguacaugaaugucauuaugcuguuguuuguauuuucauguauguucuaaaaugaccauaauaaaagcuuuuuuaauuuauaguagaccacaaaaaauauuuuauuccccauuugcaguugccauuuaaaguaaaaccagccaucacuuuauaccaugugcauugauugucuggaagcacucuugauuuccuuuguuguguuauaaccuaguuauuuauauuaauaguucuuuauuuuaacuuuccaguuggcuacaugacaaaaagaaauaaaugacuagaaggcuggaauucaacagccuuggguucuggcucuagcuguggcuauguaacuccaaacacugaguuucugaucacuuuauagauucucuaaaaaucuauaaaaauuggcuaauuauuucuuuucuuccucauugagcuuuuauaaaaauaaaagaaaauacauuaaaucugaaaacacuucuuuugagacagggugggucucacccugucacccaagccggaaugugguugugcaaucauaguucaauguaaccuugaacucuuagacucaagcaaaccuaccaccucagccuauugaguagcuggggacuacaggugaaacuuuuuuauuuguuguagagaugaggucucacuacguuguccagacuagucuugaacuccuggccugaagugaucuucugcuuggccuuuaaccuaucuuggagugcuucucacaguauauugaaauggccaauuaacccauaucuucuccgcuauacuuuagaucccugagguucuguguccuuuugccauuuguuuuuagcccaugguguaguguaagcauuuaaauauuuauggaauuaguuaaaauauugauguuuuagcauaacucuugguauguauuugggagugauuuuuuuuuacaccuuugguucacacaagucaugguguuuccaaugcaaauugagaugaaaaaguucucaguagauagcuuagaauucauuauuaagacucuagucauaucugccagacuugugccuuaagugguugaauauacaaaugaacauccuuccauccaugccccuggugggggguaacugaaguaacacgugccaggauauaaugcuuuuauuuguuuuuuguaggugcugccaugcuuacugagucccuucucucuccuucucuaucaucuuccaucagugaguaucaccagccuuuugcgacagcuaaugaaccuaccucaaagugcagcuacaccagcacucuccaauccucaccucacugcugugcuccagaacaaggugaucuugcccuuuuaacuccuugaacuuugugaaaugucuuaauuugcguuauagauuaaaauaauggcugcuguaucucuagcaacuugggaaaaaggcuucuuucagucaagaguuacauuaagcuccuaguaaccggcuagaaauaacaguguuuucaacaaaaugggauuuuaugugucuagugugaaauaaauuugauuuaguagcucgacagagucaucagggauccaggcuuuuucacuuuuuuuccucugccauucuuaccaguggcuuccauguucauuauuccucaugguccaagauggcuguggaauucaugauucagcuuuacaucaagaaggacagguggauguggagggcaaaaagauguggaccagcuguccaucuuccuuauugagaccuuuuccaggaguucuaaccagaaacuucuacuuacuguuaauagccaggacauugucacauggccacaccuaagugcagggaaggcuggaaaauaucuuuuaguuuaugccauugucaugacacauaagaguucugauaauggguaggaaggcauauuaggcaauuagcagucucugucauaacacuaugaauaguagaaucauccauuucauauuuuauuugcaucaaguuuaaagauucagagauuccuaggggaaacauaauaugaaauaaagaauaugaauuuuuaguccuucccugcuacugucuagcuuugugaccuuggacagaugauaucacauugcugaaucaguuuccuggucuauaagauggaggugaugauguagacuucauagaguuguccugguacuuaaaugagauaacaguuguaagugguucgauauaaugccugguacauaguaguuacucauuaagggccauucuauguacaguagagaugaaaaaguggucucaaggccucuugcuccuuugcaccagaaaaccuaccaaagcaugacucuaaaggucaguguaucagaggaagaagaggugacagugccucugggguucuggagugauccggaaugugccuuucuguuauuuggucucuuaguuuuaauuuuaguaaaggcaguaguauuuuuuuucugagaauaacaugaaaagggauuuuuuuuuuuuaaaucagggucuucucugucacccaggccagagugcaguggcaagaucucggcucacugcaaccucugccuccugggcucaagccauccucccaccucagccucccaaguagaugggacuacaggcacaugccaccacgcacaacuaauuuguguauuuuuuguagaggugggguuucgccauguuguccaggcuggucucaaacuccugagcucaagcuaucagccugccucgaccucccaaaguguugggauuacaggugugagcuacugcaaccggccaugaagggaaauuuuguggaaaagugagugagucuagaaaguuggaauggaaucccaaaguacugccagccuuccuuuuaugauccauuuauagguaugagucauacauuuaaccuaaaccuucuugucccuauuuguauuuucuuuuuugagacaggaucucacucugucacccaggcuucagugcaguggcacagucacagcucauugcagccucaacuuucuguacucaaagcgauccucccaccucagccucuugaguagcaugugccaccaugccugauugacuuuuuuuuuuuugagacagagccuugcucugucacucaugcugcagugcaauggcgauaucuugucucacugcaaccccugccucccagguucaagcaguucuccugcgucagcccccaaguagcugggauuacaggugcccgccaccauaccaggcuaauguuuguguuuuuagcagagacaggguuuugccauguuggccaggcugguccggggcuccugaccucacgugauccaccugccucagccucccaaagugcugggauuacaggugugagccaccacacccagccuccgauugauuuuuauauuuuuugcagaaacagggucucacuauguugcucuggcuggucucgaacuccuggacucaagcaguacugccuccaccucccaaagugcuggaauuacaggcaugagccaccaugcccauccccagcccccuguucauuuuuuuuuuucuuuugagauagagucuugcucugucacccaggcuggagugcaguggcgcgaucgcagcucacugcaagcuccgccuccuggguucaagccauucuccugccucagccucccgaguagcugggacuacaggcacccgccaccacgccuggcuaauuuuuuguauuuuuuaguagaggcaggguuucaccguguuagccaggaugaucucgaucuccugaccucuugauccacccgccuuggccucccaaagugcugggauuacaugcaugagccaccacgcccgucccauauuuuaauccuaugccccaaagacuacauuuccugauuuuacuguccacuaaauaaaacacauuuuuauauguuacuuuuuuuuuuuuuuuuggagauggaguuucacucguguugcccaggcuggagcgcaauggugcgaucuuggcucacugcaaccuccagcucccggguuccaacaauucuccugccucagccucccaaguagcugggauuacaggcaugugccaccgugccuggcuaauuuucuauuuuuaguagagacggaguuucaccauuuugaucaggcuggucucaaacuccugaccucaggucauccacccaccuuggccucccauagugcugggauuacaggcaugagccaccacaccugaccauuuuuauauauugcauacucuaaagcauguugcugaauuuuaauuauagauacgguguauacaucuguuuacccuuucucucuuuuuauuuuuuagauuuuuauuaacauucugucuaagacuuuguauuuccagauagagaugugcuuuuuaauggaaaguuucucuuuauaccauguuuauuucaguuguguuuauuuguauauuuuccuacaguuuacaccuuguuucuuaauucaaaauaucuuacuguaaugcuuuuuucuuauuuuuuccugauuuuuaauuucuguaccaaaauuggucuucauuuacuuucuuuuuuagccuauuucuguucucauaaauaggagaaaagucaaauucuacauuauccauggcaaggaaaaaccaucuuuuaaccucagcauggggaacagagaggcguguuggacaccaugacuuuccguuucuguuggcugcgccuggucacugcuauggcagaauaaagccuggagagagacauagccuuucaacucaugcuugucugaucuuuaccugguuuuacagaaaagcacaguagugagguuauuuugauuuagagcuguuccccaucugaugccaggaucccuucaacagugguggaggagguuuagacacaguguugaguuugauucccucugucuuuucucguaguuuggccugucacugcuccucauccuccugagccguggugaagaccuacagaguucagacccugcuacagaaucaacacaaaauaaucaguggucaguguggacuguuucuucucuuauuuuaaguucuuugagguaaucuuuuaaauuuuuuucuccugauauuauuaugggucuucccugucaggacggaggugauguucauggcaacacgagaacuucugcggauuccccaagcagcccuggccaagccaaucucuauaccuacaaaccuagugucccucuuuucucgcuauguugaccggcagaaacugaacuugcuggagacaaaacugcaguaaguuugaaacaggagaguuucacaucucacuaaaguugggacuuuagaaguuaugguugggaggcuggguacgguggcucacaccuguaaucccagcauuuuaggacacccaggaggguggaucacuugaggccaggaguuccagaccagccugaccaaaauggugaaacccugucucuacuaaaaaaauacgaaaauuagccaagugcgguggugcaugccuguaaucccagcuauucgguaggcugagguaugaaaaucauuuaaacccgggagacagagauugcagugagcugagaucacgccacugcacuccagccugggugacagagcaagacccugucucaaaaaaaauaaauaaaaagaaguuaugauugggguggaggggggaauaaaacugaauuugguggaagagauugacuuuuuauuaacuauuuguguaucuguuagauauaaaacacugaacuggguacaacagggccuucauaaaagaugaccaaaugcuaaggguagagaaauaaucucggguauuuuguuaugagaagucuuacaaagauguaacuguaauaugaaagauugccuucuguuuuaacucauuuauacaauuuuccuuucucuccuuuguacuccuaggcuaguucaggggauacgauaaaagaucuccaaauguguccuguaccuccuuuuggcugccaccugcacugcugccaucaccaauggaguguuuuuaaugagggaaggaagguagcuuuuuccccaaagcaaagucuugugggaucgauuccuguuuacagggguugucucucuaaaugucagauauuuccccacugcucuaugaaauuuggcugggugauacuucugcugguuucuuuaccuucuguguuacaguucugcauguccuacuuuuacucaguucuguuuugcauuuucuuugcccuagagacacaaguguaaucucucccuuuaucccuccacuacuccaccucagaguagauuguagccugccaaaggauuccuucccucauccuauugaaguuguuuuuucauugccccauauuaauaugacuauagaagagccaauuaaguagaaaucaagauauacacacacacauagauacacacacacacaccccauacauguauuuauguggucuucagaggguccuuaaagaaugaauuuuagauugaaaaauauuuaguugucucauuaccucuucuaaacacaaaccagcugauguauuuuaaucuguuucuguucuaucuuguaauuaauuugguggguucuacuuguuuuaacauaaauaaagaguaugcagcacguuuaauaaaaucagaacucuuaauuggcuuaugcccaggucuaggcugagaaguccuuuuucuucuucccaccuuuauuuccuuaguuucuguccaccuuaaucgaaacaacacaugguuaugucuuuuuccugcuacaacuacaggguacuugagccuuuccccucaagugcauucgaagucacccaggaugauccucacuaguagccugcuuuggcaguguggcuuuuugcacacuugcccugucuuccugagacuacuucaguaagccaugcuuccuucuuccccacuuuuauuuggugucaugaauagaaacuuccaaauguaaccauggaagcuaaguuuggccugcuuugcuuuuuagucuccacaccaugggcagaacugcugucuuuacuacuucaucucacccaagucccguucccaggcagccaggggccuggguuugaauaauugcagggccagccugccaugaucuuucucacuuacuccucucccauucagcaaucaaccagacuaaggaguuuugaucccuagugauuacagcccugaagaaaauuaaaucugaauuaauuuuacauggccuucgugaucuuucugcuguucuuacuuuuucgaauguaguuggggggugggagggacagguuaugguauuuaaagagaauaaacauuuugcacauacauguauuguacaacaguaagauccucuguuaaaaccagcuguccuguucuccaucuccauuucuucccaugcuguaaccccaggcuccaccagcuguuccccagugauguuaccuagcuucccucuaccguugucuacugaccauuuccacuacaugccuuuccuaccuucccuucacaaccaaucaagugaauacuugauuauuaucucuuccuuacugugcuuuaucuuuuuuguuuggauugguucuaauuaaugaaaauaaaaguuucuaaauuuacauuuuuauaggguauuguaaauaaaaacaaauuguauacuuaaaaaugagugccugcauuucuacuuuguuaccucugaauaugauuuuuauguuucuagcauauuuagauagacugucaacuucuugauguaggggauua

SEQ ID NO: 18764 - RNA, 939 nt, Homo sapiens
ugaauggagauggaaaacugcaccaggguaaaagaauuuauuuuccuuggccugacccagaaucgggaagugagcuuagucuuauuucuuuuccuacucuugguguaugugacaacuuugcugggaaaccuccucaucauggucacuguuaccugugaaucucgccuucacacgcccauguauuuuuugcuccauaauuuaucuauugccgauaucugcuucucuuccaucacagugcccaagguucugguggaccuucugucugaaagaaagaccaucuccuucaaucauugcuucacucagauguuucuauuccaccuuauuggagggguggauguauuuucucuuucggugauggcauuggaucgauauguggccaucuccaagccccugcacuaugcgacuaucaugaguagagaccauugcauugggcucacaguggcugccugguuggggggcuuuguccacuccaucgugcagauuucccuguugcucccacucccuuucugcggacccaauguucuugacacuuucuacugugauguccaccggguccucaaacuggcccauacagacauuuucauacuugaacuacuaaugauuuccaacaauggacugcucaccacacugugguuuuuccugcuccugguguccuacauagucauauuaucauuacccaagucucaggcaggagagggcaggaggaaagccaucuccaccugcaccucccacaucacuguggugacccugcauuucgugcccugcaucuaugucuaugcccggcccuucacugcccuccccauggauaaggccaucucugucaccuucacugucaucuccccucugcucaaccccuugaucuacacucugaggaaccaugagaugaagucagccaugaggagacugaagagaagacuugugccuucugauagaaaauag

SEQ ID NO: 18765 - RNA, 4486 nt, Homo sapiens
acagaggguuucuuaguauauacuuuaaugcauguuuaugugcaaucuuguuaguggguauacaaguuugugaagaacuucucauuucaauaggcaguuaauguaaugcauuaaaagccugggaauuuggggcuauauuuuuccuuucugacucaauaaucuucaaagaauucauaggaaagucaguacuugcagacaagugguuagcuuggcuaaaauguacaaaacacccagaacccacaaaacacucagagguuuaggagaauguuuuaaugcuuaagaggcaggaucaagugaagagguuacagaaaucagugucucuggcugggcagucaagagagcgggcucaaauucugugacucacuucucugugucucgguuggaaaugaauggguauccugguucccaccuucccacacacugugauacuucaaacuccuugggugaagggccucuucucagcccaagaucuugauugugaacauuaacaaagagaacagucauccuccacagaagauaacucauuaaugacauuugauucagugaauaaauauaucauuuaaaaaaauauuguagggggaucaugaaaguaguggagguaauuacaaucaggagagauugguauuaaaauugagcaaagucccaacucucaccagaugacaauuaugcauccugcuagaugccccagggcugucagccuggaacugaaauaaauguguuauaaguggugcuggaugccuuuuucaguucauuugaaaacauggauuugaucaugucagcucccuuucugcuggaaaaaaaaguaguuugcauaauugguguuaacuacucuguuuugauucuacagaguaaguaauacucaaauguggucuuacuuuaacuucuugccuuuguuacccccagaaccaugcagacauugaaauguggugugcguguguguguguguguguguguguguguguguucauauaacaggaggacaggaaagguaaggacccagaacaaugaagacuuauugaaaugugguaugugugugcguguguguguguguguguguguguguguguguguguguucauauaacaggaggacaggaaagguaaugaccauccauggaagaugaagggguaguacuuagcaccagaaucuuuuccaguuuuuacccaucuuucauuacuccuugucuccaaaucaucccuuccuuaauaacuuaaaauaacuuaaaauauuuucugaggacuugaugacaccagucagaaguccaagaguggucugguauaagggaguguucaucaaggggcagcuggaaaaaguggaauuggcacaggcaacaucuuucuuuucagauguuugaggucacccagaggagauaacagucugucaacauagagcccucaaaguuaaaaagcaguagccaggcaagacuugugucuuuucagggcucuuccaggcucuaagagugugaaauucagacagguuuuuaaaaaucaaaauaaaaggagaguaguucuuacaggcagaaacucuuagagcucacaaauuggaaacaacugcaaacuucagaguaaauucauagcuuccaaauacaaauguucacauugucccuccgcuauuuuuacacaaaugcauucaggugaagacagcaacacacauugggaaaggacaucugcuuccuauuuuagucccagaaucacuuuugcuucuagucccaacuguucccucuccccaaucccaaccuuauccauguaacaguaugaauuuccuggcccagagaccuaaacaagaagucacgaauauaccuacuuuugguugcacuugccauuucaaugcuuaggaaaacagaguggucagcaaugaccacacuggagaugagagaaaccauuuucggggagagauuuaagcuggacucugccccugcucuugguaaguggugucuccaguugcugcagugccuggaaccaaacucugccuuuccucaauugccugauaugcuuucuucuugaacuuccgggugccguagauggccaaggugauaacaacagccagaaugguggugacccccacugugaccccagcugcagccccuccugacagaccaccaccauccccauggaugacauucauggcccuccgcagcucuaucgguucucccagccuccacuggugggucugggagucuuuaauccaggaucucgcauucucagaauuggucacuaugacaguauugguggcagccugacucaugagggguggccgggugaaaggugggagccuggcagggggcagggacccuccugugaagagcccggauuugacgcaauaggacacuuggcauccaucgcugaugagggcugggugcuggcugaagcccccggggcacuuuuucagagacggugccccuaaaucucuggauauagcaggaucuaccaggggguucccaacugugcagcuaaagaacccgccaaaggggaccgcaaaccugcuucccaacucauaguccugagaaacacauaccuugagguuuucaaagagucucaguggaaaguagccggcugggcaugacugugcauuugucaugggguuuaugcucuugcugcugaagaggcccccaaaaagcaguccugaguuuucagguacuuggcugcuggccacacaccaaaaagcccuaaauucagcuuuugccaccuggaacacaucuucacacacggucuugcagaagacgaggagagugcacuuucgaugacacuccaggugguuguaacccuccucguggaucugggauaacaggugcaccggggaguagccagaggggcaggagaaaucaccagugaguggauucuucugcuccaacuuuuggcagaggaggacaucccuauucccugagagcugagugcauuccugauaaaccccaccgaaagagaaguuggucauuuuccccucgcaggagccaucauccguguuggccugaaaauugaaguugggagaauugagaucugugcagccaggguagguguugaauguauaauagcgcuucacagcaguuuccacugucuuugacaccuucuucaccagggggccuggcaagucagguagcauguugggguugaugaagaaaugcagcggcaggccagagcggucgauggccaccaggugguuggugauacccugcugccaggccuggagggugaugccuggguaaaaaggaaccccuccaaugcucugcacccuggaguugguucgguuugagagguagcucuuggugaggacauucugcgagguauaguuuuccucaaauuugaaguucacgguguuuugaaaggcaaguccagcagaggcggucacggcacuacgacugcucuggcugucuuggaggaaggaggcccugaggugguccuccugaauaagagcagccccagcgucgacacugguggugacgugggugccauaguugagcaccaggaguucugccagguagguggccauccucgucugguuguucucuagacggucagagaugucaaggaguuccuuccuaaaaccugagcuuagcucuaaaguuggguugauuuugacuguguagacgagguuucuuaccugaacucggguaguuauagcuugguccuucacuuggagggucuucauccucuggaacucaguggaaaacuugccauugacuuuggaaaaaagagagaguucuguguugauggaguaggaggugcuacucugguaauuugcccaggauuccaggauuucugaguucaucuccagguugcucuguuucuggggaauggugaagauuucaucagggaugauauacuguccauccucuguuguccugcaguuggaguaagucaauuccauaacucgucccauguccacauuccgcagauugucccagcccccuccagguaggacuuccaggacagguaguuucaaggcauucuugcauuuuugaacuccaacuucguccaucucucccgaaggcuugccugauuuagcccaugcugccgcugcccagaagaggaugguggcccugaaguuguucauggcucagacagccccagccacucaccagcccuacacagcggccagcaagcuuugggcaaacuaagauggagaaaacagaagcagaugaugaagcggaaaacucaugaguucucuaaaagcuacaaguuccucuuuaagcuaauuuaaugacaaaauggggaaacgagaguugguuggaauauuaaagaccaucaggucuuugaagaauuuaugccguacuaaacaugcaaacacaccccuacaugccuaacagguagcuauccuaauuuuucccccagcucuggcugguuacucugcugcaggggugugcacuuagaaaaaaaucccgaccccacacccuacugcuuccuccaccagaaaguuuggcuuugcuuuuugcucauucucuuggacuugauguuucauauuuucccugacugcugucucuugggacuccauu

SEQ ID NO: 18766 - RNA, 1874 nt, Homo sapiens
ggagccggggcaaggaaggaguuggggugcgcgcgcgugugugugcgacugugagugugccagugcgugcgcaagccccgagacaaugcgugucuccaguucgcgcugcggacacugaucaugcugcauuaaggaaaaaaaaagagagagagagagaaaauuacauuugggggaaggaggcugcaaaguugcggcugggcgacagugguggucccggggccgugucauggcgggucgcuucucugcaucaaggaaccagggaaacacacgcgggcgcggguuugccuuagcgcccugcuugggaggggugguucauucuggaaggaacugagcagagccacaggcagggggagcucucccagcggcggggacugcaauucgugcggcgaagggguggggagggagggagagaggggaggggaccagagcgugccauuccgagcgcggccgugcggcgagaucccaccccggcgucugcagaggccgaggcgcaacuggugcgagggcuggguccuugccucgccgucagccccagcucgcggccgccggggcucgggccgcgcgcccgccgaguggcuuuugcaaggcgggggccuguuugcagagagccgggcauuugcaugaagcgacucgaccccacagagcagcggcagcagcagcggaccccggcggcggcggcggcgcgcggucccagccaggcggccccggugucccggccccgguggaugcacggcuggggaggagcccaugggccggagcugaggcugcccggggcggcggggcgcggggcagggggcgcggucgaggcccggaggcggcggcgcaggaggaagcggaggaggucgggcgcucggggcccgggaggcgggccgcgcagcgccgcagccccgggcucgccaugcuccuggccucggccgugguggucugggaauggcugaacgagcacggccgcuggcgucccuacagcccagcggugagccaccacaucgaggcggugguccgcgccggcccccgcgcggggggcagcguggugcugggccagguggacagccgucucgcgcccuacaucaucgaccugcaguccaugaaccaguuccgccaagacacgggugagccagccgccccugaccccgccccgccugcucccaccuucccaaccugccaagguaccucccucccugugaacccaccuuggccaccuagucggcacuucugugcagcagugucaccaagaggugguggugggaggcgauucacuccgcugaauccucgcaggauccucccucccccuuaaacauccaugcaaauaguaucaguguugugguuuugcaaacccagcuucaaccuagucgguaacaauccacuccccaccccuuucaugcccccgcuuuucagcaguugguggcccuaagucuuucuauguagaaauucuagggccgccccagacuacaggcaaucccagcccuucgcaaaggcuuccugcccucaucccguggcggccggcaccuuggcugaccugacccuguuuugcuucaggcacgcuggggcuugccacacguccccucacccccgaucucacugccucugcgucuccugugugggaugccuccccgcagcuggguccugggugugggaacugggggaggaagaagggauuccccggagguucucgcuacagucggguaagggaagcgccgggcucccugggaggagagacuagggcugggguacccuggacgccgcggcauuggcgaaugccucugcuacacacuacaugcgcggaagcaacaggccggagcagauggagagaggagggggaggcucggggcuucggaaugcauggcagggaagccgcucccuuugucugcggagga

SEQ ID NO: 18767 - RNA, 4817 nt, Homo sapiens
gagaccacacuguguacaaagcucugcagaucauaauuuauucaucuaaaggauaauuguuuuuaguucaugcaugccuucugaccugaggcuuugcuaugaagcuucaacccugcucagggaaaacaucccgaguuaaaaauuacauugacugauuuuugcaugauggccccuuagcaagauguuuuacaggccucccuuacuuguucuuuacagaugcaauucugugaauuaugugagagagguaaucuuaacauguuuauuuucucaagaaaggggaagauaaguaauuccuuuaaguucacagaaagaauuaauaguagauucaggacuuuuuccguguuaaugcucuucccuuuauuucuccaugccuaagagaccuugaaaccuguugaccacuaucugaaagcaagcuucuccaaacauauuaaugcaauguuccauggcugauuuucugauugcagaacaacuauucuguauugacuguuucugcucauccagcuguaagguaagcuucuauaucuaagaaacauuuuagagacaaguguaacucaugcaaaagcaguggggcagcuauaccuacuauaagcuauuugagagcagaaauagauguuuucaacauuuuuucuaaaauacugaggugggcauagggcauaaauguuccauuauaggaaauuuagugguucuuaugaaaugugcuucuuccuccaaagauaugaacaaaaaauaagauagaugaugcucugacugacuaggugguaauuuuaucuguuuguuauauauugguuucucaugagugguaaaaaaaaaaaccaaaaacaaacaaaaacaagugaaauguucauucuuuaaacuacaaaaagguguuaaaugaauuaacgagcuaugaccuguguuuuaacuuuuuuuauaaucucauuacuauuagcgcaucuaccuauguugacagugauguggcugaaaguuuugacuuuugauuagauugaagauggauuuaacucuugaaccuugacucucaaacuagucauauaauuuuggagcaucauaucacuucucaaauugucaauguucuuaacgauaaaguaauaauacuaucuaacucucucucucuuucucucucacacacacacaugcgcacacacgcauauacacacacauuauuuauauauaaaguuuuuauuauugguuguagaacauaguguaugcuaaaugcggucagguauguuaaaguuagcaacauaacaccuucauaggucaggcuugggaagugaaguugccaaguguuuaaaagaaagacaguaggaaacaguaguuaguauugguuggacacccuucuccaggccccaauccaaauacacagacuuaaaguauuauuccugauuucauucuuuuuuucauggcuguguaguauuccaugguguauauguaccacaucuucuuuauccagucuaccacugacgggcaccagggcugauucuaugcuuucauuguugugaauagcgugcugaugaucauacagguacaugugucuuuuuaaaaaaaaaguccaacuuuuaaguucagggcuacgugugcaggaugugcagguuuauuacauagcuaagaugugccauggugauuagcuguacagaucaucccaucaccuagguauuaagcccagcauccauuagcuuuucuuccugaugcucucccuccuccuacccaccauccucugacaggccccaguguguguuguucucuaccauguguccaugugguuucaucguucagcucccacuuaaaagugagagcaugcaguauuugauuuucuguuucugcauuaguuugcugaggauaauggcuuccagauccaucuaugucccugcaaaggagaugaucucguucuuuuuuauggcugcauaguauuccaugguguauauguaccacauuuucuuuauccagucuaucauugaugggcauuuagguugaccauauguauuugucuuuuuaguaaaaugacuuauuaccuuuugaguauauacugggucaaauaguaaucuguacacuagauuuauggaauacuacauagcccuaaaaaaugaaaucauguccuuugcagcaacguggaugaaucuggaggccauaaucuuaagcaaaguaacacaagaacagaaaaccaaauaacucauguucucacuaauaagugagagcuaaauuaugagaacacauggacauaaauaugggaacaauagacacuguggacuacuagaggauggagaaagagagggugggcuuaaaaacuaccuaucagaugguaugcucacuaccagggugacaggauccauacuccaaaccucagcaucaugcauauucccacguaagaaaucugcacguguaacccuuguaucuaaaaugaaaguugaaauuuuaaaacauuaaaauaaauaaauacuaaaauauuguuccaaaacaagaauagauucaaauaaaauauuuuaucacauggaacuugccaccaaaucagaucugugagcuaaauaaagauagcccauaaaguaggaaauuuuaacccuuaaucuuugauuuaacuauggaauaacaguaauaagagaaagaauggcuuuaggaaaaagaaacuuuuuuacccacacuaaaauguggauuucaagggagaaauuaagaaaaagaaaggcucaugugaaucuuccggagcagacaaucauuugcuuggaggaagaacaaccugaaaaucacugaagaacacagaaaaucucagugguccuagcauggaggaaaagaaaauuggaggugggagcuucaagauuucaaagcucacccaugccugcagcccugcuugucaccauccaccuuuaucaaaccaacaaaaagauuaucaccuaucuaauaauaauauuuaauauuauaacuagcacucauuaggcugugcuuaacaucuagcauuuuuaauggauuaucuuauuuaauucucacaauaauaccucaaaguaggucacauuacuguuuuaguguuacagaagaaaaugugauguuuaagggaauuagauuagaaccagugauucccaggugguaagucguggacugauacgcaacucuuucaagaacucaagcucuguaucugcucuguuuggugauaggcuucucucagaauuguuucugguaguugaacaugccccaaacaacccuguuaccccagcccauuuacuaagcauauauuacuugcuuacuucauugugaaacucaaaacacugaguuuguaccaaaggagacaaugagugauuguaaauacaguuguauucaauuugauuuaaauucaguuuagaccauuagauuuaggaaccauucagcauggguucaaaaguugguauggguccaaagcauggcuugccauuuaauacuuguauaaauaugaauauguuacucaaccuccugugcuucauaauuuaaaugaaugcaacaacuaaucaaauacauaauauuguagaaaggaaauaaugaauauauaucuuaaaugucuagagaaguucuugguaaauuagcaacaugugucagcuuuuacugugcucaggaaaaguaaauugacagauagaugcaucuagaugagucaucuugaucagguuaguaaauuuuauaaauaugaguuuacacauuuauaauaucuaaaaguuguguagauaaucuacuaagauucuucaguuucaacaguauguaacucuguauaauuaaugcacugcauuugguugucaaggccgcgcuuuuucuagggaaucuugaaguacaaguuauugcuacaaugaaggaauacauauuguacuuauacuuuucaauuuuaauucaauuuauuuaucacacuguucuuuuuuguauugcuacaagcauccugugagucccccagagcagugauggaaaauaagacagaaguaacacaauucauucuucuaggacuaaccaaugacucagaacugcagguuccccucuuuauaacguuccccuucaucuauauuaucacucugguuggaaaccugggaauuauuguauugauauucugggauuccugucuccacaaucccauguacuuuuuucucaguaacuugucucuaguggacuuuugcuacucuucagcugucacucccaucgucauggcuggauuccuuauagaagacaaggucaucucuuacaaugcaugugcugcucaaauguauaucuuuguagcuuuugccacuguggaaaauuaccucuuggccucaauggccuaugaccgcuaugcagcagugugcaaaccccuacauuacaccacaaccaugacaacaacugugugugcucgucuggccauaggcuccuaccucugugguuuccugaaugccuccauccacacuggggacacauuuagucucucuuucuguaaguccaaugaaguccaucacuuuuucugugauauuccagcagucaugguucucucuugcucugauagacauauuagcgagcuuguucuuauuuauguugugagcuucaauaucuuuauagcucuccugguuaucuugauauccuacacauucauuuuuaucaccauccuaaagaugcacucagcuucaguauaccagaagccuuuguccaccugugccucucauuucauugcagucggcaucuucuaugggacuauuaucuucauguacuuacaacccagcuccagucacuccauggacacagacaaaauggcaccuguguucuauacaauggucauccccaugcugaacccucuggucuauagucugaggaacaaggaagugaagagugcauucaagaaaguuguugagaaggca

SEQ ID NO: 18768 - RNA, 1090 nt, Homo sapiens
aaacaucaagugcacagugugagaaaguacuacaguucugugucauuuagaguucuuugacacagcaacagacagacacccagcccagugccccuaagccuucaguuggcgucagaggcugcuuuacggauaauggcacuccucagagcaccuuugacauccuuguuccuaaggcuguaaagcaaaggguugaguaagggggugacaaagguguagaccaacgcgauuuggcuguccucauccucugaggugcuggaccgaggacgcagguacacgaggcugcagcagccauacugcagcaggaccacggugagguggaaggagcagguggagaaggcccggcggcggcccucggcagaacggaugcucaggauggcacaggugaugaacacguaggagacgcagaugagcaggaaggggauggucagcacgaggaugcucacgacauagaggacagccuggugcacgcggaugucagcgcaggccaggcgcaggacgggaggcacaucgcagaggaagugguugauuuccuggugguggccgcaaaagggcagggugaagauuaaggcggugagcugcagggaggggaagagggccaggcccagggccccacccagcaucugcgugcacagcucgcgggucaugaugaggguguagugcagcggguggcagauagccacauagcggucauaggccaugaucgccaagaggaaacaguccgugcugccgagggugacaaagaagaacauuugggccccacauccagccaacgaaaugggcuucugggcccccaaaauguuggaaagcaucaaggguacuaccacggugguguagcagaguuccaggaaagacagguuggacaggaagaaauacaucggggugcggagggugcugugugugcacaccacccagaugauggcuguguugccacagaggaucaucaaguagaggaggaggaagagaaggaagagaagaaccuggaauucaguggcuguggugaacgcacggaacacaaacucagugggcucagacugguugaagacaaguuuccccacaggcaugucuuaugcaaaagaauaggacgcgcuga

SEQ ID NO: 18769 - RNA, 945 nt, Homo sapiens
gauggcugaaaggaauuacaccguagugacggaguucuuccuuacugcauuuacugaacaucuccaguggaggguuccucucuuccucauauuuuugaguuucuaucuugccacuauguuagggaacacaggcaugauccuccugauccguggcgaucgucggcuccacaccccgauguacuucuuccucagccaccuuuccuugguggacaucugcuacucguccgccaucaucccucagaugcuggcugugcugugggagcacggcacaaccaucucccaggcucgcugugcagcucaguucuuccucuucaccuucuuugccuccaucgacugcuaccuucuggccaucauggccuaugaccgcuacacggccgugugccagccccugcuuuaugucaccaucauaaccgagaaggcccgcuggggccuagucacuggggcuuacguugcugguuuuuucagugccuuuguucgaacggucacagccuucacucucuccuuuuguggaaacaaugagaucaacuucauuuucugugaccucccuccucuauuaaaacucuccuguggggacagcuacacucaggaaguggugauuauuguguuugcucuuuucgucaugccugccuguaucuuggugaucuugguauccuaccuguuuaucauuguggccauccugcagauccacucugcuggaggccgggccaagaccuucuccaccugcgccucccaccucacugccgucgcucuuuucuuuggcacccucaucuucauguaccugcgagacaacacaggccaguccuccgagggagaccgaguggugucugugcucuacacgguggugaccccaaugcugaauccccuuaucuauagccugagaaacaaggagguaaaagaggccacuaggaaagcccugagcaaaucaaagccugcuagaagacccua

SEQ ID NO: 18770 - RNA, 1513 nt, Homo sapiens
cauggcagagaugaaccucaccuuggugaccgaguuccuccuuauugcauucacugaauauccugaaugggcacucccucucuuccucuuguuuuuauuuauguaucucaucaccguauuggggaacuuagagaugauuauucugauccucauggaucaccagcuccacgcuccaauguauuuccuucugagucaccucgcuuucauggacgucugcuacucaucuaucacugucccccagaugcuggcagugcugcuggagcauggggcagcuuuaucuuacacacgcugugcugcucaguucuuucuguucaccuucuuugguuccaucgacugcuaccucuuggcccucauggccuaugaccgcuacuuggcugugugccagccccugcuuuaugucaccauccugacacagcaggcccgcuugagucuuguggcuggggcuuacguugcuggucucaucagugccuuggugcggacagucucagccuucacucucuccuucuguggaaccagugagauugacuuuauuuucugugaccucccuccucuguuaaaguugaccuguggggagagcuacacucaagaagugcugauuauuauguuugccauuuuugucaucccugcuuccaugguggugaucuugguguccuaccuguuuaucaucguggccaucauggggaucccugcuggaagccaggccaagaccuucuccaccugcaccucccaccucacugcugugucacucuucuuugguacccucaucuucauguacuugagagguaacucagaucagucuucggagaagaaucggguagugucugugcuuuacacagaggucauccccauguugaauccccucaucuacagccugaggaacaaggaagugaaggaggcccugagaaaaauucucaauagagccaaguuguccuaaccaucuccaaacuuggaaaaucccgagaaccaccuacucuguagugucagaauucuggacgcucauuauuuauagcaugcucaauguuuaaaugaauauauuaugguacuagguauaaaaaagaaccagaacuuuuagcuccagggagaggaaggaagacaaggaaaagucaaccugaaaagagauuggagugggaguuuugauucccaggacaagugacaaaaggauuugaaauuaaagccugugcaauccaaauauggcacacuucaccugucugugauuauaagaguaauuuuuuuugcaaaauuuuuaaugaaagauuuucaucauauagaaauguuaaaaauaauauguaggaaguuuccuauacucaguacugagauuguguaauugcuaauauuugcugucuuuacuugguuacauagauguaaucuauccgugaguuuauucaucaaucaauucacucaucaaaccaccuuuuuuugauucauuucaaggugaguuccggacaucagcauuaguacccuuuacuucuaugcacuucagaauuauaucaucaauuaggauucaauauuuaga

SEQ ID NO: 18771 - RNA, 5741 nt, Homo sapiens
cucccuucccuccccccuccugcugcuccucagcccccagagauugagcccuggcuggggcuggguggcaggacagccccucagaugaggucagcaacauugaggggcauuuccucaauggagguguuguagaaggucucaaugucucgaagaguccucuugucuucuucugucaccauguuaauagccacaccuuuacggccaaaccguccaccucgaccgauucuggaaaacaaggaaggggaugaggaauaucaggagcuuuaagcccagggagggccaggugugaagggguaggggaguguuccagaucuacgcuuaccuguggauauaguuuucccuguuggugggaaggucauaguugaugacuaaagaaaccugcugcacaucaaugccucuggccuacgucaagaaagacaacucuucagcaugugcacggaggacacucuaucccggagggaagacacuuaggcauccaugugggcagccaaggaaggcagaggaaauaagcaucccaguuccccaaaggccuuaggcaugccagauucuauuccaagcugcuacuuuccugagaggcacugauguccccuuggagagggaaucaccuuggauccucccuucugccuuugcuaucaguucccucuacucaccagcaggucagugguaaucaaaacucugcuagagccagaacgaaacucccucauaaucacgucucguuccuuuugguccauaucuccaugcuggaagagaaaacaaauaugcagcagaccagguaggcaccuggguuccaggaacccuggcuucaaguaggacacuucugacgggcagacccacaacaggcuggcagcgggcaaacacaccauggcggauacagugaaaucucgagcaugcaucuucucggugagccaguccaccuuccuccggguguugaugaagaugacugccugggugauggucaggguuucauacaagucacauaguguguccagcuuccacuccuggagguugggggacaaaaaucagucaggggcuauacccaacaacucacuaccaggcccgccuccugcacugggccccaccucucguuccacguugauguagaacuggcggauacccuccagggucaacucuuccuucuugacaagaauccgaauggggucccucaugaacuucuuggucaccucaagcacaucagaaggcauuguggcugacagcaaaacuaccuaguggaaaaaaaggccagucuuagagugcugguuccuuccugaggccugcucccuucccuagccacaccuaaaacugaagcagaugcauaaaaaggcucaagaauccaguauaugguuccccuggcacuuacuauuuuucaagaaucauuagcuauucaagcaagacugcccucaccuggguguugcuguugagcuuuuggaauaugucauagaucugguccuugaauccacggcuuaacauuucgucagcuucauccaguacaaacaucuugauguauuugggggcuagagaagaaaaaaaaagccaauauauagcauaugauuagggaaaugugggagagauauauccaacuucgcugauaaaaaacagagaggagccaaguagucugcucucagaguacaaagacugauccuuugcccaggaccuucccgccaggcagacaacagcccugggaaguaggacacugccagggcugcacuggcagggaagccagaggcucagaugacacgcaugggcuccaucacagagcagcucuucccccagagagaaaccagcauccuugggaaugacucuggcuuacgcugaaagacuggaaagcgugcacaagagcaaagugacccaggggauuggagaaccgaauuacucacacagguaucuccgguuaagcauaucaaacacacggccagggguacccacgaugauguggggagcuuccaucugcaguuucugcaccucagcacgcacguuggugcccccgauacaggcgugacaggaggcgcccauguagucuccuagugccaugaccaccuucuguaucugagcagagagaggcaggugcucauaugucaguuaccacugugcccggcaccauucuuaaauguuuuucauguauugauuccuaaccaacaacuuuggggcaugcacuauuauuaaacucacauucagcugagaaacaggcagaggcuaaaauccacuuaagaucgugcugucaauagguggcaaagacaggauuucaacucagucugguuccugaguguacagugauucacaaugaggccgcucagauaauuaauucaguuucuuuacucuagauauuuagaacccuuaaccuucugaaaacuaauuugaccaacugccucaucacgcagcaaccauuuuuuuuuucuuuuuuugagacagagcuuugcucguugcccaggcuggagugcaauggcacaaucucagcucacugcaaccuccaccuccuggguuaaauucuccugccugagcuucccgaguagcugggauaaaaggcacacgccaccaugccuggcuaauuuuuguauuuuuaguagaagcgggguuucacuauguuggccaggcuggucuccaacuccugaucucaagagaucugccugccuuggccucccaaaguguugggauuauacgaguugagccaccacacccagccagcaaccaguuuuauagaacaggugaugcauauccauguccuauugcacuccugccauaggacccaagcuacgaggcauguucacucugagaaaacugagagccaagugccuuagaauggagcucugcuguaacuucuuacauuauccacacccagaauaaucacugccccugccacagaacauuuaaaaacaugcucugacaucaguguugcagcaugacccaggaaaaaguccagcauuagaauugugugugccccaggcaugaaacagcucuggcuauuaagcaagggugaaaaggacuguccaucugcucugacuacuguaagaucacccccacaccaagggaucucuuagcccauagugaaggugcuuauucagaacacagucaaacuugcccagccagccaggcuucacccaacagcuuucccauuugacucaggaaauggguggaggaagcaaugguuacguuuggguaagaaauagcuuuuaauuaacccagcaggucucgagaguguuagggcacccaugucuuccucccaagguggugaucagagaagacuucucugguccuuggauuauacucaucaucccuaaaucagcccugaaggagggaauagaagccacucuuaccugcugagccaauucucgagugggugcuaggaccaaggccuggguggcuuuuagaucuaauucaaucugcugcagaaucgauauggcaaauguggccguuuucccagucccagauugggcuugagcaaucacaucauaaccuaaacaaauaaauuaggaguugaaugugguaaagagcauacccuuugggauauucaaguccuagguuaaugaggucaauaagcaaccaaugaaccaagcauuucauggcucacaaacuaccuucccaaucaacacaguuacacaaugggaaccagaucagaaacaaggaccaguuauuaacucaucuaguauugcacaccaagcuggacuagaaacauggcuguagaugcaaauauaagcuggcuacaauaccaccucuuuaaaggaaaccuauguguccaaggcaugaaccaggcaugggcacggaucaaaagccaagcugggaugaacaaggaguugcuuugucccuggcugauaugagaugggcaucaccaaccagaugccacucuacccaggucagggacaguccacaaugucuucugggacugagaggucucacccuugauacaagguagaauggcucgcugcuggauggcagagggcuucucaaaaccauacgcguagaugccacggagaagggacuccgagagguucaugucaucaaagcugucaacaaucucauuccaguuacucuaggggaugcaaagaaauuaaagcuugagucauggaaaagguggagcugagcuguagucuccgagcaaacagaaucuggugccuacuaacaaaagccucagagcuuacaacccuccucccuuuagggaaaccagcugcuucuagaugaucugggaaaucaaucaagaggccacucuaacucuauacggcugaaaguuguaaugggggaggacagaauuccauuucuccagucucaccucgaugacgccuucgggcuccaucccaucggggccauugucucuggaucuguugguuuaaagcauaaguuuuguccccugcccgaccgaagcacucagaaauccugacagccgggcucugucaggaguggccugcaugaugccaucaaucugcugucccagauccaacucccaccagcucccaaaaaauacccaaaggaggaguuucuauaaaacugaggcauuugccccaugcaggcagcggcucaggccaggccacccccgacauaagggggugacccuuucugaagacaggccggcaggcgugccgccgcgcucacggugcccagagguggugcuugccgccggguccacgugggcccgacccagccgcuuaaagcccaagcgcgugcaccucccaccgcagcaccagcgcgcuggaagucccgcccuucaccucccagaucggaggguaggacauccccuuccccccacgucaucccgcccgcgcccucccccacucccuccagccgaagccccccccucgcguugcccggaugugggaggccgcgggcgguggcggccucgcgcacaaugagcccaagccgagcuagcaaagggggagauugcacaacacuuagaagcgaagcagacugggggaggggaacgccucaggccaccaugugcucgcucccucgaccacccggcggcgucucccaccccuccaugaacaauccacaucccgcccgcccccgucgcgaaguagcgucgcccucccauaccucaggccgcucacccccgaaggaagguggaccugcccauccgcaguuugccaauagcccggcuugugcggcaaaauggacccgcccgcccggcgccgggugggcuccuggugccucacgcggccgcuccucgggguuaggcucaguccuggccgucaagaaaaccagcacacugaacggccgguuucuucuccccgacccguguuuuagccgcgacgaagugacuggaucuaaggaccaggcacccccgccucucgcgagugguaccgucagaaugcuccggaaccccgcgcgccgucccucccccggcacagggaggcaaccggaccugccggcucugggccacacauaguggcggccgccuccaccuuucuuucccacgccaggucgcgaccccgucucgccacucagcgccggggcuucgcgcauggcaccgccucgggucgaggccucguaacagaccucgcacgccugacccuagccgggcugucccuacccuccgccucgaccugguggccgcgucggccgugggucuucccccucgccccuccaagucggacccuccccccacccgguucgguuucucccgcaacccuggugggccucucagcuacccccggcgggcccgucggaagggggcggcaaaauaagcagccacaaucucuugcaaaugccuuucuuaccgggaauccuggcucgcagacaugauccuuagaaacuag

SEQ ID NO: 18772 - RNA, 1125 nt, Homo sapiens
uugccaugccgguggaccucagcaagugguccgggcccuugagccugcgagaaauggacgagcggucacagcaccugcugcaugucaccuacgcccgggcggugguggacgagcugggcaaagugcugacgcccacccagguuaagaauagacccaccagcauuuagugggauggucuugauucagggaagcucuacaccuugguccugacagacccugaugcucccagcaggaaggaucccaaauacagagaauggcaucauuuccugguggucaacaugaagggcaaugacaucagcagugacacacuccucuccgauuaugugggcucggggccucccaagggcacaggucuccaccgcuaugucuggcugguuuaugagcaggacaggccacuaaagugugacgagcccauccucagcaaccgaucuggagaccaccguggcaaauuugaggugguguccuuccguaaaaaguacgagcucggggccccgguggcuggcacguguuaccaggcugagugggacgacuaugugcccaaacuguacgagcaacucucugggaacuaguggguuagcuuggggaccugaacuguucuggaggccccaagccauguuccccaguucaguguugcauguauaauagguuucuccucuuccugccccccuuggcacaggugagaccugaccagucagauggugguugagggugacuuuuccugcugccuggccuuuauaauuuuacucacucacucugauuuauguuuugaucaaauuugaacuucauuuugggggauauuuugguacugugauggggucaucaaauuguuaaucugaaaauagcaacccagaauguaaaaaagaaaaaacuagggggaaaaaaccaggucuacagugauagagcaaagcaucaaagaaucuuuaaggaagguuuuaaaaaaaaaaagauugguugccucugccuuugugauccugaguccagaaugguacacaauguguuuuuauggugaugucacucaccuagacaaccagaggcuggcauugaggcuaacccccaacacggugcaucucagaugccucaauaggcaucaguaugucgcucuggucccuuuaaagagcaauccug

SEQ ID NO: 18773 - RNA, 2792 nt, Homo sapiens
auauuuucuaucauaauuaucucucucauuucuuccaauaguaauagcgguaauauuguuccauugaauaucuaugcaccuagcucaucucuuagaaacaucccacauaguagcaucguauuacucucugguaaaaagaaagauuaaauuaaaaggacucuacacagugcugaauuuccugcaccuaaauuauucaguuaucacuugccaguauuaguugauccuucaggcuaugccaagugcccccucauguaggccucuguauuaaaaagauugggacaaaauacuugauuaguuugccuguagaagcucaaaguguguaccaaauacauugacaguggaugcuuucauggcucagccaacacaguucagaggaaucuuuucggcuuccagggcauugcuuguuaccuuuugucaggaucaacccaaauccucagggaugcuguuuuuccacacuguaaguccuaacucauuagugggucaugaaaucaacuuaacagcucaagaccaguauauuuuaaacgugaaauaauaaaaaauagaggaacaauagagcauauaaaaugguuaaguauugguuccugaaauacuguuucagcuaaauauucuauuuacuguguauacugggucacaauauaaaguguuuccuguuaugaaaugcaauuuaaaaaaagaaagcuugaaagacugcugcaggaggcaccggccauccagugauuguuggaagagucuggauuguguggagccugaccuuagauaaggagcagcagauccacaacucaggaagucuagagaugcuuagcacuucuucuuuugagugagaagauggaaucacucuugguuucuaaaauauuuuucuucucugcuguguaucgggcaaccucacaugauucagugggaccagaaaaagcauagaaaaauuagauccacacacagcacccaaaaaaggccauagucuuuuguuuaccuagauguauuuuaaccucuuuaccacuaagcauuuuacuauaauagaacuggggacauacauuguccuuuugaguccguugaaucugcaccaucuaccuuuuggcugauucaccauacagguggcaaaggccuuuaaaaauggggagcuaauacguagggcacauucugguagggccaaaauauucagugucuggggggugcuaugcaaauaucaaugacuuuuuacuaaaaacaguggauuuccucauuucuuuaagauccaaguagaaaauguaaauaacuuacauucuguaugcaggacucaauacagacuuagucaaucugauuuuuuuuggugcuuuucaguauagcgcaacucuaaaaggaaacccauucacccuccuuaguccuuugaaguauacuuuugaaauuauaccuuauuguuaauggcaaccuaaucaagcuaggauuugucgguuaaaauuuugauucuuguaaucuguacugucaauuuuuggccacucuggcuguuacagcaaacuuuucucccacugucauaauuggucuaaaguaguauuuguuucaggacuauccaaaaagcaaggccagcacauugagaagaugcagaauccuacucuauuacaaaccucacucauguuucuuuuauugaaaccuuuuucuacuuuauauuuccucuuuuguaaauuuuuccaugucauuuaaaaaauuuuuuacuuuagaauuacagauuaguucuuuuuuuaaagcauuauggcauuuucaaaaaaaaaauuauuuugguuacccaaaaagcuauacaagaaauauaacuucaauuuuuuagguugauauggguauauuuuuaaaguuuuuauuacuuuauacaaauacaaauuaauuuauauuauaguuuaacaccugcuaugaugauagauaucacacugcuaugauagaaaaucccugucugucauugaacuauucauuuaguguuacucugauauguuaauaauguauuccuucuaaugaaguccuuguaacaagaaacccugugagauugguauaaugagauaucaaauaaucagaaguauaauuaaaauagaacauguuggaaaaucccaacauuuccuguuaugccgucauaccuccgguguucaguuuguuacucaaaaguucccaguucuuaggcugaaaaacauucaaguaaaaauguagcauagauuacacugaaauauuuucaguaucaaugauuuaauauccacacaaacuauuaggaaugguaucuggaacuuguuacaaggucagauaaacuguuacagaauuuuagaaauaauuaucucuguaugugacuguguauuacauauaaaaaugaauuuuucaggaaaagugcacuuuaaaaauacuuucucuugcuaguuuuuuaaauugaugaaauagccugugcugcuuuggaaugcuuauucuuucuuugaugaaaauacggucauugauuaugauaauuuuaaaaauaucuauuucugcaucgcugcaggauuuccuacacuuuucuguuccucaucccucuuuuaugugugcuuggcucaguugccuguuacacagccucugccuugguuuuguguauucuaagauaauuuauaaacacagauauuuacagugaaguucuuccuuuugaaacuaaucuuauucuuuuauuccucucucuaaaaauugguuggccaugcucacuaaugauuuuuuuucuuaacaauaagcauuucuugguauugguagauuuggauugcaugguaagaugacugcccauuuucaccauguauaccuuugucaaauaaagauuucugaucuuuggu

SEQ ID NO: 18774 - RNA, 1417 nt, Homo sapiens
aauuuugaaaagucggugacuaugcacaaaaaguaguaaaaugacacaggaauuaauagaaauccaucauuauucauuuaacguguaaagagaaaacgcucaauguacacuuuuucgguccugcagaugauuaauuacaguucucuaaaccucacauuuagcaucucugugaccucaggccuuugggauuacuucuaaguaagaccaaacaggucgaaagaucuguaauuguaauuuauuuuaggucagugguucgguggaggcauaggggucaaggguccagcacucccaguauuucuuggaggguguucagcaguuuccagaccggcugacuccaacucuuaucugcagggaagcguguuacucuuuggaaugaaagacagcuccguauaaaugacuugaccaaaaaugggugcucaucucagaugcagggcagggacuauguaacuccauccucgacucgcagcaggaaguuaacuccuccugagagccaggcggucggaggaccaggcggggagguuacaggcaccaagacacccaggcuggcuggacccucccacccuguaaugaugaggggagaugcucccugggacagcccccuugaagcuucuggcgacggggcugggauccgcccacccuuacucaggggcgagcccugucauacgcguggaagcggccaccaccuucuagggggaggggcguucccgucgggcguaaccgccccgcccuggggggccgcuggggacgcugaucugcaggagggggcggggucggaaaaaauccgguagcuccagaccggugucccguugccaggcgauggggaggaggcggggccgacaggaaagaggagccgggcucggcgcgaaaagggcacccuccagagccgcggccgcgcagccgccuuuccucccucucagggcugcgcgcccaggucugcgccgcgcuccgccuccagccgcgcgcagacuugcgcacgcgucgugagagcgaccgccuccgucucucgcugggcucgcuagggcugcgcguugggccagcgggggcgccgcagcugaagccgccccggagccggugaaccgaauuaccucgagggaggggcguggggaaggcggcgggaggaggagcgcacgggccggcugccgugcccaccacggcugaggaacaugguuuucgagucgguggucguggacguguugaaccgguucuugggggacuaugugguggacuuggacacgucccagcucucucugggcaucuggaaagguaaggaggccgccgccgccgcuccccggccucucgugcuucccggccgucucgcugcccgagcggcguccugcguucucggggcuucgagcaccuugcucgccgggugcagccaccugccgccgcccgccugugggucaaguuacguaaagcc

SEQ ID NO: 18775 - RNA, 2298 nt, Homo sapiens
cuuuuggaauuuggggcuuuacccuuuaagcugcugccauucucuuuuguacaaacuaauugcucuagagguuccuccuauccuucuugacccccaggucagagccaagaaccuuagcuguuucccaaagauauuucgugggguucccgcugccuccucuccuccccuucccccuccaaagcgacuuuauucaugacaccguuuccuugcccauuuagcugacuaggaaaauaacgguaucaaacgcuuccucuuuuccuucuuaaauaaaacgaaauuuccuuaguggacggcaguuuugucuugaauguucacgagaggcgaccgccgaggaugcgaccagcagagagaaacgugguggcugagauccguuucagcgucacucucuguuggauucuucgcgggagguuuagcucugccagcuucugcucccaggaauaagggucagaaucgacuuccaauuuaccagcgaaugaggcuuuccuaaccuccuucguucccuccccccauaacuuauggauuuauauuaauuacaauagaaacucuuaccugaaaauuggcuuucauuaaucugauuguacaacauaguauaaacacagacaccaggaagguuauauuuauucagaccacuggagaauccacuuuucgggguuguucgucuauuuaaauaccuuccguuccagcaaaggcugagacucgccagcucugcccggccugaccagggcgcccucuccccgucgggugguuugggcgguuccgggcccggcgucucucaccccgcuggucuccccacgcccgccggguccccuaggagugcacuagcaccgagugcaaggagccgcccuugcuuucggccgagguaggggcugugggcuccagcagagaggcaacgggcgaggccgcggccgcggagcacacgguggauggcgccggaggcugcugcgaagccgcggggacagugagccccggcugcagcgcggacacgggcggcagcgcaggcgugggcuugaugggcaccggcauggcaggcaggcucuggcuugccgaguggcacagggacuugaccgggaccccgaaggccccauacuccgggccuacagggacuccggcugcggcugcggcggccgcggcggcggccaccgaauccaugacgccaacgugcggccacacggagcugacgacguugccaagcuggccgggcacgggguagcccagguggugcaugacggacgccaagggcagcccuccagccugcagcacgcccuuguagucccggccaauaauguucucaauggcaaaggggugcuugaagccugacguggacgccgcggccgcggcggcagcggcggcggccgagcccagcccguagggugggaacugagacaggcgucccacgcugcccaccgcggcugccgcggccgccgccgccgccgccgccacggccgccgccuccugcaucuugccggggugagacggcugcugaggcugcgacugcuggggcgguugcugcgggggcugugacgggaggugcggaggcggcugcggagcaguaggcgguugcugauggaaauaguguaccaugugcggcggcggcgggggcggcggcggcggcggcuggggugggugguggugauggugguggugugcggcagcguggugaugaugguggugguggggguggugguggugaugggggugaaggugcccucccggaccggcgcccggcgcgcucuuggugcuucccgcgugcaagugaguauggucggcgcgcagcaccuugaagcgcuugcgacgccgcaggaagcugccguucucgaacauguccccgcagucggggugcagcgcccagaagcuacccuugccaggcuggucgggccuccgcggaaucuugaugaagcagucguugaaggagagguuguggcgcaggcuguucugccagcgcugugugugcucgcgguaguaggggaagcgcuccaugaugaacuuguagaugucgcucagcggcagcaucuucucggccgagugcuggauugccauggcggucagcgagauguaagaguagggcgguuuuuggucgcuguacgagcucuuccccggccgcggcaucgcccccggcuccuccaccgcccuccggcccgcacuggaccacagaaucucuccgcacuccguuccuggggccuggcugcccccacuaauucccacucggccccuccagucccgccacuuugcccucucgcccuccaggcccucucugcuucucucuccugccuucuccgaauugccuggugucuccgaccu

SEQ ID NO: 18776 - RNA, 1651 nt, Homo sapiens
cgaguucagccguucuggcccacguuacgucucuaaugggcaagacaagcgcaaugcuugaccaacuguaccuuggcuggccaaggaggcgugaacggggaauccugcgauucaucucgggcuuccggcccucaccaccccucaaccccguccccgcggagcucggagccagaagcagggacaagcucccucaaccgagccaacgguccuccgccacagacaaggggaugcgggaggaggaagggugugcucucugcccgcgguccggaggccccacgccccggucccaaguccccggcugccgucucuccccgcuccccacgugacccggcccgggggacucuggccgcccugcucucaccuguggggaugcccagcugcuuggagccgcggccgaagccccgcaccacuugaccccggcagaaguaaggcaggugccucauaaugcaguccgcucggggaaugggcugcggcccggucugcgcguccugcggagccgccgucgacgcggcgcccagaccccggaccagccgggggacaggagcgugagcucugccugccgcgggggcgcaccaguggccggacgacgccgaccacaggccacugcgaaucccugacgccgccgacccaacaaauaccgccgggcgccugaggagcugcgucuccgcuggagggcagcggagacagccgaaguaagugccgggugugagcgggguggggggagggggcggcccgaagcgcagagccggccuccgcgccgccggcgugcgcucccuuccucagccgaacgccucgagcccgcucggcuuccguagccccgccccaucauggccccgccccgccgcugccucgcccggcucccgccgcaagcucccgcugcaggcucccgccccaggcgccuaaugucuggaucccgggcuucguuucagccccuggcgaugggaacuaauguggaaaccccguuuucagccugagagccgcgaaagcacaauucucgaacaauucugguuuuuuuuucuccuuccuccuguucauaacaauccggaagccaaagugagacgcucuuuagcuccuuggcaaccgcuggguugaacgucaggcaucgcucguuccguucgcucuuuaaguauuuauuaaagcuccaaaauucagcucaaagaucgccucuucacagaggcuuuuccuggccgcccuaccagaagcggucguccuccaggaccacugaccacguucuggaguuauuaauauauucgaauguaagcuccaagggagaagucccugucugugacgcuguuaaccccagagacuaguggaagguuaccgacaugggcggugacuguccccuccaggcugucuucuugacaauuucacaagcccgauaacaggccgucccucuacugcaaugcagauagaggccuucguacccucggaacuguaaauacgcacgcuccuagggaaguagcucugggcucacucacaggauaugcagggugcaagguuauaagaaggugcauccucuuaacgucucgaagacaaagaaguuuuuuauuuauuuuuuuaaauuuuuaaucaauggaauccagagaaguuuaauuuuuuucuuuuuugcucuauacauuuguauaaaauucugugcagaccguguagucuc

SEQ ID NO: 18777 - RNA, 30237 nt, Homo sapiens
caggaggagcguggggaaaggggcugugggccucucggggagcgagcugcggguagcggcgcacuggguacaggcgcgcgcuuggcugucgccucugccgcuguguuugggaggacucgaacuggcgccaggugagugcguaccugcucgccccugccgcgccgcgccgccuugcuggggccuggagguguuuccagaggguuucugugcuggagcccgggacuugguugcgcccugaaagccuugccuggacucuugccacccucacagagcugauagguggccugccgaggaggacguguacucaugguggcguggugcucuagcgccccggaauaauccugaaaaugggaacgcugccuccaagagaccgcgcagccuggagaagucgccagggacaggaucaggacuugauccucgcggaucgauauggucucauuccucuagcguuggggugaugaccuacugcccgccugcugccuguuacuguaaggccugcuaagaauuuuuuuuuuuuuuacuuuuuuuaaugacugaaaagaaauaaaaagaaauauaauacuuugugacacgugaaaauuacaugaaauuacgauuucaguguccguaaaauuuuacuggaacacggucacgcucauuugcaucuguguuuucuguggccgcuuucgcauuacccagcaggguugaguagcagcuggcaaagcccaaagcauuuccugucuggcacuuuacagaaaaaguuuuccuaccccugaucuaucggauugaaucuucggugggaggaaagaacuggagcacacaaggaagccaauggcauaaguucaaaauaacagucaauauuguaaauuaauuguauauuuggggaaagaaaaaacuguuuaccuaagaaccuacauaaaugaaaccaaugggggaggggcaugaauugcguuuucaaaaaccccagcccuucacgucuguaaucccagcacuuugggagggcaaggcggguggaucacgaggucaagagaucaagaccaucuuggccaaccuggugaaacccgaucucuacuaaaacugcaaaaaauuagccgggcgugguggcagacgccuguagucccagcuacucgggaggcuggggcaggagaaucacuugaacccagaaggcggagguugcaguaagccgagauugcgccacugcacuccagccuggcaacagagcgagacucugucuuaaaaaaaaaaaaaaaacccagccuugagggauuuguuuaccaaaagggagcaaaguuuaaacaauaguaggaaaagacugcccuaucuccuggaagaagagaaucaaaauagcuguuggauagaauacagaguaagaaguccuggaaacauuuuucucuuuuuaaaauaucagacuguccuguagauacauuugaagagcacauuuagcuuugucagcugucuuucagaucauuugcguuagagagcugcguuagagaguucguacaaucugcugauucugcacaugccacuucugaccauucugcaguuuagaauccaaaaggcaaguguuuaguagugaaaugaauuaagcauaauaaacacaccugaauuauuuuaaaaaacccaacauuuuacuuaggguuaaaaaaaaguguaaaaaauaaaauuagucauuucagguuugcucuuggcuauccuaguuuguucuccugcuaugcaaaagcucuccgcuguugaggaaagccuugcacgcacugggaaaauaaacuacacagauauuccaugagauugaaggugguguggauucuagugauagacgugcccugaaaugaugacucuuuggacacaucacaugauuuacaguuuguacgaagcuugcauuugcuucaugaagccuggcaacucaauugcgagcuuuuuaaauuugauuuuuuguuuuguuuuugguuuuaugggaggcaguuuuuggguuguuuuuugccuguuuguuuugguuuuuuucaagauagggucucgcugugucaccaaggcugcaaugcaguggcacagucauggcucacugcagccuuggugauuuuuuuuauaggggcaacaggcaaugaaauaguagaaugugauguggagguggacagugccaggccugaacuuggagcuccccuaaagcugcccugugcauccacacuguuuuugaaauaaaugccuucagggauugcuaggcccaccccccaccccgcccuagucacuuagcccaguugccucucuugucucugcauguuccaguuacccacccuucccaucacauugucacuugcucauagcugauaggguaugcccagcauuuacccaaacacuggcuuggacaggcccagacugcuaacuaauguagaacugggaguuccuguuuugguuaaaaaaaaaaaaaaaaaaaaaaaaaaacuuacauuugacuguaucugagagauuuuauaaguagguuuuuuaugccaucuuacuccugguuccugaaugcaaguaacccccucaagccuauuucccaugccacaaccaugcucacuuguuauuuacaugccauguaauugaugcaauggucacacguguaaccacagauguggcaguuuaggacggggaccaguaguccuuuccauucugugugcacagcaaauagaugccccaucaauaauacaucaguaagaaugacaucaauuauacaucagagccugacaauuaagcuagcacauaccuaacacccuuucuuugcuguuaguaauaaagugcuuuuuagcagcuuggagugauagaaagaagucagcucaauugguuuaguuuaauaucuggcuuuuccacuuacugucugugugaccuuaggcaaauugcucuauugucugagccaguuuccacuuaugcaaaaugaagggguagaccaaguaaucgcuaaagcuauacuucuccaaguuugagaauuuaugcuucagcgagcuauccaaaaauaaugggggcaaggaaugacaagguuuuaugaauuuuuauuuuauuugguaaagugaggauaucacucuacuaacaucuucugacaacauaguuuuguaagagaaagaacauuuaucaccacaaaagugagauaaagagcagccucucccuucccaaaaaaaggcuaauuggcagcauugaaccgacauaccaaaaaaauaagaauaggguaaaauaaaauucaaaagcagaaaaauuacaacauaaaaauguauuuuacaauauucauuguaugcagucauucccucgauacaucuuguaaauuuggauggagauguguauucaacaacauaacucuggaugaaacuuaaauaugcaacuugucugcuauuuuauuuuauuuuuuaagacagggccucacucugccacccaggcuggagugcagcggcucaaucuccacucacugcuacccccaccuuguaggcucaagcaauccucccaccucagccuccgaaguagcugggacuacaggagcaugccaccaugccuggauaaucuuuuguauuuuugguagagguagcguuuugccauguugcccaggcuggucucaaccuccugagcucaagcaauccgccugccuuggccucccaaagugcugggauuauaggcaugagccacagugcccugcugcuauuuuaucacagucauuauugauucuugucucacauagacuuguuaauggaaguggaccccagucuuaagcaauuguacucaaugugggauauuuagauaagccaagaagucagacaacaauagcccucuucccaccaggcuuuuuucugcauaaccccuccccagggagaguguggacacagaucauagaaacuggagcauugcugggagccuccagcuuggcaggcagccgcuugccccuggcuacacggccuaggucccuggcaaccccccugagcagauaggaaggaagaagaguggccuucagggaugaccuucaggagccacuauucuaagauucccuccagcugugcuucaccuuuucacuuagugagaaaaauggcccauuguaauaaccaaggacuacuuuagugaacguuagggaggcauguaugaaacugcccuccauccccuaaaccaaaaauccacaaaacaguggccgguggcuuaacuuggcccucugccugaacauuugcaguuucauguagaaagcacaacagaaauccaauuaagagaaaugauagcccaauaaaagggaauuucauucuugucauuaguagaccuguuaaaaaaauuaugauuauauguugaauuucaucaaaaaaaauugugaaaauguuuuuucucuuguuauauaaguccauacauaacaaccuagauuuugccucuuggcccacauagugucaaauauuuacugucuggccuguuuccaaaaaaaauguaccuagccaggcccaagaccuaggcuuuugggugaagaaauagugucuuuaaacggcauuagcuucauuuugccucuggccagcaguaacuuucuucuugucucauaagggcaguaucuuuaaacggcauuagcuucuuuuugccucuggucagcagugacuuuuuccuugucucaugaggggagaaagaggccagcccacaggggucccucccucacugauaaugagucauacccaggcgacugaaucgugaagguggaaggcaaccuggcuaaggagaggaugaaacuucauauaccacgcuguggccuagcaguucuuccacgcccagaaaacagacguucaagggggagugcuccggcaggucaccugacguugaacuguuugacaguccugagcacaccccagugguuggcacucagugguagcaggggaagccagugcggcgggaauguggauaaugcggggcugggcugaaaggucacugucauccuccccucucagcuggugcuccuaauuuaggauucuuuuaucucccuagacaucuaaaugaaaugcauuugauuuguuuguuuguuuuuuuacuuuuaggaaauauuaggaagcugugauuuucaaagcuaauuaugaaaacauuuaucauuggaaucagugggugaguaauuuugcuacaaacagcucuuuaagauacugaggauguccaaaugguguuucuguguggauggagugggggacggagaagcagugaggauuccagaguccuggggaagagcagaccacuguggaauaucaguggagcacuggcuucauaaaugccaacaagagauggaagaguuuucuauaaacagagaaacagaagagucagucaaccacauuuacccacuuucccauuuauuuuguggagcuaacaccagagacaaggucugauugggcacugcuuucauucaggaugauuuaucauuccccauaucauucuccuucaucacgauggaggagaaaacuuaguuucuuuccagcugugcccagcuucagacauuugguauacagaacaccuucaccuccauuccuuucccccauguuuuggguggccuuaugucccauguugcccaagcuaauccuuguggcccuggaugcaccucucuuucucucaaacauguucuaaauuauauggucauccuaccuguggugccauaggcaggcaugcaaauaaaacaucaacaucaacugaaaaugacauuauuuguuuugcuaccauauuauguucaccuuuacucuaaguauauucacauuguuugugacccaauuaauaaaauaucugagacuacuuuguuuguaauuuuggggaaaucauuguguuaugguauuacauuaccauaguaagucaucaaucagaaguaaaauugagugaacuaaauguuagaacucugcuuugccucccaucuaaccagaagaaaaguucaguuuuucucugcaguacuucucuuguguuucucuuccuucucacccucacugccaccauccugauacaggcugucauucccuaguccccaucuuucccuucuaaucuuuccuacacaccucuaucaguuuaaucuucauacagaacauuuugauuaucugccugaugaaugauauucagugguuccgaguuauugagaauuaaaucugaauaucaugauguaugaaggccaucuguaaguaauaaaggaaauguauuagccucagggguagcaggcugcgggaaaaauuugauacaggagcucagugguaucaccaaaggcaguuuuucucucuuuuaugugucuuucauuuggguucaucuuagaauuggcuuauccuuuuggucacaaagaucuacuaggagcccugugacuuguuucuucauagccugucacugggcagaaggggaaaugcuucucuuccccuaggucauaggucucccuuugcuggauaagccugguccacauacacucagccaccaugguaaaagaggugggauuacacugauugguuuaggucaguggguucuguucuggaauugagagugggagcagucccaaccggaccuagaaaacagacauggaaccuggagaggcaacuacaaaguccacuacaggauccaauccagccuucaucuggcaucucuguaaauaagauuucccucuucucaaugucccaauacagggccguauaccuagaaaccuaccuucugucuuguccuguguacuagguacuauccauaacucccuaagaaagccuucuuuccacuaucuuuuauuuagcaagugccaugauuucuaauuuuuuucuuuuaagaaacagggucucacuauguuauccagguuggucuugaacuccugaccucaaacaaucuucccaucugggccucccaaagugcugggauuacaaggaugagccacugcuccuggccaagugccucaguuucauuuuagugcugcugcaccugugaagcccaugccggauucaguuaaggcgacuuuuguuccugccuugcaucuuaugaacuuagccacuugcuucccuaggaaguaauuguccaauaagccucaaucgaauaauuacuucauagggaaguaauaacuuaguaauuauucaauugcaaauaacagggguucugaaggaauucagggggcauccaugaacuuccuggaaauuuaacacaaauguaaagacagucauuuuucuggguguguuaguccauuugucuugcuauaaaggaaugccugaagcuuaguaauuuauaaagaaaaggagguuuauuuggcucacuguucugcaggcucuacaagaaacaugguggugauaugugcuucugaugagggccucaggaagcuuacagucaugguggaagaugaaggggauccagcaugucacauggcggaagaaggagcaagagagagugagagggagguuucagacuuuuuaaacaaccagcucucacgugaaccaacagagcaaaaacucacucauuaccauggggauggcaccaaacccuucaugagcgaucugcccucaugagccaaacaccugccagcaggccccaccuccagcuuggggaucacauuucuuuuuugagacagagucuugcucgcccaggcuggagugcaguggugcaaucucggcucacugcagccuccgccuccuggguucaagcgauucuccugccucagccucccaaguugcugggacuacaggcaugcaccaccacgcccagcuaauuuuuguauuuuuaauagaggugggguuucaccauguugaccaggcuggucuugaacuccugaccucaggugauccacccaccucgaccucccaaaguacugggauuacaggugugagucaccguacccggccagggaucacauuucaauaugagaucuggaggggacaaacauccaaacucagucacuggggaaagagaugauaaccuucaugggauucucucagagucccacaacauaaaaaaguuuaaauccauccuggcauuagacuuucccaucuccauuacuuaacauggacuaguuuuauuaguauacaacuucucaauccuuaguuuccucaacuggaaaauuggaauauuaacaucuaccuguugcagaauguauucuccacguguuugaguaauuacagacagccuuuuaacuucuccccagcccacuguuauguccaaauacaaugagcccucuuguuaccuggcacauaaaaaauaaaugggccaggaguugugcauuuauuuggguguugugagcaaagaagggaguggcaccaaguagucacccuuuuuccuuccucagauccuaggacagaaugcaugcugggcacgcuucuccucagguuggguagcacacgcaagcuacacguggugguugugggcgugccauaggaaaauguuccuauuccuuucccacauguuuuggguggccuuccuauuccuuuaccccauccuauucccccauuccuaucccuuucccccauccuauucccuuccccaaggaagguuccuauuccuuuccgccauguuuuggguggccugagcugucaccugaccaggaugucugcagucugaguguggaucuuaggugcaggcuuguuuaaauacuuuuucuccccucuccucuccauaucucagacugucuucuagccgaucugucuccuccaaggcuugugcaaaaaugggguguguauuucucauuagcuuuagcuaagucagugagaaaggaucuaauuacuacuguugguuugacugcgugaucuuaacagagauaagucuaaaaaaugacagauuuuucuagccagauuguucauauuguaauaaagucaccccuguucacuaucucauuuaaaccaaaacuuaauaccuaaacuauggacauuugguaugguuuacagacauuuuuguuaaagaaggggaaaagucauaauauguucuugauacauaggguagcacccacucacuuuucaucguuuucaaagagauggcccauauccuacccaauuguauaucguaagguuacaugagaaaucuugugaaucagguuccuucuaccuugagguauaagguaguaauugaguuauauacaagccauuuugaugaauggauauuaguucauuuucccuuuucuagauuauaaguauuuguggauugaucucaucugggauuaagcaaaguuucuuacaaauagauguguagucaggagguuuuugugcugugaacauuuuggugguauggugaaaucuugaccucagaguaauaguuuuaaguguacaaaauaaaaugcaggaauacaaaagaaauugguuauauugaaauauaguuauaaaaauauuuuuaaaaacaaauuugugauauugugauauauacucuucuauguuaauauauuaaauaacaauagccagaagugggucuaaacaaugccauaaaucagaaacaauaaugaacaucgaugauacuucaagauauccaccccaacugcaacauaauaugaaaacaucugugauuucucuuggugaaugucagagguacuuauaucacuuacauuuauaauuaaaggagaugcuaaauuucugucagaauucaaugaaaauaaagguauaauuuuuuucucauucaaguucacagaugcccugacuuauguucacagacaugagccccagguuaaaacacgcuuucaauaaaugacugaaucgagaagugccucccucccgugugaucuccucgaugcugcaaaacuagaucuaaagaggaguaacucagugccccuucuccuggacuucacaguccggucagaagagacaaauaacuggccuguugugauaagcuacagcagaccucccagcuggcccccagguggagagagauggggaaaaggaggcaucgcagaggaaaugugauuucaugguaggugggcuuguaauaagccacuccucuguuuuuuccacugugccuugaggcaaaaucacagugaccauaugcaguuuuauacacuugcacuaaaaugugcuacucauauucucuguguugcauaugaaccaugugaauauuuugacauaggcaaaaaaaauuuugcuuccaacacagugucuguauuuuuaaguguuaguguuacucaguucccuuacuugguaguuaccuuucuccuucaucuuucccagcuuauuucuuauuauuaaguacaucagaucuaccagugccugugguuuaaggcacuaucuaugaaagaaaucauuuuuuucuuaaauaguaaauauugcuuuaaauacccucuuaaaaaauuauuuuaaaguguuuaauuuugggccaggccugguggcucacguccaagcacuuugggaggccaaggcagguggaucaucugaggucaggaguuucagaccagccugucuaacauggcgaaaccccaucucuacuaaaaauacagaaauuagccgggcaugguggcgggcaccuguaaucccagcuccucgggaggcugaggcaggagaaucacuugaacccaugaaucggagguugcagugagccaagauugcaccacugcacuccagccuuggugacacagcgagacccugucucucaaaaaaaaaaaaguguuuaaugauuuuuaaugcauuuuccuucuugguacuuucuuuuuucuuugcuucagugugacaaacaguggcaaaacaacacuggcuaagaauuugcagaaacaccucccaaauugcagugucauaucucaggaugauuucuucaagguaucuauaaaacuucuuaaauuauuuauuuaauacaaaaauguuuaaccaccacguuaauugaauuacauccaagaagucuuuggcuagagauuuacguuuuguauugaaauuaggcucagugcaaugguguuacuuauccacuagauggcacugucuaucagugcugaucuuucuuugaucauccaaagcauuuauuaaagacuucucuccuuuuuagucuauaauuguauuauuucuuuccuacacacuguuuugauggguacuuuauuauuuuuccagccagagucugagauagagacagauaaaaauggauuuuugcaguacgaugguaaguagauuuacuugucaaauauuauaugcuuauguucauuuucuuuuucaaacccaaagaacuucacuauguugaaguugaugguucuguggaacaaaaauuuaaaaaaagaacuucacuauaucugugaaggcagucuuaaaauguguuuaaauauauuguuguacuuuaagccugcauuuguagguuucugauuuauguugaacuauuuaaauaaguuaaaaccuuuuuccaguuuuauauuuaaaacugaaaacacuggggccaggcuuggaggcuuacaccuguaaugccagcacuuuuggaaggccgaggcaggcagaucacuuaagcucaggaguuucagaccagccugagcaacauagggagauuccaucucuacccaaaaaaauacaaaaauuagccaggugugguggugcaugccuguagucacagcuccuuuggaggcuaaggugggaggaucacuuugcccaggacacugagucugcagugaaccgagaucgcaccacuguacuccacccugggugacagagugagacccugucucaaaaauauauauuuuuuaaaaugaaauaauaaaacugaaaacacugaaaugauagauuuuucuucuuuuucauugagguaaaauaugccuauauaauuuacuaucuuuaccaaucuuaaguguacaguucauuuguaauaaauacuuuuuuuucucccuucauucccccccaccugccuccccuuccgggucucugguaaccaccagucuacucucuaucuucaugaaauccacuuguuuuagcucccacauaugcaugaggacaugggauauuugucuuucuaugccugacuuauuucauuuaacauaauggccucccguuccauccauguugcugcaaaugacaggacuucauucuuuuuaaggcugcaugauauuccauuacauauacacaccauacuuucuuuguucauuuauucaucgauggguauuuagguucauuucauauucuggcuauuugugaauagugcugcaauaaacaugggagugcagcuauuucuuggauauauugauuucuuuuauuuuggauauauaccugguaauagaauugcuggaucaugagguaguucuauuuuuaauuuuuugaggaaucucuguacuucuccauaguggcuguacuaauuuacauuccuuccaauaguauaugaugguuccccuuucuccacauggaaucacaggguuuucuucugaagcaaguuaggcuugcugucccucugcccauuccuguucugaagauguauaaguagcuacauuggccacccucaaccacccaugagagaauuuugccuggagcaaacuauauucucucauucuuucagcuuuccuucuugguggccaaaguacuaggccacugugguuugguuuuguuuuuuucucuguucagaaagguuugugaauauauuuuagauggauucuccucauuccuuacuccaagcucacaguuuugaagccaaaggauuacagccuaucauaaaacauuuuuuguagagaauaucaugcuaauaggcaguuuaauauuugauuaucuuauuaacuuuuauaauuaaaaagaugaucauugaauacuuacacaaacuagugacagagggagcucucuuuaaaaagucauaauguucucuauuuuuaacugauaaccuuuuaggaaaaguguuaucaaucaguucuuacagacacauaauaguuuuaugagaggcaaaauucuugacucacucucuguucuugcaucuugaguugcagccaggaucauuuuuuuuuucuucucuuccucucguccagagguuagugagaaaaaucauuacaaaguaagggugaaaaacaaggaaaaacaguuuucaacaauuggaaaagaauuacuauuucuaauuuuuaaugaauucuuacaaacugauaagaaaaacuaauaucccaguaggaaaagggccuaaggaugugaauaagcucuucauagaagcagucaguuauuggauuaauaaauguacaauaaaagucaaccuuaaagaacugcaaguuacuuuuuuucccacuuaccaaguaaacgaagauguuuaaagcaaugauaauuagccagugauagcaugggcucaguaaaacaaaggcccuaauauacuuuagauggaaguauauagauaaauugguacagucuuucuggaaaggagguugagcaugugucccaaacuuagcauguucaugccaugacuucaagcaucucacaucaggaaucuaucuuaaggaaaaacuugaacauuuuagguaaauguacaaauuuaagguaaaucaaaguacuagucaaggcuuucugagcacaaacaggauaguuuuaaaauguggaacuaccaaguuuguagaggaaauaauucauuuucaauggaauauaguugauuaauaugaaagaagucaaaacaaaaauuaaaaaucaagggauggccgggugugguggcucacaccuguaagcccagcucuuugggaggccaagguggguagauuacuugaguccaagggguucaagaccagccugagcaacauggcaaaacccugucucuacaaaaaauacaaaaauuagccaggugugguggugcgcaccuguggucccagcuaccaaggagacugaggcgagaggcucacuugagcccgggaggcaaaggcuauagugagccgagauaugccacugcacuccagcuuaggugacagagugagacugucucaaaaaaauaaauaaauaaaucaaaagaugguggaaaaauagaaaauaauaguaagaugauagauuuaagcccaaauauaccaguagccacauuaagugaaaggaacuaaaauacuccaaaaauugucagacugguauuuuuuuuuuuaagccaacaauaagcuccuuaaaagagaaagacuuaauggccaggugcgguaacucacgccuauagucccagcuacucaggaagccgaagcgggagaaucacuugaaccugggaggcugagguugcagugagccaagguugugccacugcacuccagucugggcaacagagcgagacucugucucaaaaaagaaaaaaaagaaaaaggauauguauaaggacauagaaauauaggccguaaaaggcuagaaaaagauccaugauggaaacaccuacugaaagaacuguuauaacucuagcaacuauacuaauaccaaacgaaguaaacuuuaaggcugaguauuacugagagagagagaaaugaguuacuucgacaggaagauaaaacaaccuaaaauuuuuaucuaccuaauaccauaacauuaaaaugcauuaaguaaacacugacagagcuaagaggagagaaagacacaaauccacaaucggugugggaguuuuuuguuuguuuguuuauuuuuuauugagauggagucucacucugucacccaggcugcagugcaguggugugaucuuggcucacugcaaccucugcugcccagguucaaacaauucucaugccucagccuccugaguagcugggacuacagccacacaccaccacgccugacuaauuuuuuuuuuuaaaguagauuugggguuuugccauguuggccaggcuggucuccaacuccugaccuuaggugaucugcccaccucagccucccaaaguacugggauacaggugugagccaccacgccuagcugaugagggggauuuuaacacaacuuccuuuguguauuaguuugcuagggcaacauaacaaaguaccacagaaugccuuaaacaacagaaaauuauugucucacaauucaagaggccagaagucugagauccaggugucagcaggguggguucccucugaggcugugagggagacucuuuucggugccccucuccuggcuucugguguuugcugaaaucuccggcagccuugguuucggcugcaucaccccagucccugacuacaucuccacauggugcucucccugugugugucugaauuuucuccuucuguaaccagucauauugcaucagguacccacccuacuccagugugaccucaccuuaacugauuguaucuguaaugaccauauuuccaaacagucacauucuggagaacugggcauuaggacuuuaacauagggggacgcauucaacucauaacagccacuaaugagacucacagacaaaaauugcuaaugauauaacagauuugaacaauacaauuaacuaacuugaccaaaaacugacauguacagaacaugcaccuaauaacagcagaauacauauuuuuuuuucuugaguacauggaauauauuaccccaaacaguccauauaugcaagggcauggaguaaguccuaauacauuuuauggauugaagaaauguaaagauacucuauaaucaccaugaaguaaauuaaaaaucaauaaccaaauguuugaaaaguaagcauuacccuuuuuucugauuuucaaaaacuuuuucuaauggaaaauuucaaagauaugcagaagucagcagaaaaguauaaugaacucucucuugaguucgccauccaguuuuaauaaugaugaaauuuugaccaauuauauuucaucuauacccucacccacucuauucaccuauauuguuuugaagcaaaucccaaacaucauuguaguuuaucugaagcaaaacacuuaucuauuccuugggucaaaagcuaaaucacaaugaaaauuagaaaauauuuuuaacugaaugauacaaaaauauaucaaaaguaguaagacugcugguuccagccaagauggauuagucccauugcucacuguuccuccccacugcaaugaaaaacccuagacguaaugcaacaaacagacaaaggaagacugaaaggaaaaaagaaagcaugcuggcuaaagauuccaggacgggaggaaugacauggcuaugggauccauggguuuucuuuuugccuccuacauauacaggagaaguauacaacauggaaccauccauaggcacaggcuaaaaaagggacaaggaaaaggguggccuaccagaauagaaaaacuuuuugauaauauccacccuacucuagccagacacaaaaggcaaaacuguccucccuucauuuuguuagcuuggugcggagcuagacuuccagaagauccauucagcauuagcaaggcagggugagucaccccuccacgucacccauggggguuggaucaguggaaccaaacaggaagcugcacuuucgccuccaccuggcaguacucagguggaaagaggcagugugcaguggagcagguuggcacuucaccuuccuuacucagggcgugucagcuccugucagcagaacccaguggaaagcugaacuucuacccacaacuagcagcaaugaaacuuaaccagcacucuccuugacgcccucuucucacaauggaccaacuucccccacaacacagcaucagcagggccuagcaggaagcagagcauccacccccaccugaaccugcaagcuauaccagaacagagugacugccugcaaaagaagauuaaauaggaucuacagccucauaacacaggaucuaaaauguccuggacacagcugagaaucacuuauuauaccaagaaccagaaaagucucaacuugacuaagaaaaaccaaucaacagacaccaauaccaugaucacacagauguugaaauuaucugacaaagaauugaaagcagcauuauuaaaaggcuguaaacauaauauugcaaacaggcuugaaacaagugaaaaacuagacugccucaguaaagaaauagaagauuugaaaaaagaaccagauggaaauuuuagaguggaaaaaauacauuaaccaaaauuugaaaaaucacuggauuggcucauuagcagaguaacuaugacagagaaaauaauuagugaacuuaaagacagaacaauacaaauuacucaaucugaacaacagagaauagacugaaaagaaaugaauaaaaauguggaacaauaaugaaagaucuaauauucauaucauuggagucucaggagaaagugugggacuaaaaaaguauucaaagaaguaaugguuuaaaaaaaaaacuucucaaauuugguuuaagacauaaaacuucaagaaucugagcaauccccagauuaaauaagucugauuaaaaaaaaaauagagaaggaacagauuacaaauaccaaaagcaaaaaagguaauaucacuguagauccuacagacauuaaagagauaaaaggauauuaugaacacucuugcuauacaaauaaauuugaaaaguuaggugaaauugacaauuuccuagaaagacaucgcuuaccaaaacuaacaccagaacaaagaaaaaaaucuuaauaguccuaugucuauuaaauaaauuaauccaucauuuaaaaaccuuccacuaaaaaacacucuuaagugcuguuggcucaauucaguaguucuggaguggagcugagaauuugcauuucugacaaguucccaggugaugcuaauacuacugguuuaaguaccauacuuuuaaaagcuauaggcuacuuuucuaaaaucacaauuaacucgagaaguauguacauuuuuagagugugacaaugacauauuuguguucuuuacaaauagucugacuuuuaguuauuuaucuagaagagcucuuugguauauuaaauaucuuaacucuuugccaaagacauuacagauauuucccuccaugugucauguaucuuucaaacuuaucuguagauauuucaucuucuaaaaauuuuaaauuuuuguguagucaggagagaaucgaaguuauaaguaaagcaagguuagccauggguuucugauuaucagagcugguaauagggaccuaggaguucacuguacuuuacuuuuuuguauguucgaaauuuuccauaauaaaaauguuucacugugguuugucagcauuagaguuuccacauguuaucuaaauuauuuguuauuaggaguuuugaagggaaauaaaauggugguguauauauuuacagaauccuggauauacucaucacaaaaagucacaucacaaaauuuugugcuauauugauugcauauuuuuguguguuuguuugaagugcuugaagcacuuaacauggaaaaaaugaugucagccauuuccugcuggauggaaagcgcaagacacucugugguaucaacagaccaggaaagugcugaggaaauucccauuuuaaucaucgaagguuuucuucuuuuuaauuauaaguaagcaucuccacccuaauauugucucugagugaauggggggauaaaaacccuugugaacuaaguaugcuguuauuuuaggccccuugacacuauauggaauagaagcuauuuccugacuauuccauaugaagaauguaaaaggaggaggagguaaguuuugaagccaucuuugugaguuguaauucaaaacaaaaaauguagaagaaaaaugaggacagcaacauuauugagcaaugcguauacgucauuuuucagagacaggaagccuuaacucuuuuacaaaaggagcaaaacucuuuuccauaaauggucauccgcauggaguaaugcaaauuacuuucuaagaaaagggccuuauaucaagcuuucggcucauuucuccuaaauccucaaacaaagcaagcccauggugauuaggauuuuaauguaagugagccuguucugccacagcuacaaagaacaccaauuaguucaaagcuuaauccaacauaguggucucuccauuguuauuuacacuauuugucucuuaguucucuuauaaagcacuagaaggaaaaagaauaauuaagaaugauagucaguggauuacaaaguuaauuuuaauaucaaagaacuaaauccauguuacugucguucuaacugccauugaguuaaaacauguaguacauguaguccuaauccuguuuagauucagccucugagugauuuccccauuauccugaccauucauauuuuacuuuaucaauuguguguuucugucaacauaaaguuuccuacguguuuugauaguacaagggucuaucagccuccagacucuccgggauacuuugauggccauguguggcccauguaucuaaaguacagacaagaaaugcaggacaucacaugggaaguugguaagugccuuuucuccuucuguucaaggccuuuuacuugucauuugccucaaaguauagaaaagaaaggacucauagaaaaguauaaagggaugcuuaagcaagaacacucugggcuucuccuuuuccauagcugguucuccugguuucuguuucucucuguggcucuugucagcuucuggaugguuauucauucaaccaguauugaaugaaugccuuccagugcugcccuggagauggugaggggaaugaggcagacccagccccugcucuuaugcagguaacauucuaucauggaaacaggugcuagagauaccagcggcccaagccuguccuuuccagcugcuguaaguucugcgacaccaaguucuaggggacugccgagaucccgguagucaggaaaggcuuccuugaggaagucacauuuaaccaaacuucaaugaguuuaacugaacaaaggagauggguuggggagauagaagauuaccccagaaaguggguguggcacacgaaagggccaggggacaggaaggaaugagaaaccccugaaagaaagcugguguugagaaagcuuucuaguaaagaaaaccaggggaguggauugaugcuagugauacaggcaggguccagacccuauaaggccaauaaucuagguaaggacuuugaucauuguucucagagaaguaagaagcucucuagagagaaguuuuaaacaagggcaugauugauaaaaauucuuguuuuaguuaagaccccucuggcuguguggagaauggaggaggauagauuuauagggugugauguuggacgcccgcacucaguagaacugggugauagaacagcuauggagggggcgggaagaugacagaugccucagcaacugacagauguuagaaaaaagugaaggcauugcagaccuguaagggaggaaugcaugucucuuuugcacauaaugagguugaggugccugggagacauauguagcaauuuggagguaagcauccggaucugugggcuugagcuaagaacagaucacuggaauagggcacucaaugcagggaagauggcagaaggcuguuggauaaggcaaaggaguuagaacugauguaugcuuuucacaauaaaggggacuugucuguguugugagaagccuguuggccuccaggauaggcagcuaugucagagccauguggaaugcacacagaguguacccccagggccaaugcugagauucuggcugcaccacguccaacuuggaccauugguugcaagaacauccucuugcuucccuucucucccuuuuaccuaaaaugcaaaucuaaucaggcuccugcucugcugaauaccuugagucaucuccagaucuuugagauacaauccaaacagccagacaucaaggccucuaacgacugagguacugagguacacccuugcucuaaaaucucaucucacgcuguuccuggagcuuccccauauucuagccauuccaaagggugcaucagugcucuugccucucccuacucaugcuguuuucugaccagaaggcccuuuccuuccuuuaaccuagacaacuucuacuuuuucuccaaagcugcuuaugccaguuuuauuaaaaauacgucuuuucucugauagcagaaaacacacacacacacacacaaacauacacacacacacaauacauauuuucugagccuggugaauucugaguuuguacauauguugcagaucccagaccacugcauuguuuaagaagcuucccaggugauccugauguauaaguauguugaagaauuacuccuuaagugacccuuuugggugaacaccuucagugcaccuaaagugccguaugcacaacaccacuuucuuucuucuguuucuuuccuccuuucuucuuucuuucucuucucuuuuaauuaaauaauuuucacauaagccaguguggauuuaucuguaacaauccaauauuuuugaccuauuauagcuggcuagcaucuauuucuuucuuuaaucacuauuaauuuccuuuuaaguuaugguccugggugccuugguuaaaccuauuggcauuuacaagagauguugggugucaaaguaaacauuguauauuaauaagccuguuagcauuugaacugcucucuuuuccccuucguaguguaccuggauggaacaaaaucugaagaggaccucuuuuugcaaguauaugaagaucuaauacaagaacuagcaaagcaaaaguguaaguauugugcuaacaaaguggaugguagaggagaaacagccaggaaaaucauucauuacauaugaaagaauggaauaccagaaugcuaguguaggagugauugugcucauccauucuuugcuuugaggauaauucagaaucagaaauucuggggggggguuuggagacucaauuauuuugucuguuuuuagggguaaaaccauguacccuuuguuacaucucuuaaugcuauuuaugugauuuacuuuaaaacuuuuaguagauggcuguaccaaaugggacuggaaguauccuuugggcacaguauaauuaaaaugcugaugauuuuuuuuaguauguccagagcuccccuuuucuuuuauucccuuaaagacuuucuguaaaauuucuacuuuccaaauaccucaaagauaaacaaaagauuuuaaaaaguauuaugaaguguuuguuuaagguuuucauauuggacggcacuguuugcaagugacagggaucugccuaaauauggcuacagcagaaagacaguacagggguaaugguggcuucaggcucagcuggauuaacucauuuaugccuaguguuccauuguuggaacucuaagcuuguaggaguuauuuauauccuacugcugaaggucaucaccaaggucucguuuuucacaaaaauaauuugcaaccuccaacauuaauggguuaaggaacucaaauaagguccucaggacucugcuucuauucuacuuucuauuuaggguuuauuuugaagucaggcucuccacugaccugaugucuguugacaacaacauccuccuagguccaucagucccaggguaaaaagauaucuuuuucaagauuugacaacgaguugauaaauguuggagcuggauauugaguacaaggagguucauauuuauucucacuucuuuugcauaaauuugaaauucuuuauuuuaaauaguuuucuaaaaagcaauguucuguuguagcccagaugauugguccugcuggaucacaugacuugccaaaccaaucacuauggccagggagauggcauacucugauuggccaggccuacaucacauaacccaucuuguaauugaauaccccaccuaacaccuucugauuuuaaaaauuucucuggccaguugcaauggcucacguuuauaaucccagcacuuugggaggcuaaauugggaggauugcuuggggccaggaguucaagaccagccugagcaacauagugagagggacuccauuucuacaaaaauuaaaauuuuuuaaaaauuagcuaccaagcacaguggcucacaucuguaaucccagcacuuugggaggccgaggcagacagaucaugauggucaggagauccagaccauccuggccaacauggugaaaccccgucucuacuaaaauacaaaaaauuagccaggugugguggugcgcgccugcagucccagcuacccgggaggcugaggcaggggaaucucuugaacuccgggggcagacauugcagugagcuaagauugcacgccacugcacuccagucuggugacagagugagacucugucucaaaaaaauaaaaauaaaaaauuagcugggcauaguggcacgugccuauaaucucagcuacucaggguauugaggugggaggauggcuuuagcccaggaagucaaggcugcagugagccaugaaugugccauugcacuccacccugggagacagacagcccuauuucuaaaaauuaaaaaaucaaaaauuucccaaagagaaagcagggcaggagguagaaaccagaagaagaaagucgaaaaaacaugcuuaagggacaaaacuguagauguagcuguuguuauauuugaacuauuugaauuaaaagaacuuccauggcuaacaccagcaaaaugcaaucaucagcuggcucagagaagacaguaugacucacuccagcagugaagaauauuauauguuuuuuuuggugagaagcaauugcccuaguccaaauguuguccuuccucaguaagaauuagauuuccuaccuacauccucaauaaauuccucuuugacuaggagacugagcccaacuaggcagcucauugauccuaaacauuguugauuucaggaucagcccaucauauaggcaugaacccauuugaaggaauuucaggaccauuuuaaauuuucuucuugcaaguagaauuuagaauccuugccagauaugcccgcccacuccugccaucuguuacuuugaugaaagucaggccuuccauaaugaaucucagagcaccaacaugaguggauauagaggguguggggugaagggaggggcucagccuucauaaaugauagcacaugagccagagccacuucucugagaguuauuggcuccccuuucugucccuaaugaggcacuuccaggaguguuucagcuguuggacaccuauagcucuuugucuucucagcaauggccagugcuuggguccagcuuuccuuuaugacuaagugauacacuggaguuuggccuuaugaucuaccuacugauaaagaugaaaguagccuuugucauguagcucagguaaauugcaaccagcuccauuccaaauucagucuucaccaucuguuccaaagcccaagaacagcugacauguuuugacaggugcugcuagcucacaagaaagugcauuucccuguguugugacgccccuccuuccuucccuacauccuagaggcaggcaggaaaguauuuagcuaugccauuugaggcuucuagauauuaguuaaaguuuaaaaaaaaaacuuaaaagagggauaaaaacagaaauacaucagcuuuucuuaccuccaacauuuaugcugguuuuucucaguuacauaaauaaguuacuguuuuauuucuaguaaccuaucaccuuuccuauuucuuccauccacaguauccuggcaaagcuuuccugaagguacccucagcauagccugguuuaacccugaguaugacacacacugagcuagcuggggaggccuuucaguguuucuagugacuaaucuucaggguuuuuuuucucacaucucauaaacuuguuuagcuaauuuuucagucuuaaguacauaaaaucauaauuaugauaagguaauaauaaugaaggggaaacaagaaagacugaauuuaauuguuaaugaaacaauaaauuauccaacagaguaagagaauggaguuacacauuuaauuuaauccuuauuuaaauccaaaguaugaggcaaaauuuaauuauuuccuuauucuuacuaaaacaaaguagucuagccaccaggaacauucaaacucccuuuaaaaacauuuauuuucaccucauuauaaaaacauuauuuuuaagguuuuuuauuuuuuguuuuauuuauuuuuauuuuuuauuuuucucauauggagucuuuuuuucuuucuuuuuuuuuuuuuuugagauggagucucgcucugucgcccaggcuggagugcaguggcacaauuucggcucacugcaagcuccgccuccuggguucacaccauucuccugccucagccucccgaguaacugagaccacaggugccagccaucacaccuggcuaauuuuuuauauuuuuuuaguagagacgggguuucaccauguuagccagggugaucucaaucuccugaccuccgcccgccucggccucccaaaaugcugggauuacaggugugaaccacugugcccagccaauauggaguuguucugucgcccaggauggagugcaguggcacgaucucagcucacugcaaccuccaccuucuggguucaggugaucuccuaccucagccucccaaguagcugggauuacagguacgcacuaccacgcccugcuaauuuuuguauuuuuaguuaagacgggguuuugcuauguugaucaggcuggucucaaacuccugaccucagguaauccgucugccuuggccucccauagugcugggauuacaggcaucagccaccaugcucagccuuuuuaaauguuuaauagaaagcaaaagggaggaaguaauuaccuguguucccuccaaucauuaguguuaacauuuuaaugaguacacauccagucuuuuugcuguucacaucaaucugucuuuuacaagacugcaaggacaguguaguuaaucagccaugcuuaucucuguuuuuaaauuaguauuuaauauuuaugcagcuuuauagauuucauuauauaaugaaacuaaguagcucuuccaguuaaaaaaaaaaucaaggcugaguucuguuuuguacacugaagagaaauguaagacuugacauugacccuuuaguacagaagaaacaugucacaugucuaguuccaaaucaaaagaauaagaaguugcaaaauaaaauuuaauuaucagauguuuguauuuuucucauuaaauauaaaauauaaucucauuauaaaauuauaguauaauuaucugguacaguaguccaaauuaacauaagaucacuuaaccauuucccaauuguuggauauuuacuguuguuacaaguguuucacauggauauaucacaugccauaaaaaauaucuacaccuacucuuuguugguugucuucuuuuugaauuauaucccuggaguaaauucccagaagugucacuuauguagucaaaggauguaaucauuuuuacauuuuacauauuucaaaaaugaaauacuacccaaaaaaugugugcuuugcaacaucagcuguguaauaagaaugugguagguuuaucauugaauuucuaugccaaaucaaguauuccacugggcuuccuucguuuaagaaaagggauuaaaguaacaauacuuuccccacaucaaggauaacacuccaaaacaaggauuauacugcagacaacuacccuuugugguuuuauucuagucuucaaacuauaucauucucugaagucaaggauuacuauacgaacuacaagugauauuggauaucuaucugauauuuuaagguaugcuucaaauuuaaugcagggauuaaaagaaugggacuuggacucaauuuaguucuuuacaggaaaccagcauuuuuggcuccagaaucccucuaauuuaaacauccuuagauuuacuguuguugauguaaagauuuaauaaaaugagaauuggaauucuccauuaauuucuuuuuauguuuauucccaagguuugcaagugacagcauaaagacggaacacaacaaauccuuccugaagugaauuaggaaacuccaaggaguaauuuaagaaccuucaccaagauacaauguauacugugguacaaugacagccauuguuucauauguuugauuuuuauugcacaugguuuucccaacauguggaacaauaaauauccaugccaauggacaggacuguaccuuagcaaguugcucccucuccagggagcgcauagauacagcagagcucacagugagucagaaagucuccacuuucugaacauagcucuauaacaaugauugucaaacuuuucuaacuggagcucagaguaagaaauaaagauuacaucacaauccaauaucuguggaauucauuguguauguuuauguauuuguguguagguguguaugugugugugugauacauacauacaucaaguaucacaagacauugaccuuauauauuaugcacugugauguuuuuccgucuuuaauuauaaaaaacauauugaucacaaccacaauuuggaaaauguugcuccauaccaucccauaccaacacucaccaccugcaaauaauagcauuacuaggagcugcagucacaaugaauaaaucaacaauucgcuacaagaucuaggauuauuuguguauuuuguugaguguguguguguguguguguguguguguguguguguguuggcguguaucuaauaccauuguaucucauuguugagacuuuguuacaaauaggguuucugguuucuuucuccccccucgugguucauuuuguuuuugucaaaccaguggucuaaaaucacagaaauaagcaauuacuucaaucauguggaauccaggggaccuaucuuuggaaagcacagaaggagaucugaauugugugaucucuugaggcugcuuucaaugcuggaauuuaaauuauguacugaacaaucuuuugcuuauuaauaaaaagauuacacacaaccaucucaaucuuuuuuuuauauauacuuuaaguucuaggguacauguguaccaugugcagguuugauacauaguuaugcaugugccauguugguuugcugcacccaucaacucaucauuugcauuagguauuucuccuaaugcuaucccucccccagccccccacccccgacagacccuggugugugauguucccagcccuguauccaagugaucucauuguucaauucccaccuaugagugagaacauucaauguuugguuuucuaucuuugugauaguuugcugagaaugauggcuuccagcuucauccaugucccuguaaacgacaugaacucauccuuuuuuauggcugcauaguauuccauuguguauaugugccacauuuucuuaauccagucuaucauugauggacauuuggguugguuccaagucuuuacuauugugaauagugccgcaauaagcauaaaugugcaugugucuuuauaguagcaugauuuauaauccuuuggguauauacccaguaaugggaucacugggucaaaugguauuucuaguucuagauccuugaggaaucaccacacugucuuccacaaugguugaacuaguuuacagucccaccaacaguguaaaaguguuccuauuucuccauauccuauccagcaucuauuguuuccugacuuuuuaaugaucaccauucuaacuggugugagaugguaucucauugugguuuugauuugcauuucucugaugaccagugauaaugagcauuuuuucaugugucuguuggcuacauagaagucuucuuuugagaagugucuguucauauccuuugcccacuuuuugaugggguuguuuguuuuucucuuguaaauuuguuugaguucuuuguagauucuggauauuagcccuuugucagaugaguagaucgcaaaaauuuucucccauucuguagguugccuguucacucugaugguaguuucuuuugccaugcagaagcucuuuaguuuaauuagaucccauuugucuauuuuggcuuuuguugccauugcuuuugauguuuuagucaugaaguccuugcccaugcuuauguccugaaugguauugccuagguuuucuucuaggauuuuugugguuuuaggucuaacauuuaagucuuuaauccaucuugaauuaauuuuuguauaagguguaaggaagaggucuaguuucagcauucuacauauggcuagccacuuuuccuggcaccauuuauaaauggggaauccuuuccccauugcuuguuuuugucagguuugucaaagaucagaugguuguagaugugugguguuauuucugaggccucuguuuuguuccauuggucuauauaucuguuuugguaccaguaccaugcuguuuugguuacuguagcuuuguagaauaguuugaagucagguggcgugcugccuccagcuuuuuuccuuuugcuuaggauugucuuggcgaugcgggcucuuuuuugguuccauaugaacuuuaaaguaguuuuuuccaauucugugaagaaagucauugguagcuuaauggggauagcauugaaucuauaaauuaucuugggcaguauggccauuuucacuauauugauucuuccuaucaaugagcauggaauguucuuccauuuguuuguguccucuuuuauuuuguuaagcagugguuuguaguucuccuugaagagguccuucacaucccuuguaaguuggauuccuagguauuuuauucucuuugaagcaagugugaaugggaguucacacaugauuuggcucucuguuugucauugguguauaggaaugcuugugauuuuugcacauugauuuuauauccugagacuuugcugaaguuucuuaacagcuuaaggagauuuugggcugagacaaugggguuuucuaaguauacagucaugucaucugcaaacagggacaauuugacuuccucguuuucuaaucgaauauccuuuauuucuuucucuugccugauugcccuggccagaacuuccaacacuauguugaauaggaguggugagagagggcauccuugucuugugcagguauucaaagggaaugcuuccaguuuuugcccauucaguaugauauuggcuguggguuugucauaaauagcucuuauuauguugagauacauuccaucaauaccuaguuuauugagaguuuuuagcaugaagggcuguugaauuuugucgaaggccuuuucugcaucuauugagauaaucaugugguuuuugucauugguuguguuuaugugauggauuacguucauugauuugcauauguugaaccagccuugcaucccagggauguagccaacuuugagacagucucacucuguugccaggcuggagugcaguggugcgaucucggucaccgcagucucggccucccggguucaagcgauucucccaccucagccuccugaguagcuggaacuacaggcgcaugcuaccaugcccaguuagucuuugcauuuuugguagagacaggguuucaggauagucuugaucuccugaccuagugauccgccagccuuggccucccaaagugcuggaauuagaggcgugagccaccaugcccagccaacuuucucaaucuuuaaaauauauuguuacauuaaccauucucuacagac

SEQ ID NO: 18778 - RNA, 49991 nt, Homo sapiens
guuuaaagcugagcaccuucaugacacagacucuaagacucaccaaguuaggagacagagucaaggaagccucugcacauaacuuuaauuugaaaauguuuauucuaccuccgaggauauuucaaaguauggagcugauuaucuuuauccaugacauucuggccuuuaucaauuaggucauucagaccuauaucaauacauuuaaugaauuacaacauguaaaacuucugugcauguguacaugagaacaguauuagaaacagcuacuacuaugaguguuuauacauaacuuccgaacaauuaguguuuggaaaaauagacauuagauagaaaaucuggaagaaugggcaaggaauugguauauugugucuggagaggaacauagcuggcuagggacagguaaaacaauuauucacacuuggccgagcguggcggcucacgccuguaaucccagcacuuugggaggcccaggcagguggauugccugaguucagggagacuaaccugcgcaacauggugaaaucccgucucuacuuuaguauuuucaaauacaaaaaauuagccaggugugguggcgcaugccuguaaucccagcuacucgggaugcugaggcaggagaaucgcuugagccuggaaggccgggagguugcagugagcugagaucgugccacugcacuccagccugggcagcagagcgagacugucuccaauucauauuuguaauccuuugcacuuucuuuuugaauuuugaaacauguauuacugcauuacuauuaauagacucacguuuuagaaaacuuuuauauaaaaauguugucauuuuaagcauuaccuuuauuucaacuauuaauuuaaauuaugaaaauaugaagccacuucacuuucaauaugguuguaacuuuuuaacagacuuuguggucacugggcauauuuaaccccucgaauaaagcaaucuuucccuuuuaucauuacuuuguaagacucauuugcugggugguggauuaaauugaacagaauaaguuauuucuuuuucuuuucuuuuuuuuuuuuuuuugagacgcugucucgcucugucgcccaggcuggauggcacgaucucggcucacugcaagcuccgccucccggguucacgccauucuccugccucagucuccagagcagcugcgacuacaggcgccagccaccaagcccggcuaauuuuuuguguuuuuaguagagacgggguuucaccauguaagccaggauggucuugaucuccugaccucgucauccgcccaccuaggccuuccaaagugcugggauuacaagcgugauucaccgcgcccggccccagaauaaguuauuucccaagagccacccuuagaugcugguagguguaauggucuucccaagaccaggugcuggauagaagguccuugcauuuuccucaucuguugccauccucaguaaaggaggaauuaggacugccgcaagccccuaaagacuggaaagaugggacgggcgcgauggcucacgccuguaaucccagcaauuugggaggccgaggaggguggaucgccugaggccaggaauuccagaccagccuggccaacauggugaaaccccaucucuacuaaaaauacuaaaauuagccgggcgugguggcgcgcgccuguaaucccagccacucgggaggcagaagcaggagaaucgcuugaacccaggaagcagagguugcaaugagccgagaucgcaccacugcacuccagccugggcgacagaguggggaaaaaaaaaaaagugaaaagaugauggcgcccacuuccgacccccuuaaguaauuaaaaauaggaauucauuuaggaagugaauuaaaacuuaaauuaggguggauacaagacguuccuucuagacuuucugaaauaaaaauuccgaauaaaaucaucaaagccgaacuuuuccuuuuugccuuucccuucuuugcuagugccugggaccgcguucagccuccagcucaacaauccggcacucgccggcuuuuaagucccacccacgcggccgcgcacagguaacggcagugccagucccaccccaccuacgagcuccuccuccgccucccaccaaggggccuuggccccgcccuuggaagcgugguugugacgucagcgcgcugucuccgaagcccggcagcaaaugagcgcagaccgcacgggcccuccgcguaccaaggcacacgcaugcgcauugguucugggagcccugaagaccuggcggagcccagcgcggauggaggccugaggguggcgggggcggagcgcgccgcgagcugggggcauguccgcggcgggcgccgucuagaggaaggccaagcagccgccaccacgcugucggucgcggagagacgcaagcgagccaggccgagggccgcggcggcgaugcagcgacggcgucgcccuccgccgcccaccucccggcugcccgagggcugcgggggaggaggcgguggcagcgaggagguggaagugcaguuuuccgccgggcguuggggcucggccgcggcgguuucggcggcagcggcggcggccacgcgcagcaccgaggaggaggaggagaggcuugagcgugagcacuucuggaagaucauuaaugccuuccgcuacuacggguaaggagcccguggcggaccccggcccagaccgucggggcgcccacugguggcggcggacccgccggaacgggggcgcucgccgucccgccgccacgccuccgaggcgucgggacccggcugcugcagcugaccuccgggccccgagucaccucgcaccaccccagccccucccggcccugcacacccgcguguccgccgcgccgucugcugcacagccucgugucuucugaccucaggaucagauuagcucuccugccuccguccucguaaagguuuggcuuugaggccgaugggggugaccagagaagcgcuguaacaauuucagauagaagacgauggugguacaaucguccacugcugggcugauugguguguguggucgauguccuccaaacugaacacacggagagcccaaguucaccuacgcgugggaugcuguaggacguauuuucccaaacuguuaccagugcuuguaagagcaguuuaagauuuccacccaccccucuuuggcgcugugaacgcacuugcacuuuugugugagcgauugaaugaugcugcucagugucuuuaacuggugggugauuaagggcggaagugguccggauauucuaaaauuugcuaauuauuaggagagaugagagaagucacaauaagagcugccuuuacguucuuuuuuucugcaaaucuguaucuaauucucccuggugugcuaggcacugugguaggaccuuuaugcuccucauucauaaaaacagcucccuaacuuccacguuucuucuagauagauguuaaaguagcuuaaucacaaaauuauaauuccaagagcugaaagggacuuaaaucaacuggauuuucaggugaagauaacacuuuuauucacguaagagauaugaguccaccggugacuauguucugaggcugcaguuggaaucagacagacaugaccuccuacgcagguaaaccuguucccauagguggguuccugcugugcuuuaugcaaaguuuuuuuauauuguucaucuuauguauuauaguuguuuuuauaaaucucuugcuuugcugugaccuccucaagggcaggggcugagucuuuuuuauuuuuaugucacuagugcuuggcauauguuguuuaagcucuauuuuuaacaaaacaaauaguagcaaagaaauacauuucucauucccaaauagucugucaaguuuuugacugauaguuaaauuaguuuacuagucugaauuuagaagcuugcuuagugaaagcuuaaaguuauuuggaaucugauuguauaugugauaggaacuuuugaacuucgaagaucuugaugaaauaauuuacugauuaaacccagaaauagggaccagggacagcauuacuuuacggagcccaaaagagaaguuuggauauuuuauuucuccagguuuaguaguaacagagggagcaaggcgucagaccaucagagaauugaauuugaugcaggaauugugacggaaagaaccauaaaguuaggaaaggcagcuaacaucagauagcuaagagugggagauacagaaaagucugguacauuuugcucuugaaaaaucuagaaagaauauugggaaaugucuugggaauaugguggacccauuuaguuaagugcguaguuguacuuacuuuuaauauauuaggaccaauuuaaaauugauauuuauggguaaguaugggaugggacuuuguugggguagggguugaucaggaacugaaguguggcaauauagagaagagaucuugugugaauauucuagugguugugauacuauuuccuauacucucuucuuuaccagcguaauguuggauucaggacauuucauuuuuuaaaaaaaacaguuuuuauuuguauauacucucuugaaacacuucaaauacuugggcugaaaauaguauaacaucaaaaauaugcuuuuuaaaaugucacuuaaagccuagggguacagaaaguuuauguagcagagaacaguggauuguuacauucuaauauuuugugaucuucuagacuuaaacuguagccacuaaucauaucuggauaaauuuaagcuaaaauuaauuaguauuuaauaagcuuuaaaauuuaguugcucaguuucacuacccauauuucaggugcucaauagcuacauguggcuagagucugcuguacuggacagugcaaauaaaagcuuuuccauuaucgaaguagguugugauggacaauccgguucuacacauuuagcaaguacaguugacccuuaaacaauauggaucugaacugcacggguccacuuauacacaaauuuuuugaaauaaacauauuggaaaauuguuuugacauuugcaacaauuugaaaaacuuagcaaacuugcauagccuagaaauagugaaaaaauuaagaaaaaauuaugccaugaaugcauauguguagauacuaguuuaucauuuacuaccauaaaauauacacaaaucuauuauaaaaaguuaaaauuuaucaaaacuuacacaaacacagaucuuacauggagcuauuugcaauugagauaaauguaaacaagcaaagauguagcauuaaaucuuaguugcauaaaauuaucuguaguagauacuguacuacuguaauaauuuuguagccacuuccuguugcuuuugcaguaagcucagauguuaccaguaucuucuuaaaauaaucacucugcuuuugucugucaaguaaauugcauauagcaguaaacagauuucaucaaauuuaaugcaauaccauaaaccuuaaauaacaccaugggucccauaugacgugccacuggugaugcugcaggugcucccaagaagcagagaaaaaagacauuacaagaaaaaguugauuuguuugauauguacuguagauagaggucugcaguuggagguugccccccaaccccauuucagacagaggauucaucuuguaaucaaauuauguaaacuuauaguauugauaaaugcagugcaguaguguaaauguauuuucccuuuccuacgacuuucuuaauauuuucuuagcuuuauuguaagaauauaguacguaauauauuaacauacaacauaucugucaguuguuuauguuauugguacggcuuucggucaguaguaggcuauuaguaguuaaguuuuuggugaaucaaaguuagguguggguuuucgacugcacaggggguuggugccccaacccaaguauuguucaagggucagcuguacguccagauuuugcaggguucaauuuuacugcaaaaugucuuuuaguuaauacguaggagauuuagauaaaaggucauaaagcaaggaaugucuuuugauuaauauuuucucuuucuaauggguuucaauuuugugauucccacagauuuugcuuagaugacauucucauuaagguaaaaauggauauagcucauuuguauugaauagcaaaaauguuaguuuuauaacccagucuuguuacgaaugaagcaccucagcacauagaaaacacuagaguugaaaagcugaaagucuuuucagaaacuucuuacuuuuagaaauaacggggugagauuuuuuaauauugagauuuagaacugauuuuuacaggugaggauguggauagacacaaagcgguaagcaacuugcucaggguuacacaauccaguugugguagaaucugaccuaaaauccaaaaucguuaccuaaaauuuuacugugcauuaaugaggaguuauacuaguaacacaaauuuaauguuagguauuuaauaaagauuuaaaaugaaucaagacaggccaggcuuuguuucugacaaguuauguuuuuucuauuuggauuuccuagaguaguucaacuaggugcagaggaaugggccugugaccauggccuuuagaucagaccuggugugggcucacccugaugacaggugacuaaaucagaguugaggucacugcugacaccagguuucuagagagaguuagagguagagauaccaccauuggggaaaaauggcuacuaaguuuacuuucuccucuuaucagcaagaggaugucaccuccugaugcugacuuaguucagaaccaaggagagucugauuuuuguaaaauacuccuucaaagcagguuuggcagaguuucuuaaaagggccaggcaguaaauauuuuaagcucugaaggccaaguggucucuuguuacaacucaucaacucugcccuugaauggaaggagccuuaggcuuuguguaaucaaauaguguggcuuuguaccaauaagacuguacaaaaaccagguagccaaugggccccugccuuaaagcaauucugauagcguaagcaugugcaggauagugaaguuagccccaguuauaaggguauaauaaggauuggacuauauucucaacuuuaguaagaucccaccuauuuuaagagucacugguggauguauguuauggcagcuuugcacaccauuaaguaaccagggguuuaaggaucucauccugcucuguguaguuacuucuguaucaaaaauugacagcucuuguaaccaaucuauaacuuaucucaacucacccuugcaaccuugauauuacuuggugauaaguagucuccauggaaaaccaaaaguggcacccgugggaauauaacugaacauuuauugcuuuuuacauaugcugaaauacggagauauugaauaaugaccaagaugacacuuguguuuuagaauaauucuucugauuagagguggggcaggaagggcaggggaggaguuaggaaguagaauugaaaaguauccuggguuuauugauugugggacuaggagaagaggcauuuaggaugacuccuuaauuucuuuuucuuuuuuuuuuuuuuuuuugagucuugcucugucacccaggcuggagugcaguggcacaaucucaacucacugcaaccucugccucccagguucaagcgauucuccugccucagccucccaaguagcugggauuacaggcgcaugccaccaugccuggcuaauuuuuuguauuuuuaguagagacaggguuucacuguguuagccaggauguucuugaucucgaacuccugaccugaagugaucugcccaccucagccucucaaagugcugggauuacaggcgugagccaccaugcccggcugaugacuccuuuaauuucuaacuugggugcauuuguuaaucuuagccaugaaggaaggagggcagguuuuuguggggcaugugcuaaguucacuuuggauaugaguuuugaguauggugagagggaaguuguggggcauccagagcccgggaguaaacacuaggaagaaagcucugugaggcuguucaacuguugaagcucugcuguuugccuaacuugauguggccauuuuaguuccuuuaaugucauacucugcuguuaggaauguaaauuuauggagucuuuuugcacaucauuuuauaucaagagccuuaaaaauacuaacuccuggccagguguaggggcucacgccuauaaucccaauauuuuuggagaccaagguuggcagaucacuucaggucaggaguucaagaucagccugaccaacauggugaaaccccaucucuacuaaaaauauaaaaauuagccgggcaugguggugugcaccuguagucccagcuacuugggagacugaaccagaagaagcgcuugaagcugggaggcagagcuggcagugagcugagaucaugccacuguacuccagccuaggugacagagugagacuccaucuccaaaaaaaaaaaaaaaaaaaaaaaaaaaguauuccuucucaccugguaauucugguuuugagaguuuaugcuaauuuuuuuccuaaauuauagacagauuuugaacacaaaauguucaucacaaaaacaagugagugucuaaaugcccaguaguugggaaauagcuaagucacugaugguuaccuaagauggaaugaugaacauccacuuuguaccccacaaauauagacaauuauaauuugucaguauucagcuuaaaaaaaguaagaugcuagaugacuuuuuuuuuucuucucuuuuuuggagacaggguuuuugcucuguuacgcagccuguagugcagugacacaaucauagcucgcugcccccuugacuuucugggcuaaagcaauucuccuaccucagccucccaaguaggugagacuacaggcaugcaccaccacgccuggcucauuuuguuuuuuuauuuuuuuguagagaggauggucuugcuauauugcccaggccgguuuugaacaccuggccucaaacaggcuucccaccuuggccucccaaaauacugggauuacuggcaugagccacugcaacuuuguguuaagcaaaacggaaaugugccaaaagguuagaagugguucccucuagaagaggaauuauuaggccuucuuuccugaguacuucuaauuucuacauuguucaugcuuugaacauuuuaguaauauaaaugagauauaccuacuccuuuuuugaacaguagauauauauauauaguauauauauuuauccuauauauacuauuuauauuauauauacuauuuauacuauauauaguauguauauaguauauauacuguauauaguagauauauacuauguauauaauauauaugguauguauaguaguauauauacuauauauaauauauaugguauguauauaguaguauauauacuauguauauacuauguauauauacauauauacuauguauauacuauguauauauacucuauauaguauauugaacaguagguauauauauaguauauauauuuugagcgcuugcuguguuuucagcuguugggcuaaaucuuuugaguacguuauuuuuccaaugaaacccugucugcuaggcagaggaagguaaugcuaccuaccuaauuaugaagaucuuucagaauaauccguauuaacugacuugguuuagucccugguauuuauuaaaucucaaauggcagcuuccaugaucaucaucauuguucauucuuaucuugcuucuguauaugagagaguuggacaaaggaaggcgguaauuugccuggugucauguggcaaauaggugucauaaccuggauuucaucccugaucuuucugacuucaaagcucauuauuauacucuccccagaggggcaugucaguggagcuucugacaacuugaucucuucaccuuaucccuaagggccccccacaccaagccaccaaacacaagcuuguaaaaacgcgaccagccagguuuuugguuguuugucaggagcuucuucugaaguucauuacuguuuggcaguuggaauaauuuggcagaggguaaaaauaagaaaauuguuuggaugaaugaagauuuaagaaaccaaaugacaaagauauugaaaaugaaagugaaauugaaaaugaaaaugaaggcugggugcgguggcucacgccuauaaucccagcacuuuggaaggcggaggcaggcagaucacgaggucaagagaucgagaccauccuggacaguauggugaaaccccgucucuacuaaaaauacaaaaaucagcugggcaugguggcgcgcaccuguagucccagcuacucgggaggcugaggcaggagagucgcuugaaccugggagggggagguugcagugagcugagaucgugcuacugcauuccagccugggcaacagagcaagacuccaucucaaaaaaaaaaaaaaaaaagaagaaaaaugaaauagaaaaugaaaaauacuuccauuuucauuuaauauugaauuaauaccaaagaacauuuaaacauauacacauacauauauagauauaaaauguaaggaauauuacagugaacacuuauaaaucaccuaguuuuuaaaacacauuauccugucucuuucacccucagaaucauuaaccugaauuuuuacuucuuugcuuucuguguaguuuuuccacauaugcucagucccuaaauaauauuuaguuuucuaugaaaugcaauuguacauuauguauuuuacugcaauuguuuucaacaaauguauauguucuugagguuauccagauggugaugggaguaaccaauuucugccaaaauauauuuagagguuuguucugggccaauaugauagugacugcagccugugguuacacgaucucaaacaacccugacaaagugcaccccagguggucagguuacagcuugguuuuauacauuuuagauacaggaauuacaugcaagguauacauugaucucacucaaaagguaggacaucuuaaagaggggguuacaagucauagguggguuuuaaggauucuucagcugguaguugguugauagagguaagcuaugguaaguagaaaggaaugcuugaguuaaggggcuugugaaggccaagguucuuguuaaguuaauugaagccuccuagguagcagcccucagagggaagagauacuaaaugucacuuuuuagacuuuaauguuaucaggcucucaguuaaucucuccuggauccaggaaaggccuagaaaggaaggccugguugcauuaauggagauucuugacagaugcauauuuccccuaggaaacauggcuuuguggggccauugaaauccguuggccauguggcagccauuucaaaaugucaaauauauuuugggguaaaauauucugauuuccuucugagucugcuauuugucauaagaugccauaccagagucagguuggaaaguaagucguauuauauaggguuaauaaaaaccuguccagugagauuucguaauuaguaaggcaugacuccccaggccucuuagugaagaacuuggagaagagagaaaauauaaaaaagaucagcguuuagucuucacauauuauuguaugagcuguaauuuacucauuucgcugcauuccacuguauaacuauacuguaauuucuucauucuauaguaacuauaugauaauuucugauaguagaccuuuggguuguuuccagauauuuuauuccuuuuuuuuuuuuuuuuuuuuaugagauggagucucacucugucgcccaggcuggaacgcaguggugcaaucucggcucacugcagccucugccucccgcguucaagcgauucuccugccucagccuuccaaguagcugggauuacuggugggcgccaccaugcccagccaauuuuuauauuuuaguagagaugggguuucaccguguuggccaggcuggucuugaacuucugaccucaagugauccgcccacauuggccucccaaagugccaagggauuacagggaugagccacugcgcccaccuguuucuuaucucuaacagugcuaugacaaagauuguucauguuucauggggcccauuugcaagaguuucuaggauauaauugcuaggucauaaggcaaguaccaugcuaaguuguacuagguaaugcucuaaauuuaauuuuccaaagugguugcgcugauguaugcacuuaccauuaguguguaaauguccuaauuacaccauauuuucaccaaucaccaaaauuugauauagucaggauuuuaaauuuuggccaucuugucaauauaaaaaugauauacugugaguauauauuuaacuuuaaaaaaugauguucuuauggccaggcaugguggcucaugucuguaaucccaguacuuugggcgaccagggcaggcagauugcuugagccccggaguuugagaccagccugggcaacaugaugaaacccaucucuacaaaaaaauacaaaaauauuagccaagugugguggcacaugacuguagucccaguuacuugggaggcugaggugggaggauggcuugaaccugggagacagagguugcagugagccgagacugugccacugcauuccagccugggcgacaagagcgaaaaucccucucaaaaauaauaauaauaaguaaauauaaguaaaaauuauguucuauuuucugguuuuaugaauaaguaguccccaaagugaccuuuggguucguuuuuggaaugcaaauuguggguauuguuaaguaaaacacuauagaauuuuaauuuuuuauuugcuuaguaauuuguaguauauaagaucuucuaugauauuuaaaaaaaaucaaccugguuagcuuuuaguuaauuucaggacauauuuuguguguauuauaauuucauagcaguauuuauuuugcuacuuaaagauggaaaaaucuaaagcugguuuugcugaaaauuuuaaguuuaaaacacaaaaauaaauuaauuguacauuaaucuucuuuuuccucuucuaauuggugcauauguuuacuuuuacuagugauaaaccauuuguauuuugguugcuuagagaaggacuuguaauaaaguaaaaacauuuacaacuuuauaaguuaaugccuuuuuaaagccaagagauuguaaaugauaggacaguauccagcauaauaaggaaauaauuguacagaaagacaaccuuaaaguaagauuggccucuggugagaauucuuuugugaauuuaaaaaacaccuuuuauguuuuagcaccaguaugcaugagcgggugaaccgaacagaaagacaguuucgaucacuuccagcuaaccaacagaaacuacuuccucaguuucuucuucacuuggacaagauccggaaaugcauugaucauaaucaagaaauacuacugaccauugugaaugauugcauacauauguuugaaaauaaagaauauggagaagauguaugugaaaguuuguucuauuucuguuuauuuuagggucaaccucuguauuuugaggucuuuuauuuucuggauuucauuuuuauaaucuggcacaggcuauuugcucuacucagaaaguuuuaacuuaaauguucagucauuugauuaggcuuaauagccagagacuggaucuguucacuuguuuuccuuuuuuaaguacuaauauaacuguugagauuuugaugcauuuugacauaauguucuguuuuggaauacaggguuagugacuuaaauuuuuaaaagcaacuuuacuagcuagaaauuaauuucccuugcuuaacucauauuuuuucagugucuuguaucuauugcuguucaucuuuuauuguaagaaauuguuuucacuuauaaaucucaagggacuggcaguacauagaaacugaaguccucuuuuuguauccacaggauggauacaguugggccacuccagugugagccucuccaugcugccccaucaaugaccuggagggacuuucuucccucucuuagagaggauguucggucuccauagcagcucaguuugguccucuccugaguaaagacugcuuaauuauauggugguuuuaugauuaauggaccuuaaucuuuugaggguagcagugagaccaccaaacucuuuucauuuaggaucucaagcugcacuugaaccccaguugaggugagaggcuagugauuuauccacuaaaccaccuauauagccccuuaguagcaugucuauuuaaccauaauauaaguggauuacucucucagaagcuaauugaugucuguuuuuuaaacaggggaauggaaagauuaugccagcaucuacauuugacauggauaaguuaaaauccacgcugaaacaguuugugagagacuggagugaaacugggaaagcagaaagggaugccuguuaccagccaaucauuaaagaaauuuuaaaaaauuuuccaaaagagagaugguaaauaguaccucauuuuuaaccaaguuuuuaaaguguaugaacacuugaguuucuugauaaaauguuucacagucucgcuucauuguuauaguugcugugugccuguauguuuuacauguguaaguguuaacauuuguuauuggaugcucugugugagauuacaguuguuauuuugaauaauuuuuaugcuggugcuuaggggaaauuacuuagaaauuaaauaauaagguuaggucgaaaauuaucaaugauguguaucuuuuuauaauuugcuuuauggcaaagcaaaaaaacuaaacuuuuaauuccccucauuaugacauaguuguaaacaagugagggaucuguaccucugagcaagcagagauucuuaacuuuuuuaugccuuggaaccauuguucagucugaagcccauggucugcuuuucagaauaauuuuuuuuuuauuuuauuuauuuauuuauuuauuuauuuauuuuuuugagacagucucacucucuugaccaggcuggagugcagugguguggucuugguucacugcgaccucugccuccuggguucaagugauucucaugccucagacuccgaaguagcugggacugcaggcuuacaccaccacgccuggcuaauuuuuguguuuuugguagagacaugggcucaccauguuggccaggcuggucucgaacuccugaccucaagugauccgccugugucuuccucccaaagugcugggauuacaggugugagcuaccucaccuggcccagaauaacaauuuuaagugaauaaauuuaagugcauaugauuacaaagaaaacugauuuugaaauacaguuaucaaaauauuuaaaaaguaaauuugugaugcauguuuuuuuaaaucauauaucacuuuaaauacaauuuagcugcaaguauaauuaugaaauguauuaugaaaaugcugaaugggauauacacuguuuugagaacuucagcuaaugugaagugaaaauaugugugauuucucuucgugauaaagucauagguauugcuaaaacuauuguuuguugccugcauccguaauugaggggaaaaaaucaguuucugaaauuaaaauguaauuuuuucccauucccuucagagacucagugaauucuauccacagaccucuugauggauagaauuuaauccaccuaaccucugucccagguuaggaaccccugauuuagggguauauauuuaacgaaagcuauuggauggaauucagucuuauuuaaagaucuuuuagagaggcuccuuuuccuccucuccuuugccuccguauugauugacaacuuuacguuugaguauuugcuuucagaaauuucaauacauaugugucucuucucucucuuuauuuuuuguuaggacauuuuauuuuauugauuauuauuuauuuauuuauuauuuuuauuuuucacucuguugcccaggcuggggugcaguggcgcugcuuacugcaaccuccgccuccugggcucaagugauucuuguuccucagccucccgaguagcugggauuacagacaccuaccacuaugccuggcuauuuuaacuauuuugaaauaacuuuaaaauuacagauaaauugcaugaauuauauggagaccuccugaauucacuuauacuuuuuacuugaauucaccaguuuuuaacauuuugccacauuugcuuuuauuguuuccucuuccgucuucccucccucccucuuucccuugcauuauguaugugugugucugaaaccauugagaaaauuuaacccugaauacuguuagguaauuuacagucuauauucaaguuucauaauuuacugugguucauacugauaacucuuaauuccagucccaacucuauaggguuauccuugguuuucccucuuuucuguaucuguuuaccucacuuccaacaacaucaauacguuuacuuauucgcccaguugucuacaguacacacagaaugguuucagaauugcuucauccauaccucugugaaaaagaaaccuacuaaaaggaguucgggauuugcuaauaguuauuuuucccuuagacuaagguuguauagugaauuuauucuuugcaguuuacccaaauuagcucucccuuuaaucuucagccuccugguguuuuauucccucccuuuauucuauaccccauuuggauaaucaguaucauuggcaucuuguuuauucauccuuuuauucuugggguuuuuuuuuuuuuuuuuuuuuaaguaaguggaugugguuuuuuuuuuuuucucucucucucucuuuuuuuugacacaaaguguugcucugucauccaggcuguagugcagugguguuaucguagcucacuguagccuuaaacuccugggcucaaguacuccucccaccucagccucccagcuaauuuuuuaguauuuuuuguagaggcaggggucuugcuauguugaacaggcuggucuugaacucccggccucaagugauccuccugccucugccucccaaaauauugggauuacaggcauaaaccacugugccuggccuuuuuguuuuucuuuauaauuacccucuuuggucauccacaaaagauaauauagcauacauguauucuguaccuugcuuuuuucacuuaguguauccuggaaauagcuaugcugucauuucacagagaucuucagucauuuuuuuuuuucccagcugaagauuacucuguuauuuggauguaucauaguuuauucaaccaacuuucuccuacguuagguuauuuagguaguuggcaguaucuagcaauuauacauaaugcuaaaauuaauaacuuuaugcauauguauuuuuauauuauuggagguauaacuuuaauuuuuauuuaaaaauaacuuuauuugauaaucuuuuaaaaaauccauaauauaauuucagaagaaauuucuccugauuuccccuuaccacauuuuagaauauaaauaaugcagaaggaucuguuuauuuuucuuugcagcaguuccugaccaguccauggugagaaauaucaguuggcacuuaauugcaccauaauaaauuauacccaguaaggaugauuuuucaggucuccgugcauggguuauggagauuuuccaucaugcaucuuuuucugcugcaauuauagggccuguauauacuuaugagaauuggagcuaauaucaaagacaaaaaauuguggggcccuuuccccgacaguccaccaaguuuugaggaaaagaaguaucaguugaaauagcucugaagaauuuaucuuccugguucugauaaguagaucucauggucucugauuuaacaguacauauagauaagauuuuuuuuuuuuuuuugagacggagucuugcucagucgcccaggcuggagugcaguggcacgaucucggcucacugcaaccuccgccucccggguucacgccauucugcugccucagccucccgaguagcuaggacuacagacgcccgccacgacgccuggcuaauuuuuuuuuuuauauuuuuaguagagacgggguagauaagauuuuuuaaaaacacaguguaacaacuugaacuuugccgugcaaacucuguaacccacugucaacauaguucuguauuugggcauggaucauucugaagaaaaauggagcucaaauuuuuaaaaaauucuuaaaacuugaagaccuguccaggugugguggcucacgccuguaaucccagcacuuaggcugagccggauggaucacuugaggucaagaguucgagaucagccuggcuaacauggcgaaaccccgucucuacuaaaaauacaaaaauuagcugggcaugguggugcacaccuguaauucuagcuacucaggagucugaggcaggagaauuguuugaaccugggaggcagagguugcagugagucaagaucaugccacugaacuccagccuggccaguagagcaaggcuaucucaaagaaaaaaaaaaaaaaaaaaccaaaaacuugaagacccucaguaccugggcucuuaacugacccaacauauuaauguacauucagagcucagauauaagugauauucagucacaucucaaauggucaaggauauauaguguuuggcaucaagaccuugaagcucacauuugcuagcagaaaaaucucaguuccuuucaucggguaugugugcaggagaguaucuuuaauuuaaauucuuagaagugggauugcugcauaacacauugauuucaguugcuaugggucaggagucugggcuuggcuuaacugguucuucuguguaggagcuuacaaggcagcaauccacgugucugccgggcuguguuuucaccuggagacuugacuggggaagaaucugucacucauauuucauuuuguuuaauugcaguuguaguagugaggcagaauuguuuucacuguggcuguaggacugagggucuuagcugcucucuguuugucaguuggaagccugccucaucuccuagaggcaacccacaguuccuugucuuucccaaaaggaccacuucaucaagccagcaaggagggugucuagaucaagcaagcugucaaccgucuuacaguguugaacagucacagagcugggugucaaggcucaugucuauaaucccaguacuuugagagacugagaugggagaaucacuugaggccaggaauucaagaccaacuugggcaauguagugagaccucaucucuacuaaaaauuugaauauuaggugagguggcaugcacuuguauaguccuggcuacucuggagguggaugccuggcaaggggaucauuugagcccaggaauucaaaguugcagugauaagauuacugcauuccagccugggcaacagagcaagacccugucucaauaauaauaauaauaaugacaaucacaggagggacaucucaucaccuuugccauauucuguuggguagaaacaagacauggggaccaggagguagggagcgugggagcaccacuacagggucugucugccacagucauuacuauguucuucuauaaggguugcacuguuuugucugucuacuggcaguguaucaaagugccuguuuaugcacagcccugacaaauacuguaguuuuaagccuuugaccuuuugccaaccugaugggugggaaauuauauguuggcauagucuuaauuugcauuucucuuaugaugagugaaacugaacaucuucauauguuaaagggucauguuacauguuuuuuuuuuugagaauuauauauuuaugucuuuugcccucaguuuuuuauugaggugaauugcauauaacaaaaguaaucauuuuaaauaauucagggacauucaguacuucacaguauuguacaucugucaccacuguguagauccaaaacauuucaucaacccagaauaaaaccucauacccauuaagcaguuacuccccauucuccccaccauucuccccacccugccucuaccuuuauuauuuagcaguuugacugugaggugucuuaaaugugguuuccuuuguauuuaucuugguuaagauuugcuaaugucuugggguuuagguagaucuauaucaucaauucagaaauucuuugcuaugucucuucacauuauuucucuaucauuuccucuacuucuuucucuucugguauuccaguuacauguauguuaaguaucaaaccauuucaugucgucucuuagguuucacaugacucuacccacuccuucuccucccagcccuuuauaguauaguuuggauaauuucuguuaaccuaacuucaacuucacugauuauuuacuaugcuaaucugcugauaaguccuuugaaagaguucuuggccuggggugauagcucacaccuauaaacccagcacuuugggaggcugaggugaguggaucacuugaggucaggaguucaagaccagccuggccaacauggugaaacccugucucuacuaaaaauacaaaaaauuagcugggugugguggugggcaccuauaaucccagcuacuuggaaggcugaggcaggagaaucccuugaacucaagaggcagagguugcagugagcugagaucaugccauucuagccugggcagcaagagcgaaacuccgucucagaaaaaaaaaaaaaaaaaaaaaaaagaauuucuuccuuuuuuuauaagagagaaagaguuuuuuuuaucucuuauacucauuuuuugauuuuuuaaaaaauuucuagcacuuacauauacaugcacaccccuacacauauacucugucuguacccaaauucccuaucucuuuguauacaugaucuaccuuuugcacuacgugcuuuaacguacuuuucaugguuauuuuaaaaucccuaccuaaugauucuuacauucuguuugugcgacuguuuucuugaaggcuuccuuauaacaauaaguuccacauuuucuugcuucuuugcauguuucuuaauuuuuuuuauugaaugccaggcauuguauguaaaggaauaguagacaauaaaguaauauuaaugaccagaaaaaaaucauuucuccuuagucuuauuaggccacuagugggcugggggguggggagaaggguggugcugacugaaucauuuaagugauuuuaauuuguaauauauuugcauguauuagcugcuucuacuaaucacuuauuuguccauaagccuugcaucuagaaauauggcaauauaggaauauuacugcuuucugaaguuucauaugcuucucaccuuuuauuuuauguuugaugauuuuaauauuuuuccugcaucagaguaguaggaauaucuuugcaacauuaagaaauacuugguauggguuacuuacuuacaccgaaaagaaaaaaaaaauacuuggguugggcaugguggcaaacaccaguagucccugagucaggaggacugcuugagcccaggaguucagggguguagugugcugugugcugugauugcaccucuaguaauagccacugcaccccagccugggcaacauugcaaagacuuaccucuaaaguuaaaaagaaaaaacuuuuuaaaauaagguuuuuauaguuuuaauuccuaaguuuaggucuuugauccauuuugaguuaauuuuuauauguggguaagguaauaauccaacuuuauucuuuugcauauggauauccaguuuucccaauacauuuguuaaaaaaaaaaaaaaaaaaaaagacuguccuuucccgauugaauggucuugguagacucguugaaaauuaguggaccauguauguggguuuuuucuggacucuauauucuguuucauuggucuguguguuuguccuuaugccauaacauacuauuuuaauugccauaguuuuauaaauuucaaagucaggaagugugaguccucguuuguuguuuuucaagauuauuuugggggccucuuguaauucuugugaauuucagguuuuuucauuucugcgaaaaaguuuguuggaauuuucauuaaggauugugcugaauauauagauugcuuuggguaguacugaggucuugacaauguuaaaucuuacacauuaucacaguaugucuuuccaucuauuuagagcuuuaauuucucucagcaguguuuuguaguuuucaguguauaggucuuucacuuugguuagauuuauucauauguggccaggcgugguggcucaugccuguaaucccagcacuuuggggggccgaggcagguggaucacgagaucaggaguucaagaccagccuggccaacaaauacaaaauguagcugggcgugguggagugcaccugugauuccagcuacuuggaaggcugaggcaggagaauugcuugaacucaggaggcagagguugcagugagcugagauugugccauugcacuccagccugggcaauagagugagacuccgucucaagaaaaaaaaauuuauaaagauuuauuuguauguauuuaauucuuuuaaaucaaacuuguccaacccguggccagugggcugcaugcggcccaggacagcuuugaauguggcccagcacaaauucauaaacuuucuuaaaacauuaugaggguuuuuuuuuuuuuuuuuuuuuuuuuuuuagcucaucagcuguuuuuaguguuauuuuauguguggcccaagacaauucuuccaguguggcccagggaagccaaaagauuugacaucccuguguuagaugcuauuauaaauagaauugcugucuuaauuuacuuuucagaauuuuuguugcuaauguaauagaagcacaacugaauuuuguguguugaucuuguacccugcaaucuugcuuuauuagcucuguuagcuuucuuagggauacuuuguggaucacauuaugcaaaaagagaguuuuuaccuuuucuuuuccaauuugaaugccuuuuguuuccuuguuucuguucuuagggagaaagcuuucagucuuucaccauugaguagcugugggacuuucguaaauacccuuuaucguguugaagaauuuucuuaguuuuuuuuuuuuuauuauuuuuauuuuuuugagacagggucucgcucugucacccaggcuggagugcaguggcaugaucuuggcucucugcaaccucugccuccucgguucaagugauucuccugccucagccucccgaguagcugggauuacaggcgcccaacaccacaccuggcuaauuuuuguauuuucaguagagacgggguuucaccauguuggucaggcugaucucaaacucuugaccucaauugauccacccaccuuggccucuccaagugcugggauuacaggugugagccaccacgcccagccaaauuuucuuaaaguuuucuaaagguuuuucugauagagugcugaauuuugucaaauauauuuuuugcaucaguugagaugauauauauguuuuuucuuccauuaaugugauauauuucaucaauugauuuucuuguguugaaccacccuugcauuccugggauaaauaccacuuggucaugguaaauaauuguuuaaauaaacauuguuguuuccaaaaagauguuauauucuuaaaguuucuagcugguauucucucucaauauauucagugcccugcuuuauaaaguaauagauacaaguuuaauacuuucuauaaaguccagguauaccucaaaauucaaaauaucuguagguuuuaauugauaaggcuuuuaauagaaauguaccaaaguuugagugaauguuggaggcugaaugugaaauguuuauaucaacaucauuucuggcacuuaaaacaugacuuuguuuauacucagugauuauagaaucauguaugauaccauuaauuaguauaacagugucagcaauacuaaaaaggcauggcauuauuagauaauuauaagauaauuagugaacuagcacacacuguuccuuuuccguuguuauuauuacuugacaaaauguaaacuggugaggaaaggaugaguuaacucuaaaugguacuaauagguuauuuuuuaaauaaaaauaauuuaaaaccguucugaauaacuaaaacauuuugcaggauuuaaaacuuaaaagguuucaagggauauauagucuccuuuccauaacuguuccucauaacuguuccucaguuacccaguuuccuuuccugaaaguaauuguuauaaaaguggauagguauauaugaacuuuaaaugaaguacacugaaauguaauaucuauuacacuguuuuuuguuacauuucuuccuauguuauuuguuuuacuuacuugauuuagauugauuuccuuauaguagauaaggugagcuaucaaaaaaaccuaaacaggaaaccuaauaaaacacaguaaaggcugcaucaauauuaaaaucguagcuuugucagaauaaauuaaacccuagagccuggaaaaggggcauuaggccagcugugguggcucaugccuguaaucccagcacuuugggaggcugagguggguggaucacuugcagucaggaguucaagaccacccuggccaacauggugaggccccgucucuacuaaaaauacaaaaauuugcugggugugguggcgugcacuuguaaucccagcuaccugggaggccaaggcaggagaaucacuugaacccgggagguggagguugcagugagccgagauagagccacugcacuccagccugagcuggagacucugucacaaaaaaaaaagaaaaggaagaaaagggucauuaauuguagcccuucagaauccagguugauucuagauaaauucuggucaacuuugugucuuucagguaaauuucuaggacucuguuuaugccacaguaaguacauggggaauuuaaugucuuuauacucaggcuggaguuaacacaaauuuaugucagcuagccuuuuauuguguguguguguguguguguguguguguguguguguguguguguguuuuaauuucacugaaggccuuuucuaauugaacugccuauagaagaucauauacuugccgggcucgguggcucacgccuguaaucccagcacuuugggaggcggagguggguggaucacgagaucaggagaucgagaucauccuggcuaacacggugaaacccugucucuacuaaaaauacaaaaaaauuagccgggcguggugacaggugccuguagucccagcuacucaggaggcugaggcaggagaauggugugaacccgggaggcggagcuugcagugagccgagauugcgccacugcacuccagccugggugacagcgagacuccgucucaaaaaaaaaaaaaaaaagaucauauacuuaaugaaauauguguaaaauuaacuauauuuguggucauuaaaauauuuuuccuaaggaaacacauauaucaguuucuccaaucugucuauguuucaaguuuuuaauaugccugaguuugcaagcacaagcagcuuugaagccacagaucgacuugcuuuuguauagagucuguuuguuaauuaaggaaaugcuguuuucguauccucugguuuuuguuuuaaauaguauuugaacacuacucuagugagcaguugcucauugaaauuuaugauauauauguuuuuaauuuaaagaaugagcuuaggguuuaaaccuuuuucucacguaugaacauaaacauaauguaauaacucuucuuaauugauggucagaccuguauguauugaaauuuaaaaaaaaauuuuuccaagugaaugucuaauaauuuaaauauaagaauucagugcuguaaagcuuauaguagguaaggaaauauagauucuuaaguuugcauccuaucuggaaggaaggcuaacauguaaaaucacauuuuuugagucuaaaaguugcuggacuauauuuuuuagaucuuaauuucauuagcccauucaauuuuagaagacuuugaagugauuugugggggaaaaucuguuaugucuuugcauuuuaauauauauacacaaacacuccaaaaagauacugaugcacuacugacugguugaauucguuuuuucuuuuauauaguugggcauuaggaaaaaaauacucugagcuuuaacgaagcauuuuuuuuccacuuaagauaaaauaaauaauguaaauuauaguucaugaaaagauucuuuuagcuaggagaacucauuuuuaaaaagaaaauggaggaaauuggagaaaauguagacugccaaauagugcaggugguaguucagagacuaaagauagauuucucccucauccugagaccaaagacagguauguguuucauauuucuuucaagucaagauuucaagugcuuacagaucuagaagaauaacacaguagaaaaaccacucagcauucauaacccaguagacaaauccuguaaauagaucacagaaaaagaaauacaggacacucaaucucauagggaaaugcaaauguaaaaaccacguuaagaugccauuuuuuacuuauuuuauugcaaagauuuaaaagauaacuauuagugcaggugugaggaaacauaaauauguugcugguggaagaauaaauuagcaaaaaauuauguagaacaauguggcuuauuugucaaaauucaaaugcauaucuuggccaggcgccguggcucacgccuguaaucccaacacuuugggaggcugaaguagguggaucaccugaggucaggaguucaagaccagccuugcuaacauggugaaaccugucucuacuaaaaauacaaaaauuagcugggugugguggcacgggccuguagucccagcaauuugggaggcugaggcaggagaauugcuuuaacccuggaggcggagguugcagugagucaagauugugccacugcacucuagccugggcgacagagcgagacuccgucucauagcaaaacagaacaaaacaaaacaaaaaacaaaugcauaucuugauucuugaaguucaauuuaagggaagcuguucuacauauauauuucugcaugugaaaguuauuuaugccacuacauuaguguagugugggaaguaaaauuuuucaaaauaaaaaguuauucaugcuaaggguauucguuuuaacauuaugauagugaaagauuggaaacaauauaaauauccuuaauuaggagauuuugauaaauuauguuacagucaugcagugaguuaaggaagcucuguguacugcugugaaggagauucagggguauuguauuagaucagggguuggcaaauguuuucuugaagugccaaacaguaaauguguuaggcuuugccggcaaugucgucucuguugagacugcuuagcgccuuguugcaggaaugcagccauaaacaauucuuagaugagugaguauggcugcguuuuaguaaaacuucauuuacaaugacaggugacuggccugcaagccauaguugcuguaccuguguuaagugaaugacgcgaagugaagaaccuugguauguaaacuauaauagaacugugaaugaauuauugaaagcauagagaagagaguucagggaacuuugccugggauauuuaggaaauauagaugaagugauaauuuauaauaauaagguaauugaguuucuguggguaagagcucuaaagaaagucuucugggaucagugagaaguugucuggcugaaauaaagaguucuuuguugggaguugaugaagagguaaguuaggagaugcuaaacacuccugauuuauagucaauuuucuaugaugaauaaaaaaauuuuuggcugggugugguggcucaugccuguaaucccagcacuuugggaggccaagguggguagguuacuugagcccaggaguucaagaccagccugggcaacacggcgaaaccccaucucuaaaaauaaaaaaauuagcugagcaugguggcacacaccuguagucccagccacuugggaggcugaggcaggaggaucgucugagccugagaggcagagguugcagugaccugagauggcacuauugcacuccagccugggcaacagagcaagacugucucaaauuuaaaaaaaagaaauucaauacuagcucuguuaaaccuugacauuuugccauauuugcuuuagaucucuuuuucauauuaaaaaaaaauuuuuuuugacugccucugcagagcagggcuaugccacaggcagugugcucagggcagccauauuuuuuaaaagaagcaauuuuauuuuuauuuugaaaauuucaauguaauaaaagauuauuaaugagauguuuuucauuccuuuuuguacugucuuuaaauuugguguucauuuuacacuuacagcacgucucaauuugcaauagccacauuuuaaguguucaguagccacauguaguuaguggcuuuuacuguacuguacuaugauucaaagagaaccacuguagguacuuaaaaguuguauuuacuucuaccacuaggggucagccaagugucauaaugacccaacaagacagcauuuuguguuggaguuuuaaaauuuacaacugcagugcaaagaucguucuguguguaacaaaggaaaccucugucaagaguaauguuuacugcuggugaaaaagcuggagcagaaagguugauggaagugugaucuauggccucuuuagacacauggacucuguccuuacagauguaucccuucuccguuccuguuugucuugaauaaacuguugaaacuuuuccuccuguuauuagggaggucacauuguaguaaauguacuacugcuucuccacauuugggccuuauuaacuagguaaacuuguuggcuugcuuguuuucacuaagaaucucaaguaggcaccauuugauuacugagccacauauuguaugccuuucuauucuggcuuuaaaaaaaaaauucagccugguuuaagguugucucaccauuaaggucuguauuagauuuguguuucuuuuucuccacagaaaugaccucauagaaaugcccuagacuucauacggauucauagcagaaauucccacuuagagugcguuaguuucaugcacaucacaguuagaggaacuuuucauuaugcuguuaauaucccuuguguaaagaccaaaugaagaaaaucuagcuaagaacaaagauuuagggaaaaauuuucuccaucuuacccauucauugcauaguuccugaucauuuuuucaguucuagaggguuuguuuuaaugcauuucuuacauguccacuuccucuuugucauaaugccaguaauuuacaucuauauuagugucuguuaacucuuaagauaggacuuugauauauucuucauucugugacuugauggguagccuuucaauagcaguuuuaauacaagguacuguuaauauauuuucugccauuagguugagguggagaguucuaugguucuguuuaguuaaggagaauuugauaaaagcagucauuaaguuaacuuucuguaaguuagcaaaauaauuguuguuaacauuaugucacagcuuucccuucaggguagcauaauuucuaacuccugcaugguaauauuuuacuggggucaucagccauuuggaaauugauugcugguuauuuuuauauaaagauuuaaauacuauaugaauuuacuuccaaauccuuuugcuuucuguugcaugaguuugaucagauaauuaaaaaaaaaauucuaaacugagaacagccacuugcugggguaaggguagaaaugcauguuaugauuggacagaugggaacugagaaaagaaagguaauucuccagaguagggguuucggugggucugguagggagugagaaaugagagagcguuaggucugaguaggaugccaucauggcaguucccuuauauaaggaauagcacagaguccuagagcuaugaguuuucaaaagccccauaguguucuuucuuauuuugaagugggacaugcaaagguuauaugggcuacuaguaaagugcccuguugcugcuuggagcaugccaaacuuaaaggccacauaguuaaagauaaaaaaaucauuaguaggaguagauuuggaaauuggauuugauuugugaaccaaauuuaggaaauacaguagugaaguuucuuuuuacuuccugacaugauauuagcugauuguauacauuuuccuuuggcuucuuauaagacuacaauuuuaguuuccucgggauuauauugauuugccaaaauuccugagaaaaagccuuguuuugguaaaacuuuuagugguuugaaaguggaaugauggaucuuacgugaaggaaauauguaauggcaguguggugcuaguagguagagaucaguuugguugugaaccucugguuugguguaauauauuuguuaucauguauguuuaauuagagggccguuucccauuuuccccaugaaaauauccccucccccaaauucuucugucaacuaaaauauauagggauuuagagauauaccugacacauuaaacucuacaucuguuuaaucuaacauaaacaauugaguuacauauaaaauuuagaaauaaaguuauguuguauuuauugucccauaugaugaaguacuuuuguucaaacucuucauauuuaauugggaucccuuuggaauaauuugucuuucuaagauaguuguucagggugacagcuauuaggaauaugagugacuuuauaagucuugagauguaaggggacuccuuuuuucugaaaaauaauuuuugagggguaaaacccucaucugauaucggaacauacauaauaauuccuuauaccuuuuauuuuugauauuuagaaguauuucuugauugugagaagucagagucuuagcuuauucuuauugaguaaaugaguaaguuuuuaguuguuaauguggauuuugucuuuuccuuuuuuucuuugagggguuggacauaauugccuuauuucauuucagggauccuucuaaaguaaauauucugguaccuggugcuggacuaggaagacuggccugggaaauagcuaugcuagguuaugcuugucaaggaaaugaauggaguuuuuuuaugcucuuuucuuccaacuuuguacucaacagguauuuaauuuauuuuuugcuggaaauaguaauuucucagaaucagauugacuuaccuauuuucuugaacaauuuugaauuugaagauaaguacauagcauuugauuauuauauauaucacaaaugugucuuauguuaaaaucaaaguacuuacacaaauuaucacuugaaccaauugccuaguuauuagaguguugaaacaagauggguaagugacuuuauagaaagugacugggcauuccaugaaaugauuucuguacaaaaucuucaggacuaaguaugaaccaggaaggaguauuucuaaauuuauuccuuaagcuucuuuacuuccuuguuucuuuaguuaaauaagaguuuaguuuagcaauuauaacuuuuucuccuuaaucaaguucuuauaaaauggccaaguaugcucucaugacugaguuggaaagaucucucagaacuucuguggccucuuuuggaaggcaguggaaaacaauuguuauuuuuaaagccagaagauguacauugaguagcugccuuguuuaaauaauauguugucucggauggcaguaugaguuuuaggggauuggugaaaaagggaaaaaagaagaggguuauacaaaaaauagcaaacuguuuuaguugaaaccaguaccauuuuaaaaaaccucguuggacuguuauuacuugguuuugaaguuuagaaauacauuuuuaaaaaucugaaugaacagcacauuuauaucucugaauuuacuuuuuuuuucugucuuuaauccauugauugguugcucaucuacauguauauguacauuuucagauaauuagggaagcuguaauagugacucuuuaaauauuaauuauauaugcaaaucuucaauuaaacaguauauuuuuaguauuuaaaguggauuuucuugguaaaauauuuaguuaacaccugauuuuauacucauauuuugcagauguucugaaauuaauaaauauaaacuuuauccuuggauccaucaguuuagcaauaaccggagaucagcugaucagauucgacccaucuuuuucccugauguugacccccacagucuuccuccugguucuaacuuuucuaugacagcaggagauuuucaagagauuuauucagaaugcaguaaguccaaaucaagcguuuaaaaagucuuguccuuuauucuaaauuuaaugagcuaguuuuauccuaagccaagguuuagaucauucauuuugaugguagaacauaaggcauaugucagugucaauuuagaauguuuucaaggucguguacaaggcagugauaggaaauaagaaguguaagauaucuacagucaagaaauuuagaaucuguugggcccauuaauacuaagagauaccauguaaacaaagguuaaaugaguaaugaauaccaaaaaaaugaaagguuauuaguguaagaaggaagcuguucauagugaggcuaugacuugaagguugagagaauagcauuugaggcagacagaaguacaaagauaugaacaaggugauuggggauggcagcacagcuguacuggcagggaaagaaaagauuuaaugggagauuuaaugagauuuaauaggagcuauugcuagaaaagugaauuuguuccagaucauggaggacuuguauagucaggcugcacaguugacuucagccuggcaaacuguugaagaaaucugagcuaggcaggagagaaagggagaugguaauagggaaaguggagagggagauuggcacuaaaaggaaagcaaaauagaauaccgaggguucagcaagaucauugagucaauagguauuuguugagcaccuacuaaguacuagguauuuuucuaggugucaaaagagaacagugaacaaaacaaaaucccuguccacagagaacuuccaauagagaaagugaggcaauaacaaauacaauauuguaaggaagaaaaaauaaggcagggaagacggguuacagagugacuggggagaggcugcugcuuuauauagaguugucagggaaagccuuucuaagaguagaaacuaaaaaaaaaaaaugucuaguagagaaccuugaaagaguacacagacaaaccacugagauauuugaaggcaaaauuuugcagauggggaauggcaagggaagaggaucagggaguagagugagugcuugcucugcucaaggaggagcuaggcuguaguaagcaauggguacaguggugagaggucagccucgagaggguuugaugaggcaaacuuguuggcaggccauagcaaggacuuggaauuguacucagagaaacaggaagccauuggagggcuuaaagcagggauagcaacaacauagauuguuuuuauuuauuuauuuauuuuacaacauagaaaguuuuuguuuauuuuucucugaacucugagacugggacaaccuguacucugaaggaagaaagggagagauggaagauguuagguguuguggauaaggaaugaaauaauggaaaacaucacuuaggcaaguaaaaguccccuuuuucuggagcaagguuugagagaacagaugaugaagguaguccuccaugggaucaagugccuuuauugcaccagcauuuguauagacaccauaccuccuagaggcaaacgguguucucuacuggguucccacccacugcuucugccugccccuggcuccccuuuuucccugguaauuauucgaaguugugguagauguugaaguauuuggaugucauucauuucucaguuggcaacuggugccugcagucuuucugaaaccugccagaauuggugguuaacacuaguuuaaauuugaaugacuauuauuuuguuuuaagugauuuuaaaugaaggcuagaaguugaauagaggauaaacaaaacucuaacaaauaccauuugguaauaauauguagagauuagauuauaauauuaguguuauuggggaugauuuccaaauugauuacuuaaucagauuauugauaucaguauuucccauaaaugacuguuugguuacuguaauuauaauguugaucagaaguuuagcuucuguaucucugucaaauauuaauacucuguaaaagguaacuggcagauuuaaauaauuaauuaaaagaaaaaagcaaaauaacauaacagaugcaguaauuugauuuuucuucauuagauaccugggacuguauugcuaccuguuucuucauagacacagcucacaauguaauugauuauauugauacaauauggaaaauacucaagccagguggaauuuggauaaaucuagguaaguuuuuuaguauuuacuaaaauuuuguauauuaaucugaguacuuacagcuguauuacauuuaacuucacagucucaaaugugcaugaacauuagaauuauguuguaaauguuuuaaaaccacuacaguuuccuuuagacugcauccugguggugaucccuccaaaggcaguggaagcucagaaguuguauauucacacuuaggucagucucacagucauuguaauuucaguguauacuaauuguugaucugaugguagguaaucauucccucauuaucaccaucccacaugcugagacagugguccguucuguuaggaagagaguguucucuuuuucuuucuauaaugaagcaugcggggagauuuuaccucuuccauggaaucuuccucccuaguacauccauauacugggaaggguguaggugugauaacuucugugauuaccuugaguuuaagaaagaauagaaacacaauuuuuuuuaugcaaaauuuuuuuuuacugcauucuacuuacuacucgauguuagaaauuaaauguugacuauaacauggucccuccaguccagaaucuaaaggaaauugccauuuuacuccuuuuuaaaauaaaggggguauaaugauaauauucagguagauauacauguauucuuucgugagauauauaaucuguguucagaaagacaucaugacuagaacauaaagguuuucaagauaaggauuauuauacuacauaaaaggacauaacguacauggucuugagcccuuggccuuccgggugggucuaguuuugugacugauuucugacaccuacucucuuuuuaauuuuaauuuaccagaaauuuugccauuugggacuaagcccuggagguaguaguaagucuuuugcaaacuucucuuaagaauuccuuaggaccagaugaaagcagcuguacaaugcaaucauaauaaaauaaauaucccaaacuguaagucuucuuuaaaaguaguuaccuugggaaauuuuucccaaggaaaaauggaaagauauuaccuacuggguauuugcuuacuguggguuagguacuguguuggucccuuauaaauaccuuguggaaucucaaagcagcccuauauugaaauggcacuauguuauaguugaagagacuuagagucuuggguuaaauaacuagcagaacaguccuguagcuuacauguggcaaagacaggcuugaagcccagagccaauuucuugauuacccucaguuaauuuguaaguuagcauuaacaugacccuguguuuauauaauuaaauuuuuugacccccauuacugaguuaugguaagguuuuauguauuuccagagcaugugacuuucauagaaacagcuuuuuuuuuaacauuuguuuuauugguuuaugaauauuuuauuaaguuauauaauacaauaauuguaacuaccugaagcacauaaaguuggcuccugauaaguauacuguuugauaagaguagauguacuauagugugacuuaugaucugucaugggcaucagaaguaauggagcauguugguuaacaggaagucaauuaggagagcuaauuccauuauggagucucaaaacaauuuugaaaauuguaauaauggagaaacacaguccuuaaaaauaguuauuuggaagguuaguacuuuauaaaguauuaacuuacacaucuuuugcauguauaaguuaaagaauguaaaaaaaaaagucucagaaucagcuuucuuuuaaauguuacuguguucugggcaucuaaucuguguuuuucauuuuuuaugccauguacucauuuuugacuccauauuccuccuaccuaaucucauggcuuuuccuacucuuuggauucccaaucuguaucucugguccaaacaucucucuugugcuccaagccaguauguccaacuuggguguaccacagauacuucaaaauccuugugucucaagaccagccugggcaacaugcccugagaccccaucucaaaaaaaagccaaaacaaaacagaaaaugauuccaugccucccaauaucuuuucuauuaaucaucuacucagguuacccugaagaaaaauacugggagccuuucguuaccccuuuuauuaggucacucaggcuaccauaacaauaccacagauuggguggcuuaaauaacaaguuuauuuucucacaguucugaugacuggaauuccaggugcucaccagguuggugucuagugagggcucuuccuuugauuugcagggguuacccucuugcuguguauucacauagccuuucuuugguugugcauagagggagaaggagugaaugagagcaugagugagcucuuuggugugucucuucuuauaaggacacuaauccuauuggaugaggaccccacccuuacgaccucauuuaccuuaauuacuuccuuagaaguccuacuuucaaauacagccacacuggggauuagggcuucaacaugugaauuuggaggcagggggacacaaacagucaauaggaccucucuuuuuccucgcuguuugucucuagucagucuaaaaguuguaucuccuaaagcuacuuaaucgcucuugaauauccuucuauuccaggguuucucgauugugguuuugacauuugggcuggaucauucuucagugggaguggugagggaagugggggucugaccuguauaguguaggaugguuaacagccuuccuggccucuaagacuccaguaguaccucccaguuuugacaaccaaaaugucuuuagauauugaaaaauguugcccuccggggguggaggguguuggcagagucauccccaguugagaaccauugcuccaauuucaugguuucuugccuggauuagcauuaggauuacuguaguaauuuccuuaaggacgccccugccuucaaguugucuucggcccuuuucauuucuccacauaaucaucagugaccuuccuaacaugcaaaucuguuccuguaagacucccugcaugaaauucuagcuuucuggaaaaccuaaacucuucaggauuauguuuuuuaccuucaggauuauuuuuuaccaccccuucucugaccucaagugccaguccuuugacuuagcccuuucuuucucuucuguuuucccuugguuaguccuuauguguucuuaaacacuuagcucaggugauccuuucggguuggguuaaguauucuguauuucuuauguucuaagagacucugcuguaacauauacuucaguuugguauuagcacccauaugcuuuuguuuccacugcuagucucuaagcuccauaagggcaaagaucuaaugcuuccuagucaccugguacaaagccuggcaaacaauggguauuaaugacuguuacauguauguaugaauguauuguuucaaaauuugaaaaagggaacauacuaagaugucucgaagagaugaugaagugccaucuauauugguaaauucauaacauucuuaugguuuuggcuuuaauuauauagaccuggaggcuuaauuuacccuguaaacugagagaucaaccucuuggggaugauuuuacccuaacccugcuuagguagacuagaacaucaauauauucauauauaaugggaaauguaauggccagccauucuggaacaaaugacauuggagguaaaauuauauaugaaaauguugcccaaacugcaugaaaucagauuugguggggaucauuaauuuacaaaugcuuuaauuaaggaggauuugauggacucuuuaacacuacccaguuuaaggaaagcuaguaagccuuuuaagggaacuauuaugcauauguccuuuggguaaggcuaugauuuuggcaaagaacaaaagaaugccugugaauucccuuuuucaguuuuucauccugaccagcacuccuuaaacacauuuauuuauaauuucuucuaaaaagaaaguguguguguauguauccacugauaaauuugggagucagguaguggagggcaggcauuuagcuacaucuggaagaauuaauaaaaugaaucuaacuacaucugaagaauuaaaauguaacuacaucugguaaaaguaccaaaggagaucuuuguaaaguguacugaaagauaggucuuaucagauuuuagagcauuaugaagcuacagaauuuuuuuuucuuuuuuuuuuuuagauggagucucacucugucacccaggcuggagugcagugguaccaucucggcucacugcaaccucugucuccuggguucaagcgauucuuaugccucagccucucaaguagcugggguuacaggcgugcgccaccacaccuggcuguuuuuuguauuuuaaguggagaugggguuucaccauguuggccaggcuggucuugaacugccgaccucaggugauccaccugccucagccucccaaagugcugggauuacaagcgugagccacugugccuggccuagaauuuuuuaaaacgagauucccuuuaaaagauagaugacugaacacauacagcccuuuccucauuauaguaguaguaaaaauauaaaaagauauaaaacacauggacaaagaauggcaggcauguuacugggggacaaaauaaugugccaguuuuuagaaguugggguagauagguaaguuuugcgaagaaaaacacaugugagagccaccuuacccgaauaacucuggaaaacgaggugcuguauggaaaaaccuaacuugaaaaucuguauauauugaacaguugacuccucuauaaucaagaugccuaccuuauaugcccauuuccacuccaugcucaggugagagaccauaaguuuaauucucuagaaaaaguaaauaggaaaggagcaggauuuaggaaagcguguccucauauagaaugggggcgaaauguagggcagaaaagaaggggauuaauuaaaaacuuuggaaaaugcucaagcagugaacgucagcccaagccaucuccaaccccuacccugccuauaaaacguaccaagguuuggccgggcaugguggcucacaccuguaaucccagcacuuugggaggugaggcaggcggaucacgaggucaagaaauugagaccauccuggccaacauggugaaaccccgucucuacuaaaaauacaaaaauuagcugagugugguggcgcacaccuguagucacagcuacucgggaggcugaggcaggagaauugcuugaacuugggaggcagagguugcagugaucugagauugugccacuucacuccagccuggcgacagagcgagacucccucuggaaaaaaaaaaagaaaaaaaaacuuaccaagguuugaauuccagauguuuugcacagaugcaagucacauuucuuggagugggcaugucaauaucacuauaugagcuuauuuuaaaauuaauaacuguuucuuguaucuuuuucugucucuuaaaucuuuaugccuaacuuuuuagauuuuucagccuuuuuguggcaaucuuuauguuuuaggugugucucuuacaaacagccuacaguacauuuuuacuauccagucaaacaaucuuucucucuuaaccagaacuuuuagagccuuacagguguaaaugguuuaaauccgccugucacagauuuggcaagugguuuggcaacccccuuuaagcuaguuccuguucuuucgacauaucccugucacuguuugguaccuccuuugugaaacaaccagauauuccaagcccaucuuguacuuugucugaccagccauuauuuccaaggauuccuaguuccuuuuaauggggaaugguuuguagaaauggaaaaucuaguuccuaccaccgaagugguauuuugucuaggccuuuuuggcaaacaggguaggaaauauauguauauguccgucuguaaaaaucauguauaugcguguauguaaaaaucaucaaaggagggccuuaagaaaaacuaaacacacacacauacauacacacaaacauacagacaaaaucguaaguucauacugauaacuuuaguuccaaugcaacacucaguauaaaauacuaagguggcagguagcuuucaacacuuagaauauaucacacccaguggccucuaguuuccgucuuugcuguugagaauucagcuuuuuaaaauguugcuccucugaagguauucuguuuuuuuaagauuuuuaccuuguaguuuuaucaggucuaauauuacaucuagguguggaguucucuuuuuaauacugugcacaguuuguuaggcuucuuaagucuaugaauugaccuuaucaguugugaaaaauucucagcuuugcggggggauccccucucaccaaucauagguuuagcauuaaaauauguaacaauagccauuauuucuucacauacuuccucugccucauucuuuuucucuguuucuucuggaaaugcaaucaaauauauuuuagaacuucucaugguagcuuucauauaucucaaccacuucucuugcuaucuuucucgccaugcugcacucuggauaguuucuucugaccgauagucuuuuauuugaaaauacugagcauauuauuucugauaauucugacaucucaagucuuugcaggucauuuucugcuuucucuugcuuuucuugguucuuguucaugauuccuuguuucucugugcuguugacuuugaguguuuauuggggauuguucaugagaaaucgcacuuuggauuucuuaaggccuggguugaaguguuuuuccccaaaggaauuugcauuugccacuuuuaaagcaucagaucuugcaagaacucaguauccugagaacagcauggggggagccaccccuaugauccagucaccucccaccaggucccucccuccaugugggauuauaauuugagaugagauuuggguggaggcacaaaggcaaaccauaucagcaguaaacuauauuuuuagauuaaaaaaauucuuuaaagggggaacaaagagaaaacuacccagcaaugaaauaggcuguacaacauaaauaugcaaguuauuuuaauaauaaaaaaacuggaugacguagcucaugccuguaauccugacaacuccugaggucaagccaggcagaucacuugaggccaggauuucuagaccagccugggcaacacagcaagacccuucaucucuaaaaaaaaaguuuaaaaauuagccagguguaguggccugugccuguagucccagcuacuugggaccugaggugggaggaucacuggagcccagaaauucaaggcugcagugaacuaugccuaugccauuguacuucaaccugggugacagagcaaaacuccaacacucaguaaaaaaaugaaaaaaagaauaaauguaaacaaccuauauacagaaaaaaauguucauucucacuguuaaguaaauaaacauaaaugugcuaccauuuuucaccuaucauauucacuaaguuuuuaaauuugcuuacuuaaagcuuagguaaguacagugagaugggauaugcucuuguucuguuaguggggauguaaaaugauaugacuuucuucuagaaaaacaguaacauguuauaaaauagugugugggaaaaccuuaaauauucauacauuuagucagggguuggcaaacuacagcccaauuuggccuguagccuauuuuuguauggcccuaccacuacaaguauuucuuacauucuuaaaggguaauggggaaaaacacaaauaagaauauaugcuagacacuguaagugggacacaaagccucaacuauuugccaucuguccuguuacauaauuaauccacuauuaccuauguuuauuagauuaauuauacuucuagaagucugucagaggcaaauaaucagauaugggcggacuaaagacugaugaaauggacagacauacucagcaagaacuuagagugaacuuauauuucuaacaguaauggaguggacagucauaagacauucauacaguaaaacuauuuucuagaaauaaugaaauagagaaauguuccuaaugaaguauaagauguaaaacuguauauggaauauacuguacaucaaggaaagacugcaaggagauaaauauucaagugcuuacucugaauguuagacuuauaggugauuuuuuaauuuuuuaaugcuuuuucauguuaucucagcuuccuaguuuugaucuuauaaucaaagaaaaaaacauaucuuugcuccuucuguuauggccacuaaaagaauaugaagaaagcugcgugugguguugcaugccuguagucccagcuauuugggagacugaggcaagaggauugcuugagcccaggaauucuaauccagcuuggguaauauaacaagacacugucucuaaaaaaaaaguuaaauaauuaaaaauuaaaaaagaaaaaaagaacgaagagacaugagaguugagaaaauaaagaacccuuugaggaaugugucucuguuauucaucuucauauauauccagugccagacauuagcuaggugcuugguaaacauuuguuuaaagaaugggcaacuaggucgugaauaugaaaaacugcucagccucaaagagaugcaaauucaaauuauauauaauuuuccccauaucaaauuagcaaauauuuuguuuaauaaaaauucuuguuguguuuuuuuuuuaaguuggauuuuuuuggagauauaauugacauauaauaaaauucacccuuuuuacaaauguacaguuugaugcauuuugaaaacuggauaauuguguaaccauggccacuaucaagacagggaaucuucccauuuccaucaccccaaaauguccccuuguacuccauucucuccucuuacuccuaauaccaugcugucacuacuuuggauucuguuacuauaguuuucccuuuucuagaaugucauauaaauagaaucauacaguaugcugcuuuuugucucuggcuuucuuagcauaacacuuuugagauucaucauuuuguugcauguacuguugugguggucuuuuuuuauuguugacuaguuuuccauuugauauauuacauuuuguuuauccauucacugguugguggacguuuggguuauucccaaauuauuaugauuaagaauaaaguugcauuaaauaugaguauaaaucuuuguguggcugcaaauuuccauuuauccugcguaaauacguaccuaacagaauugcugggucacauauggugaguguaucuauaacuuagaaacuggcaagguguuuuccaaagugacuguacuauugcauucccacaauuuaauauaagaugcugaaauaaguacuuauugcaauugugagugaaaacuuauaacucuuugggaaagcauuuuuggcauucugaaucaggucaguaaaaauguuuauucucuggccuucaagaaacaucuuuguaagggauaaucuaaaauaugcacaaggauauuugucaaaguaccauuguauuagaagacuaaaaauauacacuccagcuguugucuuugguaaaauuuauaaauucagcacuaaguuaggcauugugguggguucaaaagcaacuuaagauguguuccuugacuuacauaacuuguaaucuagugagaaaacugugcuaauugccugaaaaauuuucacugagcaaugcaacacagcauuaaaugaguguuaaaauaugccacauuaagaagaaugagcaguagggaugaagacuuggauggauuucagcaagguuuugaagcacggcuaaagcuugaguuggaggguuggagcuuucuagguggaacacaccaugacuagagguaaaaauggucuaaguauguaaaaaucauuggaauauauguauguauguagagauaauaaaacuauguuauuggaggcucuuaauggaacaggaacagcauaaucuuuaaaagcuggaaagacucugcugugaggcucugcauucuuauaaaagcuuuggguagucuaggaaacagcagugcucaggaaaugguagaaaacaaucauuuuuacugguacuaauauaacaaauuucagcuugauagaguaguuugauaaggaaccauuguuaucuuuuguaaguagcacuaacauauacauuauauucauggucauuuuuucuagucguuuauguaggauacagaaaggagagagaaagaaaaacuuuuuuacccugugauccacagaauguuaagccucuugguagcagaaccuuugucuuguuauuaaauacuucugucuuccaugauuagcacauuguauggggaguaggaguagagagcugguugcaggauuuauaauuaacccaaugaaagguaaagagaagauugucuagauuagccugagguauauauaacuguguuaagugauaaugguuccuggaugagguugauggauugggcaaaaugauagauugaaagauuugaaaaucaugcuuuaaaucauaugugcauuucuugaauguauagaaugagcaaauaguaaagggaggaugucauauaaacaguguaauaccugccauuuacuuagugccuuguuuaugacagguguaauacauauuaucucacauuaaagucauacuacagggcacacacgguggcucacgccuguaaucgcaacacuuugggaggccaaggcugguggaucacuugaggucaggaguucaagaccagccuggccaacauggugaaacgcugucucuacuaaaaauauaaaaauuagccuggcguggcgacagguuccuguaaucucagcuauucaggaggcugaggcaggaaaaucacuugaaccugggagguggagguugcaguaagcccagaucaugccacugcaccccacccuuccugggcaacagagugagauugucucaaaaaaaaaaaaagucauauuguagaugaaguggaguuauugaauugcccacagacacacaauuauuagauguuagagcugggauaugaacagugcacuuaaaaaaauaaaagccagcucuaauguuacuucuuccuuucaggaaaccuuccauauaacuccuguccaccuuuuacuaccuagguuaacuugaggcuccuccuuuguuuucauaugauauacaguugguaacugcaguuuugcauuugcuuauggaauuauaauugcagaauacauuuggaauuugaggacuuagcauucucugauucaucuacuccuucaguaacuugcaaguuaaaggugaaggcccauggugugaaucacagugcaaggcagguaugccagagggacucacuccucaugaguguaggcccaacucuugagauacuaggccaaauuuucagaggucugggcauuuucagcaaaugcccagacuuuuuauguuugucucauccaguaccuaacuuacucaacuuggaauucaguguaacacagcuaugaguguauguuuauauucaaguaauucauaguaucuuuaaaccauagguccucugcuguaccacuuugaaaaucuggcaaaugaacuuuccauagaauugagcuaugaggauauaaaaaacguuguucugcaguauggauucaagguagagguaagaauggaauaaaauauugccaaaguuuaacucccaaagcaccucaacagaaguguugauaucauggcuguuagugacuauuugaauucucuguuuucuuaucuauaaagggaagauaauacagguugaguauccccuauucaaaaugcuugggaccagaaauguuugggauuuuggauuuuuuuccaauuuugcaauauaugcauauacgugacauaucuugggaggggacugaagucuaaaugugaaauucauuuauguuuuauauaugccuuauaagcauagcccgaagguaauuugauacaauauuuuaaaauuuugaccaccugccacaugaagucagauguggaauuugucacuuguggcauuauguaggcgcucaaaacauuuuggauuuugaagcguuucagauuuucagauuagggaugcuugaccuguguuccuuaguuuucagaauuauaaggauuugggauaauguguacauaaagggaaaacuacuuucuggugaaauagccuuucaauaaaugguagccgaucauuauaauacugaucuuacagacucucacugauagaaaguagaguaggcucuggggaaaacaaaagggggucggagggcagguguaagagggauauucacaauauguccuuguguacugcuucaucuuuuuuuaaucaugugcauuacuauaaaguuuugugauauuuuggcuauuguguuucaguucauuuauuuagaagcauuccauuuuagaaacaauagguuuguuuuuaagaaugacgagaagcaacauauuauaguaguucagagcucaagacugccugaguuugaaucucaguuccaccacuuacuagugugacuguucuuuguaaagugagacuacuaauauuaauaguaccucucuuauggggguaguuguauguaauaaaugaauaugcuuaaaauagugccugccacugauacauaugugcucagaauuuguuagugguguggucaugaugacugucauaguauuaugauuauuguuugcauugcagguggaaaaagaaucuguauugucaacauauacugugaaugaucucucuaugaugaaauacuacuaugaaugugucuuguuugugguccguaagccacaauaauggucucaagugauaccaccuggaaaaaaguuuaguaagaacaaaugcugaaaucaacgacucaaaaucaacuaucagugaugacaggacacaaccucaaaucaguggugccuucuuauuccuaacgaaauuuagaaauagugucuauuuucuuaauaugucuauugcuuuuucagaaauauacuaugccaugcagauuuguacuacacaaguaaaaauggaggaaaugucuugaaguauacuuuuuccuugaagcccagaauuguguuucaguaggaaaaaaaccuaaucuccagugucuucaugaugcuguccauugcaagucugccgaauuaaugacuaauaguauugaaguacauaauaaucuuccuuuuuuuguuguuuuguaugcauugcacauguaacuuuuagaagagucuaaggauccucagucauauucaacaucuggaguugggacuuuguucacuuucaaucuaagaaaacuaugcguaaaauaugucuuuuuuuuuuuuuuucuucagagacaggaucccgcucugucucccaggccggagugcaguggcacgaucauagcucacuguaaccucaaacuccuggacucaagcgaucuuccugccuuagccuuagccuccugaguagcuaggacuguaggcauguaccaccgcgccuggccugugucuauuuuaucauucagauuaauuuaauuuuguauuuucuggcucagaugaacuuaaagaagcaucaaacauuucuuuuuuaugaaauguuaaauuuaauagcaucacaggccgguaaaauauauucaaguaacagaaauaucaaagucuuuuggccacaauaaacugaacacuuuaugaaagcauacucaucauggaucacuuugaaauauacgagaucucaacauucaaagugagaaauaaaaagccuuuauuaaaaguagugcuaggaaacagagaaaauaagaauaaaauuuacccauuugaaauaugugauuuucagacucuaaaugaauacagaguuugacagugugauguuuacaauaaugucuuuucuuuagaauaucuggauuaugaaagcaagcacuuuuuucauuaaaaaaauuauauacuaggaaaaacugucauaauaguauuaauguggggaauuuugauuaugaaauucagggauauauuacugcccguggucugugucuucaauauuguaagcagcagccaucauguaauuucagauuaauaccaauuuuguucccugauagauggagcuuaaacaguauaugcugcuuuaaauuucuaccucuagcagaucuuuauuggagggaguuuuccuuuguauuuuuuaauguaugauauucuguuuccaguagcuuggaaaguagagaugacuaauguuuuagccuuuucuuggagaaaaggaagaacucuucuugaauauuuucacagaugauugugauugcuuuaaaugaccucuguggcaauuuaaauuagauggauuuaaucucaguaaugugcuggucgcauaaaugucauguuuuaauaggaaaaguuacuuguaaaucuuuagaccuuuguugucacuuaggcuggggagucacuacccuauuuggcaucuuacuaguuggggggaccuuuuccguguacagugaugggacuuuugugaccuuuacucucacuaugcaauagaggguuucauguaguuaaucugacaugucaaaauugggaagacuguaaccuuuuuuuuuuuuuuuuaagauuucucuuuuuugugucccucaauacuuagcagauguucauuugguggaaauucuuauuacuuacaugaaugaguuugaauuuaguggcaaggaagaaaaaaaaaacucaaauuauuguuuuaaaagaagaaaacuugcaaaguacauaaguauuuuuuaaaaaucaaucgaacagaaaggaaugcaugcuguuuuucaauggcuuagacaugcuuuuuauucacugacuaguauucacuuuuuuacaacuuguaucaaaacaaaugaucuuuguuuuugucacaggcaaaaacagguugacacugguggguuggcuuuauuaauuaauuuuuuuucuauuagguuuucuuuaauaauguuaaauuucuaaauuauagcauauguuuuaguuaauucugaaaucaguuacuucauuuguuaauuuaucccucauaucaugaauauuguuuuuuaaauguucuauacaaauuugcaucacuucuuuucuuacagcuuuugcaguuaauauauucuaaacuugaaaaugugguaucaaucaauaauagaaguaucacuggaggauuuauuuagcuuuguauuucuuaauuuuaguccuagcuacuaaaguauguaagccuuaaaguuuaaaauguuuuucuuaaauuagcuuuauacacaaacauuuucauuuacuuuaugaaaugggaggagauaguccacugugcuuauguuuuuuuguuuaauuucuauauucugaagcagugcagauauaggguaugcuaaucaagugagcaagguggaacauguacaauauaaggagaagcuguaaaaaucacaguauaaaauuaugaaguuugguaacuguaaaauguacuguauuuauauguaacucucauucuaaaaguugccacaaaagcugaauuggaagcuucaugucugcaugaaauuuccuauauuuuuaauguguaugaugaaauuaauuuuucuugaauauuaaagucugccaauugcuaugaaacgauaguugcuugguuuucaucuaaauuaauguaacuauagauguggggauuuuaaugaguugagcauauauacuuuugaacucuuggauuagccuauuuuuauaugcuucuaagaagucaguaacaugaauacuucgccuuauaauaugccaggccuuauacuaacuauuuucacuuuguuucauucaaguucacuguaauaaaguuagaauccauugaggaaaaugaauaaucuugauuuucaguuuuguuaaauaauggaaaaagaacuauaaaaggaacuaguagaagacaguucuaggaccagccaucagugggaugagcacuuagaucuucuggguucauuuuccugaa

SEQ ID NO: 18779 - RNA, 17273 nt, Homo sapiens
ucgaagccauaaggcaauucuuuuccuuuucugggggugaauccuuacgauucuugggggagggaaugucugcccagggcuggagacaaagcgugagaacuaggauggcgaaaaacggguuugaaugagaaaauccgaaggagggaggcugagggcggacaauuggguuaaaaauagaaacgcauccuccacaggacucgcucuucccagcuccacccuaggggccgacugccaggccaguggcugggcuccgcgagaaggcacagcaacccgucucggccccgccuccuggaccuacugacagggcaccgggggcguggccuugggcccgcgacgucaccgcgcuccccgccgccgccgccgccgccgggguuuucgcugacgcacgggucccgcccccucccccucuuuucccucacagcccgggcgccgggcggcgagugcguuagucggccgggacgcggagcugugugcaucuccuacgcgggcucgcucgcucccgggagccgcgcagcuuccccggcgguggcaggagcggcgaagagcgccaucagcgggcccuuacggccccaggccucgcggcgcgcgguccgcucgcccuccucguccgcccaaccugcggccuguggaggcgugaggcgacgacaggcgagcgccucgagcagcguuagccgcugcggccgccgguccucccuccaccuccuccucggcccccccucgcuucccuccucccacuucccgagcuccggcgugucccggccacgcucgacgcugcugcaggaacaaaggaagaccccgcggcggcggcggcgccaccuccgccugcugcuccgacccgcucccggcccgcggcggcggcaccagggcgcccggcucagccuucccggaggccucggcccggccucaucgugccggcuucgcgcgcgaacccggcuuucgcauuugggacccugcagggugagugauacggggcugcgggugggagccgggcuccuuguugccgggccgggggcgggagugaagggaccggggcgccgcgggccaauggcgaagccggagcaggccgcggauggcggcguccgggggaggggagcccgcccgccagcccaggaagcacaaagacggaggcgucauccugucgucguggcccgagaccuggcucccggcgucccuggcucgcuccacagcacggucgggaaacaaugcacggcgugccgccucugcggggccggccucuaggccgcucgccuccgcggcggcgcccggcgugggcaccacgacccagagaaacaaagaggccgaggcggcggccgcgcccccugcccguugcagcccccccuagcucuccccuaagaggagccguucggggucgggggucgggggucggggauccgcguggggccugcaggcgaagggcuggccgggccugcugagcugcuguucugcaugacucagugguuuucggagagggcccuguugggcuuuauugagugaggccuuugcuuagagggggaugggguaucagugggacccgaacuuguuccaaaauccauuggaacauggggccggggguucucggcgucgucuuuugggcuucucgacgucgcugcguuuuuauccugagauccguuuucauggaggaaauggaacaccuccuuuguuuggugcauuuaggcugaugaaugugaaauuuuuugcucgcuuuccacgcacuccguggagguguguuuucggggaagggucggauuaucuuuauugauugagugucuccuaagggauagcaucuaaggagauaccaagauaaaggaacauauaggucacacauccccguucuuaaaccugggauuuagauacagacuucuaaaaacauaaacgaauguauuuuauuccuuauuuuuaggauuuuuuuuaaagaguaggcuuucagaacucaguuggugaaaauacugcaauuuuaucuuugaaguuuuuuguuaaaauguuuccccacaccccccuaaaaaauuaaggauucuuuguaguugucuccuguuuucuaucucccaggcccugaaaaggagccuuuaaaagucaauucuacuccauuuggcaaagagggaacugaaaucuggaaaguaaggacuugcccaaggucacugacuuaguggcagacuagagacuugaacucaggucuccauucccaggugagugggaauucaugccaucucaucacaucaugugcaccugaaagaacuguauuccauagguguaaaagcucuuuguucagaauuggaauuggagaauuguucaguuacacucggguguuuuuuuaagcuguaaguuagaggaagccauaaacuuuauaaaaucugcauucuagcuauaccugauagagcugacacgugcaugcucaaguugcuaauuacuuuaaaggcaauaaauaguaaugguauuuuuuucuaaaauacaaggggaaugcaauaccuaaugggaacacacaucccccacuucauccccuaaauccucacuaaaugaggauucuuuuuuacacugucuccacugugcuuaguuuuuuaucaacaaccuugaccauuuuagcuuugacuaugcuuucaucuucuagauugagauuguucuguaguuuuuccuacauuaggaaaaaacuagcagcccuuuuuuuguuuucuuauguuagauauaugaacgcugcauccuuaguucuugggguuguguaggaguuggcaggcuuugagauauaaauagaagcugauuucagaggccccuguugacuaggcuuuaugugagagccuccauccagcucagcuugucacauugcagccuugugacaggcugaagcgcccucccaugugaucugagcuucugagaaauauuaaagcaagcugugcacaugugauggcauuuaaaagcuggcuuucuaggggaaaaaaaucuaaaagaugggaacccauguagaagacucauguccugguaccucuugugugucucgcaguugaaaguuauuuauaaugaaaugaagguagacauguucucugaagcaaaguuggaauacuuuguuaucucugagugugugaaaucuuuagauggaguauccuccauuuuaucuaaaacaaauauuuuaagaaucagauuaacuaaaauuacuuagguagguugaucgcuuggccuuaaacuuuaaagccaaugucacaugagacugggccucaguguagaaaauguaagcuagcauacuuaaacugguuuuaaggagugacccaacuuucaugcauagggcaaacauucacacauauuuugugcguggugggcaugcaaauacauacauauuuaucauuugaaagcauuuuuugcuccuauuaugcucauuuaaaaacccagcugaaaguguuuauuaauaaacuuccuaagugauguugaaauguuuacacuacccugcuccaaaaugagucagcuaaauuccaguuaauauuuaaagagacagugucaacuaaauuaauacuguuguuaaaaguaaguuguggaucuuggucacuccacacaagcuagauugucuuaauauuuguauggugcacuuuuacuuacaaaagggaagauaaaauguuuuggggaauaauuaccaggggucuggccaggucaaaauugguuaguccccuucucccaucuucuaauuuugguaguuaauacuuguuaaaacaucguuuuuuaauaacucacuaaaaaguguauucuaguauguaguuggaaaaaaugacugaccacaaguuacagcacacgaauuuuccuuuaagcaaaugcucucaaauaugcuuuuuguacauaugcuuauacauguuuaagaugacaugaaaacccuccacaacuuuauuuuaaaauaauuuuucuuuaauauguauuuucucauccagaggaaaacuuauuaauaauuuagcacagcguuuuaacaagacuuuuagaaaagcaaaucuuccuuggaaacaaaugcuugcuauguaaagcuuuuucugguaacccagcauugaauauuaaccauuacuaaagguuauguguauauauugacuuuaauacauugaauuugagcuuggaacgguuuuauuauuuucugguaugaggaagacaagcacuuguuaaaauuaauagugccuuuggcugagaaaucugguucauaauuuguguauugcagguuccuaggcacuggcuuugacauacucugaaacuucaaauggagaacguaaaaggaguuucguaaaccagcugacccuaaauucuuagagauuuacuuguuggugccaggguagcaggaagggcuaccaguucucuuuucagccuuauaugaagauguuucagcauuaaaaaguacagaugcucugccucagcagauuugucaaauuacugaugaagcccagauauguacagguguuuuaagaaaacuuuauucauccaguuuaaagaacuaccuauaaauaucaagacucagugauaauugugauuagccaauuaaguaaaaacauuugaaauggucugccuguagugcagcagagugaaaaguuaaagauaccaguuucccaaauugauuaaaacauaacccugagagcuaacagaccuuuucauaaauugaaaccaagaauagugauagguaaaaauacccuaauaauugauaaaauuucuuuuuggguuuuuuuuugguccuaaaacaguuugcuuuuauaaaggcaacaaaauauugauaauuaucucugcccacccuuuuuaaugauuaacggaauuugggcuuuuguuaaaacuugcguagcaauuacaacgguauaccgaugauuauauuagacuauauuuuggugauaacacuaauuucugaaauuucguuucaucuauagcagaaaaauauggcucaggagacuaaccagaccccggggcccaugcuguguagcacaggauguggcuuuuauggaaauccuaggacaaauggaauguguucaguuugcuacaaagaacaucuucagaggcagcaaaauaguggcagaaugagcccaauggguaaguuauuuccaaggaaaaacacauuugaaagaacugguggacagaaauacagaaccaagaauuggggcugagaaugcugaaagcacauggagagaacaccugauaagagcuugaaauucaagcaacagcccaagugcuugacaugacugaucaggaaugaaugacuaucuacaagcaucuuauagcuuuucaguuuucuuuuuugggguuauuuuguuucacacuuguguucauuggauugacuuuuuaauauuuuuuguuuggauacucaaguauaggauuacagcacagugaaugcuuauaucacuaaccuaauuaaaugcaaguauuuauuacuacgucuugauacuaagugaguuuuuguaguguucauugguuccuuacaaauccuuuuuuuaaauaggaacagcuagugguuccaacaguccuaccucagauucugcaucuguacagagagcagacacuagcuuaaacaacugugaaggugcugcuggcagcacaucugaaaaaucaagguaagauugaacguuucagaguuuuuaugauauuacaaagaagaaaucaagaugucuguacugguccaauaauaaguuaauagauacccuuggcuuugcaaucgaggauuucagugucuuuuaauacaugacucuuaagucauugaguaaagauguguguuacuuacaccugacucccuaacccccucaaggauacuguguuggaaaugcugugcuuuuuuauuucuuuguaauugagguuuagggauugucgagugagacuguagaauauuauugggccagacaagguguuuuggcagagcugcccuuuugcccuuaaacaaguuacaggcacagcuaaaaaucccuagcugguuguaaaauaugguaaccuauacaaaaugcagccucgaguucaugagccauuuaucaaacuuuuuucucaaccauuugugcugggcauccaauuuuuuuuuaaacuuuagauuaucuagcuccauuugcucauuuuggaaauauucuauaauuuaaaguugaacugacaacuuauucauugucucaagaaguacccuuaacaccuuuaaaaauuguuugcuugaacucaaauagaaaugugccuguggcugccuugccuguaacucagcaaaugacagaaaugagcauuucaagagaggacaaaauaacuaccccgaaaacagaggugucagagccagguauguuuuucauuuaauacuuguucaguucugaauuugauagugcaagaaauggcugguggggggauucuuuccuucccauugaaggaccaaagaggagggagagccauaaaauauaggccaagcaaagaacuacuaucuuuaaaaguaucuugaguaugaguaucuugaaguguaaaauagucauauuuauucucaguuucuucucugcucauccccugcacuacccuugugcauaaugggcaaagucuguaaucuggagauuggauguguuaaaaacuugaugaaguuaaauuucaaggguauaaggaauaauuuuauaaccaaaagcaguaacuuuaguuuugauauugucaauguuguggaaaacuuuuaaguagaacaacauauuugaacacuagaacuuauuugaaguacaauauuccuaucauauuuugugggaguuugaaacucaguguggaaaggcauuuugguuuucaugagauauggugacuuuggaaacuuugcuuauauagcacaaccagaagugcccugaugguggaagaagacugacuugaauuaccuguacuaggcccuagaacaaaaagauuucugugcuuuauauagugcacguagcuuauuuuaucaauuuguucuuuuuuggcagagugcugauuaaaugcaauauaaaacuucuguugugaaaaaauacugucagugguuauacagucugcuuuggaggcuggcuuuugcuaacagcagucaaguuuguuuauuguauuaaucuuacaaaguuaaggccaaauucucaaguuuggcaggugaaucuauauuuggcauuuugaaaugagcuccauccuuaaacugaccacauuaguuugcccgugaugccuuuguuuggguuuuuguuuuugguuuugguuuuuaaauacaaaauuacucugaccuuggaagaauagucuuggguuagagcuagucugcauuuauuauuacuuaguaggcauucugugauucacugcuauuugccuuuucugugucauuuucuuauucccccuucuucccuugucucaggagccguaguucauuuuucagauguggccaaagaaauggcugacacccucccucuaccccauacaacuauuccccuagauuauucuuuauccucaugacaucaggauaaacauuaauguugucacaguagcaguagguagaauauuguucguuuagucuaauauuaggcuauuucucccaguagauucauugcuaaugcaauugaauuauaaauuugggcagaguuuuagagaaaauugccauuaaaucaaucagcuuguuguaggagcuugucuauaugcuaauagcauuggugcuggcauauuugggcaguaauuucagcauugcauacauaaauuugcuauuguuacauuuggauuaauauuaaaaccugaguuuauaguguuucagguguaguugaauuauauguaaguagauauaaauuuuguuauuuuuguguuaaagaacuaguggcagugugggcuuuaguacaguaauguauuuuuuguucauugugagaaauuuuauugaugccauguguacacugaaacuuaaagccuuuuuagguggagaaacggugggacuguuuguagaugcuaucucugucgauaguggaugcccauuuuagauaagauucuuguucugccuguggaauccuuaauaguuuaaaaucaauacuucucgaguaguuucuaaagacuguuugccgaucuguuuuuaaaaccaagguuuaaaaaaaucuuucaagucuuccuaugauguuuagugcaccugugaaaaugguaaaaugauuguuuuggaauuuuuggaucugacguugauuuagggaugaaugguuugaguuuuauuugucaaaauuugcuguuuuuauaucuacaggauuuuuuuuccuauaagcauaaaaucaaaguuggcuacuguuauuuacugugauguaaugaauuugaacugcccugauugaaaaguuugcauuuaggaaauuauaacguggaaaaacugagcauaugauuaacaucucccagcucuuuaaaacagaauuaggauuuuguuuuuaguacuggcuguuaccaguguuuuaaaggaauuucuugagugaagcgaucauuuuacaaaauuagagaagcaaguaguauggugauuggcaggaauuucucagauuugaaucaaguucugauguuaaaauggaagauucuguuuaaagcuuguauuuucaaggaauacuuauaaacauuuuuaucaggcaucuuccuguuucucuuaaauacuuccuuuuuugacuuaaaaauguuagccagugaaugcuugacaaauuuguguuuuuguccuuuucaguugucacucagcccaguccaucaguuucucagcccaguacuucucagagugaagaaaaagcuccugaauugcccaaaccaaagaaaaacagauguuucaugugcagaaagaaaguuggucuuacagguauuacaaaacacaagacaauguauguuuuacuucugcaguuaacaaggagcuuuuggucacucccuaagagacuaguuggucuuacacauaaaaaaaaaaaaaaagccugacuagcuguagucuaggaaagguggaggaggugguauugggguggaaagaaguuggguuuuacuuccauuugucuccuaaucauauaaaacuauuaacucaggcccucuuauuuuauuagauugauaaaaaguuuuuguauaccuagggaaaauguuacugaacuaacaguaagcgccaccuacuuugagcuaugcagggaauguucuuggugcuuuuuuucuugucuccuucaaaucucagaccuugaugguuguuuucacuugaggaagcauuacuuaagauaugguaggacuguguuuugaauccagcuuagccuaacuccagagccuguguaaauuuuauccugcguugcaucuacaggagucgauagagggagagcaucugggagaaauuagcuggcagauagcccauuuuguuuucuccacgugguuuggcuuaccaaacacuucgcuauugcccuugcaaggaaagacugaacauaguuauuugaauuucucaccaugucaaaggaaguuaaaaguuccuuuuccagguuaacgugauagacucuguaagaguugacugugucuuaucaccaggaaguggaagaaaagaguucacugucuuuuauguuacaaagcaaugaaaaucugguuccuuuucuauagugacuaaggcuuuuuuuucuuuuaauugccucaaguucucaaaugacucuacuucuucguuuguacaggguuugacugccgauguggaaauuuguuuuguggacuucaccguuacucugacaagcacaacuguccguaugauuacaaagcagaagcugcagcaaaaaucagaaaagagaauccaguuguuguggcugaaaaaauucagagaauauaaauuacuucuugugaagagacugaaacuuuguuuuuauuuuaauauaucguaggaaaacauuaaagagcagaugcauggccauuuuucuuugauguucuccagaguuuuacauuacacuugucugucuuauaauugauauuuuaggauguuuggguguuuguuacaggcagaauuggauagauacagcccuacaaauguauaugcccuccccugaaaaaaauuggaugaaaaucugcacagcaaagugaaacacacagauaauaggaacaaaauguaguucccaugugccaaacaaaauaaaugaaaucucugcauguuugcagcauaucugccuuuugggaauguaaucaagguauaaucuuuggcuaguguuaugugccuguauuuuuuuaaaaugguacaccagaaaaggacuggcagucuacuucuaccauaguuaaacuucacccucuuuaauuucacaacauauucuuuggaagcaggaagaaaugcucauaaagaggaucagaccuucuuucccgugaaaccaguauuuggcgccauauauaagccugguuaaauuggucaucuaaagcugucaaauaagacauucugugaaagguaaacaucgaaacugguuauaaguaaaaccaucaagccaacaacagggucuugagauaaccuuugaagcuuauuguacuggccugcaccagaagaugucugcauuacucauugcuaaaaauguguagcacagaacugcacuaggauuaauuuguuuacaagaagaaauuuaaacucuacguuugguuuucacauacagcagcucuauugaauaacaugcaucugaauuuuaaguugcaaagguaucugaauaauuuuucaugugcaucuuuugucgaauguuuugguucaagaaagaauguuuaaagcuuuuuaaaagacuucaguucuuaauguaacuguacccuucugcauggaaaaucauaaccaacauggcugcaguagacuucuuagugguauccagcaccacuugcagagggcugcuuuaucauauuguacuuggguguaggacucuaguguucuuggguguauugcaugggcugcauuaucuacagcauuguacaauaacaacuagaaaaggcaguauacuucacugaugcuugucugguaauaaucacuucuguguuauaauggaagguuuuuugugauguaugaaacuuguguuuuuuauauauaaaugaguauaguuaguguugugguaaugccuguuuucaucuguaaauaguuaaguauguacacgaggcacuacuucugauuuauugcaauguucaguccuaguuuuuacuuuuauucuuaaagcauucaguuuugcuuucaauuuuauguaccuuaguucugaguuagaccugcagauguguacagauaguucauauuuauguauugcacauaaucaugcuauucagcauugaugcuauauuguauuauguaaauaauaaaagccauguacagagggaaacuucacuuguucauuggguuuuuaagccauaguuggaguccuaaagggggaaaauuagaaaauguuacuuuacauggcuauauaauuuuuuuuccuuugccaucgcugaacuuguucaagugauaaucaagagauauuagaagcauuugcagguaugauaccugauaggcaguuuauuuuugaagaauucaauaggcaccuuugggauuaaaacaauuuuaaaauuugagaaagaugaaauuugaacaauuauggccuaccucgcuucuccauguuguaaaagaugauguuuuaugacaauucugaagaagaaaguagguaugacuuaguuuacaaaaagaguucuguuuuauuucuguuuuggguuuggcucuaauacagagauucacccauggacuuggucucuguagcguuuaugccagaucauaaagaacaaggggugacagguacauguugacuuuaccugggguaaaugauuaccagagugcaacuguugcuucucugugauggaguuugggguggaaauacccuaguuuuaucugucaguucuuugcaugcugcuacuuuugcuucaaguuagggagguacauauguaugucaaaguuccuauacugacauaggguaguauuucucugaauaugaaaagucacaauugaguugaaaauuuagaaguugaagauuuagaagggcaacuuaauuuuucaaguuaaaaauggaaguaagagugguauagagaagguaagaugagcccucggacuccaucacucugaaggucugaguaguagcaagagauagauuuuuguuuggccaggcugcagugcaauggcguaaucuuggcucacugcaaccucugccuccuggguucaagugauucuccugccucugccuccuaaguagcugggaucacaggcaccagccaccacgcccagcuaauuuuuguauuuuuaauagagacaguuucuccauguuggucaggcuggucuugaacuccugaccucaggugagcugcccgccucggccucccaaagugcugggauuacaggcgugaggcaccgcacccggccaaucaguuuuuuuuguuuuuuuuuuguuuguuuguuuuacaagaaacauuaaaccagaucagaacaaagauuugucaggguuguccauugacuggggagaaagggaaucaguguguaaggcaccugagaggacucaguucuacccaaauucuugcauucaaaccugaaugcaaggccaugaaguccuuugaaauguacagauauuaagcaauuuaauaauauaccauguuucccuuacauaagcagacaaauauuuacacccccaugaccugaaguuuuguuaggcugugaccacaugaauucgcaguauaaaugggugaguccuuuuugaaaaccucaucuucagugugccugaucuguaaaacuagagccucagguuugauccuagguaggcuucccacaacguggggaaaauuaguuugugagggaaagcuguuucugagcauuauggcauagugauuaagaugagggacccuggaaccagcccgugauuuugggcaaguuauuuuagguccacuuuggacugcuucaucucuuaaaugaagacagcaaccaccuucaggagugugaaggugacaacacuuaaaacugugccuggcacauuguauuugcuauugucuuaauguucuggaauaaugguuuccauaacuugggaagaaaacuuugagaacaggauugguuacaucaaguuguauagugaaaagauaaagauuuguuauuuaaacuugcaguuuaaagucauuagaaucauucuuuuccguaaggcuuucuuugcaagagaucugcauuaaauaaaguugcuaggaaauaacuaaaauuggggaaauaaucuaauaauagcaagauguuaagcauacuauuauuguauuuuggggguugguaauaacauucacauggauuuaucaauacacacugagaagcaaagccucucaagcugucccauauccuccauuucaaaggcacacauacauuuuagguaacucauaauuuagaaagguuauuuaaucuuuuccacauguaaauauuugaauauguacaaagacuugauuugacucuugucuguuuuuguuuuguuuuguuuguuugagacagaggcuccgucgcccaggcuggaguaaaauggcauggucucagcucacugcaaguuccgccucccggguucacgccauucuccuggcucagccuccggaguaguugggacuacaggcacccgucaccacaccuggcuaauguuuuuuguuuuuuggguuuuuuuguauuuuuaguagagagaggguuucaccguguuagccaggguggucucgaucuccugaccucaugauccgcccaccccggccucccaaaaugcugggauuacaggugugagccacugcgccuggccgacucuugucuguuugaaugcaaaguucucaauagugguuuuuguccauaaguauuaacuuauaauuuuggagagugauagguaugguugcugguugauuagcaauaagauuauguagccuuaaacuagcuagaagaguuugcaugggugaggcaacaggcuguuaacaaaaagaaacuggaaauacaguuuccccuguuuguuucuccuguuuguacaaucugcuuuaaaaacaagugaacaugcaccaugucagucauggugaaucggccaacagccagcccuugccaguugacaucacagucuaagaugggaaacugguacagauagacaugaagagagcuuagcagugguugagguggugacuaaauauacagucauugaauaaauaccguguagcaaauguaaaaaaaaaaaaaaaaguacaacagaauacaaaagugccauuuaauauuuuauagcuauuucuaugcacaagugcugguuuuaaauuuauauaaaagcaaagacuguuucuguguuuucuuccagaguauuucuguuacagccauagaaguaaaguuaauaaauguaagacuuuuuuuguuuuguuuugugccauaaauguaagacuccauuuugucugcaacugcuaagugccacuuuccuuuuauuauggguagggauguugcuaaggauacuuaaguaguuaagagcaagaugaaagaaguuacagauuauuuucuaguuggcuaaucuguguugaauacauuuuuuaugaugauuuuuauugacaccacaggaccucagccuguauauauugauaauguaaccaaagcugcucaggaauugggguaauuuuucagucaacucagaaguuaacaggaaauccuuguuacacauucuuaaauuuuagauaagugcaagaacuauuaacaaaauaacauuaagcacuuaccuuguagagcucaggcaucagccaggaaaaaaaauacaaauaaauuagccuaaugaccucaucuuaaauacuugugucuggguaaauuuuucagacugaucuugugaauauaauccaggauaaauuaaaaauguuggcugguccuugcuauguaauaugcuucugcccucuugucccuucccaucacuaaaaauguauucauacaugcaacuacaauaccaguugacaaauacgauuuagauuuucuguugugugguauuugucuacuauuauagaaccucaagcauuucucuaaagaaaacucuuacacaucuugguguugugguuucauguccacccuaaugagaaaaguucuuccuuaguagggucauguuuccugaggaaccccuacccuagauuuaucccauaguaggucuuauaaauaauauccacauacuaaaauuauuuggcuucuaauguuaaguuuuacacuaauauuguaaaaguaacucuacagucaaaaauuguaauauuuaaauaagaauaaucugccauccgagccauuagccuuuagcaucuguguuauauuuuaaaaugccugcaaaaauugucuaugcguaaacaaguuguuuuuaguuauacuguggcuuauuugguuggcaugaaaauuagauugcuuugcauaucugggguagcauaaccaguuuuaucaguggcuagauuauaucagaugacaaaaauaacaugagacuucagaagucugauaaauaaagugaugauaccuauuagaagugggugcaaucuauagccaucaaaaugugaugcauucauauucaggcaugguccuuuagcauucgagugauaggcacuuuuauuugagucuuugaaugaaagauaggcuuuuaaaguggauuaaaggauagcaguuuuuacuugauaaguugggacccaugguaacagcaagcaucccacuuauaacugguguccauucagggaaaaacagauguaaccauuaugugacucaauacaaagaagaagauuacacugguaaaaaauacuaagugaaaaaaagaaaaacuaguaaaaaauacuaagaggauuacauuagugaagauucagggugugaaggugugaaguaaaaggagagaagauuaacagaauagguuuaccuuuauuugaucuccuuacagggaucuaucuuccauggugacuaauucuccuauuuuggugaaacuuuucagguugauggauuuaaaagaauaguauaaacccaaaauuuuccauuuuaaggucaugauuuuauuuuuuacucugugguucuuaaauacaauuuacuucauuuuauauaacaccugccaagaacaaccuaauaaacaagaucugguuuagguuuaauaaaauuaaaauguguuuaacaaaaccuagaaaugaugugaauuugcuccuaggaaacacugaaagcaugugaaaggaauagcacuccaauccagcaguuuauuuuauuugugcuuuuuaauaauugcuauuuuaaauucucuaaggaguugauaauacauagucauuucuauuuggcuuugaagcgauccaaguauauaugugguuuguuuuauaaaacaaccacaaaauacagucucccuaugaacauaugcagaguggucggaaagucuucccacucucuaggccagaaacaucaugauugcucucauaucugacuaaauacugacuaagacaucucaaacucuacauuuuguccaaacuagaggaguuuuugacaauuuuucuggacuggggagguuauuuuucaaagaucccuauuaaauuuuaggaaucagaagggaaucuaagaaaauuacuuauuuaaucuacaaacugauaaacugagaaccuaaaguauugaaaaucauuaaauauucuauaaaaucaauaauuuaccaaaaauagaaaaugcuuaauuacuucauuuuuauuuauuuauuuagagacagagucucacucugccauccaggcuggaguguaguggcacgaucucaggucacugcaaccuccaccuccuggguucaagugauucuccugccuacucagccuccugaguagcugggauuacaggcauggaccaccgugcccagcuaauuuuucuauuuuuaguagagacgagguuucacuauguuggccaggcuggucucaaacuccggaccucuggagauccguccgccuuggccucccaaagugcugggauugcagaggugagccaccacaccuggccuuaauuaauucuuuagaaugcugucuaccaaugguucuugggccaacagccgugcuuuaaauucccuaccagugccuuccuauauauauauauauauauauuuuuuuuuugagucgaaguuucaccuuuguugcccaggcuguagugcaauggcaugaucucggcucaccgcaaccuccgccucccggguucaagcaauucuccugcuucagccucccaaguagcuggaauuacaagcaugugccaccacaccuggcaaauuuuguauuuauaguagagacgagguuucuccauguuggccaggcuggucucaaacuccugaccucaagugauccgccugccuaggccucccaaagugcugggauuacaggcgugagccacugcgcccggcuuccaauagaauuuaauguaggccaacauguaauuuaaaaauuucuaauagccacauuuuaaa

SEQ ID NO: 18780 - RNA, 86851 nt, Homo sapiens
ugggguugcuccaagggaccagaagagcugcccugugucccagagcaggcugguucuucugacagcgcugagaaccuggcgcucgcgccuggccagguaggggcugugacuggacgcucagaacauuugugggaguguggaaaucucuuuacgggugauggggcucaaagucugacgcagccgaggguugauggggugcagucacgcucagccaggggacuuugggggcgcagugucaggcucagccagggagugacaggcgcaguaccagccuuaucugggggugcuggaggcacaggcuccgguucggccaggcgggugugcgcgcccaggaaggguaggagccugcagccgcagcggggggcgcuggcuggggcucugccccgccggcagugcgcucgggcgcuguuccagcgcgcggcagcgaguggcgcugagccuccgcuuucgcagcucgcggggagcggggccggcgggaggggccgggcggggccaccgccuccucugauggcaggcuccuccucucccuccgccucccucgcucuccaccgcccgcccgcccgcccgcccaauccacaguucccggcccagccgagccgggcugcuugucuggccggcggaggcugagcgcgacccuagcaagccgcggcgcccgccgaccagggacaagagcgacuccugggaccccacucugccccgcgccgccgccuccuccccuguugucgcggggacgcucaggcccgcgccgcccgggccacgauucuccuccucuuucucccggaggggaaggaacggagaaagccgagcggcggcuccgggagagagcgagccgaggccccugcccccgaggcucggggcaggaggaggaggaggaggaggaggcggaggcggagggaagugcgcgucacucucgggaggagaguauuucaccuccaggcagaggcugcggcugccaguugaguacgagcggcagcugcgggcgccggcaaucgaguggcuuccuggccauggagaggagaucuggacccgaggacgccagggacuccucuccgucucccuggaccgcuguguaggcaccugaguuaacggacgcuaagcgggguaggggaagguaagaagcgacucggucacccgcccccccaccccgcuccaccucguuugcugcccucgggggccacugcggggacgcagacccgggucucgcccaccuuuucugcucccggcggccuggccggcuccggcguugggcauuucugccgaaaaggaaaacguccucccgcccuucccccgugcgccuccuuucccgguuucaucucuggauugggacugacccgacuccccaggagucaguccucucuucuuaagaaaggguccucgggaacggugucuugauuucuuucucuccacucucucuuuucauuacguuuacggggaagggaacaauggaccuuucaaagucggugcgaacagccuuaaacuuucuggagagggauggggugaggggauaaaccccacaguaagccgauuacagugaaagguugauggaaugugcuuugcaguccgggcuucagugcgcgcgcgcuugugcguuuggggucaucuuugucuccuuacaauuccccuggguugguggguccuccgcccuccgcccccugccucucuguuagcugagguaaggugaggcuuuaaaaucguguacagcuuccuuuaaaucuggggaauagccuuagcccuggacccuauucccagcuuuucucugcagaguugggagauccugguaaaggaggggggcccucucugugaggacccagagugcugcuguuaauagcacuaguggcuacacccuuagcgauaaaaccaagguccugaauucccuggaugcucucugcugaggguugaugagugucaccagacuucgaccuggagcggaaacagcucacuugaauucuccgcagguuaggaaaacagacuuugauauauaucuccuuuuaucagcaguugggauuaaggauagacugccuaauaauuuuuaaaacuuucauugugcacaugagcuacucacugccuugaguucacuccccuugauucagugugacagagugaugcgcugcugcacaguugcauguauugagaugugcugcucuucccgguaaaaagugagaagaauuuagagagaggggaaaggguagaggcuucaccugagcugagggaggccugacuccccagagcagccaggcaaaucuguuggaaauggcucaguguuaaaaaaacaccuuuaaaaugguuagccuuaucuuucuuugguuggcuagaauggagcuacuaaugcuuauuugacccuugaaggacgcuuguucuuuucagaauuggucuggguaucauacugugguugugggucugauuaccuauacaaaggguucuuuuuaguuugcauuucugggcaaagcagaagaauguguaguaggcauguccucugcuuaguaaacauuggguagcacuuuagagugcuuuucucuucacaccgaaaugacuucccccagcuucuguguaccugcauuagaggaucaguuugggcggaacuggaaaucugucuucuggcuuucuguucaguccuccugacgcuguuuuuuucugauguaugugugcuuaaaggcucagaaaacuaagauuagaagcgaauucugagucaucaccuguucuuauuaaccugugaaugagauagugagcugaggacucuccuguguguggacagggaaauagaaucuguaaauucuuacaugguguuuaucuggauauucugugucacaguuaauuauuugaguagucuccuuccuugaucuagucuguaaccagugacuuuucagaaaugucagauucauaacaggaaaccagaauggggcaacacuucagucauguucuaauaggccuaaucaaugcuguccucaaacagcuaucaagaaaagacaagcuggaggguaauguagucuugugggccauuaucuugaaguugacaggguacugcuuagagcuacaugcuuugggcaaguuucugaaauugagaaagacaagccacauuuuagaaagaggaaacuuaggccgggcacaauuggcucacgccuguaaucccagcacuuugggaggccgaggcagguggaucaccugaggucgggaguuugagaccagccuggccaacaugguaaaacccuaucucuacuaaaaauacaaaaaaaaauuagccaggugugguggugcacgccuguaaucccagcuacucgggaggcugaggaaggagaaucgcuugcaccugggagguggagguugcagugagccgagaucgugccacuacacuccaaccuaggugaugggaacgagacuccaucugaaaaaaaaaaaaagaaaaaaaagaagaaacaauaaucacuaccaaauucauggucuuagacucacauggagugcuguauguaaaugugugcauugugaugugugcucuaaaauauguaugagcauugcaucauucacccacccaccauccauucagcuagcacuuauuaaucaccuauugugguccagacccucuggaagcaauugcaacaccugcuuuguggagcauucauguugguaaagagaaggaguugaagugguugcaacccgggaggccacagggauugaagauaccugugucacuugcaacuagagagaugacaaucucugcuauugaagaaaugagccuagccccggacauaaggaaaugaacaauuagaagguccaauaagugcaugucugggagaauuacgcacagaacgcucuaagaagccagagaaggaacaguugggggugggggagcaauuuugugagaaauaaaauuuguuaaaucagacaaaauaguagggacugaaaacuagugucagaaguacuaucuuaaaauggugaagauuggaggacuugaagucagacuuggauuuaaaacaaggcuuggcacuugcuaaacauuugcugugggcaaauccccuaauccuucucacguuguuucuucaccugaaaaaggaguuuuaaaaugcuuuaugggaauguuuuggggauucaauuugaguaaguuugcuauguauuaauauaugauaaaguacuguacaggcuaaugcugucugguaucaaaagguacuuucaaaaguuuuuuaaagcuauaaauagauauaaaucauagcuuaaucaggucucagcuacagauuuucauuuuauuggcccuuuccagaaugaucugaaucccaucuugagagcaagucuuuagacuuuuaagcuaguuacugucauaugguauugcucucuuguccaggcuucuucccaucccagccacaggaaaucuuuucauuucucuuggauugugagcauuagugagaagaaugggcugucuaguacaguacaucaauugaaaaggucuugucugguuuuguacgguaacauccauucuccccucugccucccaagccaagcuagcccuucuguuuuccucucucucaauaugaugaauauggaaaaggaaaaaaaaaaaaaggaagaaaagcuaugcaucugccuuuuugagaguaugaaaauccccauuacuaguuuucuccauuuguaaagagguauaauuuucaucuagauuguuaaagucuauucucucaauagcagcagcugcugucuaggcgaaucuguuagcaauacucgcuuuaguucuccacuugaaauggacuuaagcccaucugacauuuuaauaaauugccuuugauagaaauccaaacucagauauuuaaaacuaucaagugaacugugcccuuuugccaggggugcgguggggagggggguaaugaauguaaaucaguuuucuagacacugcuacauaugcugaaucuuagcaugucgcuugaagggaccucaaagauaauauuaaaacaaggaaguugggacccagagaggcuaaauaauuagguaaggucauauaguaaauuaauagccaagcagggacaagaacuccuuugucccuguuuccagucagcacuuuuuuuuuuuucuuucucagauauauucuuauuuuauuccuguuuggcuuuguuagcaauuuaauuaguuuaaugaucagauaauuuguauuugggcuuugaaagucacugcuuucagguuuaaggcagacacuauguauauuuuuucauugccuacuacuuacacaugaugguggggugauguuacuuguaacaaauuucugggaaauaaggaacuaaguguaaaaauagcauuagcuuuacuuguauuuucuauaaacaggauggaaauuuaaaguacuguagaugugcacauuuuuuagaagaagcaaguuccuggaaacccuguucagauuuggcuugugaaucauagaauaaaagcauacuagaauauguuugcauguucuuuuuuuucuucuucaaaacuuauggcuguaggucauguuugcuuguucuuuuguuuuccugguacuugcuuugggaagccuuuaauauugguugucaggaacuauguucagcaacuauuuuauugcauuccuaggaugugcaaggcacuguacugguugcugugagcaauacagagauaaauuaagcauaggguuuuuauuaaaaugucuuuaaaaaaagugaaagacucauaaacuguaugucuuaaaacacagaauugcuaucucccaacaaaucaguccuuugaucuauaaggcaaaucugcuuugaaauuguuaauauuaggguaaccuaguaaccagauuuguaacaagacauuuauuuucuuuacacggugaaaagugauaaaccuuuuuacauuuguuguaucaaggguccauuguaguuugaacaauaaguaaaaguucaauauuugauaagaauuuuaugugaaaaguuugccugguagagauuguggcauucuuaauccucauauuuuuuaauaaggcuuuaccacugguuagaagugucauuaggauguuguugccugaaagaguugaaauuuaagacaauccacauugagcccaugagaaaagaauugaccucugacugaguuucauguaaguaucuuaaaacauaugaauauccacuauaaauuugauaucguggucaggucagauuaagucccccuccagugugaaauuguuaucgauuugggggcucuuacuuaauuauuggugugcacuuuggagacagcaagccuucuguugucuuaauggucucuguaauggugauucacuucccugaagaaugaaucauuuuuucacauacaaugaaguuuggaaaguuaauuauuaacauuuuaggaaugggaaagauuuagcuuaacacagggacauaugccugauuccuguuucaggaggaauuagaaaaaugaguucuugagguuuucuuuuuuuuuuuuuuaaguugugguuugaaaaaacauaacauuaaaaaaauauauuuuuuugagacaggagucucacucugucacccaggauggagugcauugguaugaucacagcucacugcagccuccaccuccugggcucaagcuaucuuuccacaucucagccuucugaguagcugggaguacaggcaugcaccaccaugcccagcuaaucuuuauauuuuuuuguagagauaggguuucaccauguugcccaggguggucuugaacuccuggccucaagugauccucccaccucagucuccuaaaguggugggauuacaggcgugagccacugcacccauacuaacauugcuuuuuaaugccaccagugccaccacuauaaaaucaacuuuauaugaggauuugaaaaauaugcuugagcagggcuuggcugagucugagguuggcuuuaaucuucaaguguuuuuucuugccuccuguuagugcuugcagcacuugggcuugucacguagccccuguuugccuguuaugcugcugcuagccaguuuuuuuuuuuuuuuuuuuuuuuggugacggggcuggcauggggucuuguuagguuacccaggcuggagugcaguggcucuauaguaguccuagcacacuauagucuugaacuccugggcucaagccauccaacugccucggccucuaaguggaugggacuacaggugcacaucauuguucaccucuuccuagccacaguguaucccuauucggcuaagugaaguccagcugccacucuagugcugaguaauuacuuguucauuagaaguucugccuuuugacucuguagcacccuugagucuugaggaacauagaggaaacuguugagaauguguaagauggcccuuuuguuuggcuuagguuucacguggccuaggaggagagggacuaugacuguuuuauauucuggccuggaacucaccugcaggugacacccuuucaaagaauaugaaagacuucuguagugugucacccuccccucccucccauacuuuuuagucacuauugggcaacgugucgucauuuaaauggcggaguucagugguagacuuuaguuuacacaugcaaaauaagaaagauauuaguaaucgucugguggugcacauuugggugaguaaauuugccagggcuuuuagaaaauuaagcucuauuccauucauagggauuuaauaaacucaagcaaucaccuccucagcccaccuucuuugccucaacauucaguuuaauuacuuguuuacuuguguugucucccuacucuuucuacccccaaaugcugggcugugagcuucuugaauguaggaaccauguuuauuuuuuguacuauugggucuccagugucuagcagaacccuuuucucauaagagaugcucaaagcugaccuugugcccuguuugaaaaggcuuuauuccaagugguuuaaguuauauuaaaaauaggcuauguguuacaguugaaagaaauagucaacuuggguucugguccuggcccugccauugauagaaacuuuacuaugaugcuggauugaacagccuuggauuauuucagucugggcaucucauuauucauuugaaauauuucuagugugaaaggcacaucaaaacauaccccuucuguuuccuauugucauugcauuuugguaucuguacaucacuagaucaugaacuuuggcaggucuuugcuuguuuuucaaacacaucccuguugucuuuucauuuuucccaccuuucaacauuuugccaacauaacuuucuugguuuuuucuuccugagaaguauuuuaaugcauugucuuuggcccucugcagagaaugcagcccacaggcaguucugcccuuugcuauaaccuuaauuaaaucagccucugucaggacagacuucgacuuugguucuuucuuuggaaggccagcugcaaggcuggugacgcgccugcacuugccauugugugccucugcacugccauccgucacugccagcagguuggaagccucucuugaaucuucccagccaguugagaacaagggcgaagggggauggucuaggaucacugggaaggaagggagaaaagagaacagcuuuucaauaaaaagaauuaaggagaaaaagaaauaugagaaauauuaauaggaaaaaaggaaaccgaagggaauagagaaugacugguagguacaacgaccuuuuucccuuuuuucuaauuuucuggguugaagaacaaucuaucucucugcaguuuaucuucuaguucuuuacuuccaccuagaggccuauguacuuugcucucuuuuuauuuuuauuuuugguugcucagagaguguuagcuguucuuaauugcuacccuuccuccccgcuuggucuguaguaggucugcaguuuuuuccuuuuauguuuuucuuuuuuugggcaugauaauacauuuuaaccuuuuggccguaucagccucauuggcuuuagggucaagcauuacuucucauagacuuguuuaacaucguuggaaaaagauaggauuaauuaguauauuugggaucagaaaaauuagacagcugccuccuuuaccuugcauaaaugacagaaacauaggaaugaauuuuaaauauuucuuuaaagucauuuauuucacuuuaagaaguuuucacuugguucacuuuuggcauuaaacauuauaaauagcagcucuuuguuuugagggauucauauuuuaacaggagaguccaaugugauuugccgaagauguggccacuuuagugaaacuguggcuaaguugcucaucugaauuccuuaaauacagaccauaggcauuucuuauuuuguuauuaucagguuaagcaaacucuuaguauuuauaguuaauuuuuguuuuuccagagauuuauuuccuaacuauaguuuuuuaguaguuuucuagcaaaaagacuauagcuuaauacaaaaguaaauuuuuaagcaggaaaauaaaucuuucaacuuuaaauaauacuuauucuaauccaaagcuuaguaucuuuuuuuuuuuuuaaguaaauuuagucuuuuuaggacuauagguuugaaauauucugaagaaaauaaaaauacuucaccgcaauauauggcuucccugguaaaaugaguauuuuaaauuaaaagccuuuagagaucaaaaaguuccuggagagacuuuuccccuacuacaaagauaggacugacccccugccaucccccccccaccuccccguaccccccaacaaggagaacaauuaucccugcuucuuucccuuuuauuucauuauccguugcaggaaggaccaaaaaucuaaccacauccgaacagcccuauucaagauaaagacuaccuccacggaucauuuaaauuccaaaaagaacuaucuagaagucaauuucuguuuccccauccaaucauucucccuaguaaucauuuauucccucaauagaauuccuccucuucuccuucccauaaccuuuuuuaccaggauccaagcccucauucucccuggaaccucaggauaucauacaacuucugugccucauugggaaguuggguuuuccuucugaaggcucccaugcuuacacauuaaauaugucuuuucuccugugaaucaaacugccucauggcagggauuuuagugaacuuucagggagccaaaagccuaugacccccacaguuucuuauacuuucgcuguauuauauuuuaauagguuuuuggggcaggcaagauuuuuuuuuucuuuaaggaaggagauaaucugagugauacguggugugaaucuagaagucugaugcauacagauguuuauuauaacaauagcuuaacuugggaauaucacuuauaugugucuaaaucgaucaaauagauaaagcagguagggacauauaaacaauuagggguucucagucccuuguccuuucccuucauaggcagagguuuauaauuaagaguuggugcauuucccuucuaccucugaacauugaccuggcuauaaucugcuuaauaaaaguaaacaaagaucuguguaaguaaacuaacugugcagagugucuuauuucuuggaaacaugccaaacaguugcaggugauugugacucauacugauuuuugagaguugaaggaaaaagacaaaagcgcugugacaagggcaaagaaauaauggagaaugcgccuugugggacagugugaaggcauguccuguggaaaaucuucuauuuuaggaaaucaaaauauuuuacccccaaauauauuucuuugacauauuuugagaugucagcaaacagcagcaaacagaagucacccugcaaagcagucuuuuaugggggaaauuugcaucuauagaaaauaugcauuaaugcagccaggcuuucucuuguccgguucuaggaaggauuaauuaagucugacuccuuacagaucugaaagagacauuugccgucucuccucucaggggugcuaccugugagguucgguucaucuacauaacaagaccaccuuugcuugccaagccuccuuacauaaccugucuuacagcuaaaaccugauuuacuacuguaaccuguuuucggccaugcucugagccugcauucuuucuccaauuucuagaagguauuuacacacuucuguaccccaccaggggguuggguuuucauucugaagucuccuguguauaacacauuagauaaaguuuugugucuuuuccccuguugaucuggcuuuugugaguugauuuuucagugaaccuucagguggccaagguccuuggccccacaccuguuuagaggucuaaggguuuucaauucuuugagaguaugcuaauacacaaucgagcagaucucugaaugaaaguugacuuaauuguuucaaccauauguccguuuucucauaaauagcuguauguauagaccuagcauuuauguugaauucuuugcagugguuguuuuuuuaaaaaauguauauuauccugugugcucugggaauagaauaggugauacauuauauucugcuaaacuacguauagaaagauuccucccuacccaaacucuuugaaaaccuuuauaauaguuauuuaaguacauaaucuucuugagaguauuggucacacuuaauuauuuauuugaaacuugcggaauuagaggaccuaaaaagucugcuuugcuaagguuauuuucuaauugaacacuuuuuuauguacaggguauuuguugaguucacuguuugucaauggacauaaucugaaucuaaaacaaaacuaaaugaaacgcccuaacccugcuuccccucaaaccaaaccaaaccaaaccaaaccagaagaucuaaauggugaucccugaugguuauucuuuguuguguucuucuccugaaaguaggagguugggaauguggaauuauuaauugaaaauucaaggcaguuagaaucugguuaaauauuuuauuaggucaaaaguacaaauaauuauaguaucaucuguuuucaugauaauucaugcucacuccucuuuuuacuuuuugcugcauguuuuuacuuuuugggcauacuagugaauguguuagaucuucuaagaucguaauaaaagaaaaaauguucuuagccaaauuuuggccaguuguacugaaacucuccgaaagcaaaaauuguaacuugacccuuagguugaguauuguuuaaaaaauuauguccuugaucaaaaaagaacugaccugauuagaucgugccaacuucuuggcucuucccacaagccugaaucuuccauucaaaaauuaguuuucuuaaaaagccuaggcgugauuugagagagcuuaaaugaaucaaaaguauuguauuuucauuaguuguucaauaugaggggaugauggggccaauaugcauuucuuggacuguguggcuguggcaccuucucugcauuggguuggaagggcuagauuauuugggggacugaugauauagccuagggggcaaguguccucaaccaccauguaagugauaaguaccuuugucuugcauauuaacaucucagcagcugaaagaacacuaaaaucccuuuuaaagagcuccuacuaguuuugaacugcugccgcuuucucuguguugagaagccuuucucuuugaucacagcauugaauggcugucaacauaacaaaauaaaguggaguggaauguuucuuuuuuucugugugccuacugcauuucauaauguguaguuaaaacuauuacaaaauauugugaaagguugaauuuaucuagguaguuugcugcucuuuaucuuuagaauuccuuccugcaguuguuaauaauaccuuuuagucaccuauuaguuuucauacuagaauugcauuuuauaagaauuaacacauagacuuuuuuugcuuuaaguaguauuguucucaauuuucuccugaaucagagaaacugauauagaaauuagucaaauugcccagagccucaaggaugucaaagaaggauuaaauaggaaauuucucucucucugucucucuuucucuuguguguguguuugugugugugugugugugugugugugugagagagagagagagagagagagagagagagagaggaaucuguaguugaagagauucuuugggaguaugcuuagacaaaaucaaauugauuucugaaugaaaguggacuuaauuuuuucaacuauuuguuuccuccucaauaacuacauguauguauauacauauauauauacacacacacauacacacgcacauauauauaugcuagguauauauauauagguauauacauauacguguguauauauacauauauauauauauauauacaccuauauacauauauauauagccuaucuaucuaucuaucuaucuagcauuuuugcuuaauuccuuggcaggaauuugugaucuaaauucaacaaucauuuguugaguaucuacuguauguuguauguaagcuuuugcgagaauaccaaucacuccuggucucaagaggcuuguggucugcugcagauggacaaguacauaaauuaacugaaacauaaggcaaaaaguaagaugauccuguaagagguuuuuuuuuuuuuuuuuuuuuuuuuuuuugugagacagagucaugcucugucacccagguuggaguacaguggugcagucaguuuguugcagccuucaccucccaggcucaagugauccucaugccucagucuagugaguagcuaggacuaaaggcacaugccaccaugcccaguuaauuuuuuugguuuuuaauagagauaaggucucacucacuauguugcccaggcuagucucgaacuccugagcucaagcgauccuccugccucagccucucaaagugcugggauuacaagugugagccauugugcccugcuaauuuauggaaacuugagaaggguucauggaugagauagugugguguuugaaagcauuaaaugagaauagcucaauuuuauuaaaaucaugccucuccuuuauuuauuuaauuuuauuuuuuauuuuuuuagagagucuuacucugucacccaagcugggcugcagugguucauucauggcucacugcaaccuugaacuacuggucucaugcaauccuccugccucacugccuccgccuccggaguagcuagggcuacaggcauggaaccaccacaaccagcugauuuaauuuuguguguguguguguguguguguguguguguguguagagacagggugucucacuagguucccaggcuggucuugaauuccuggccucaagcaauccucccauauugaccccccaaagcacugagauuacaggugugagccaccuugcuuggccaaaaucaugccucuuuuuauagguaaaaaaaaaaaaaaaaaagcaugauuuccuuuaauguuauugaaaucucaaaauaauugcuuucuauguuuaguuacuguaauuuauuaccaaauaaaguggaugcucuuaccaauuauacaagucucucucacuuugaacugcuuuugagguaauacaccaguuuuuuuucccaagagaagaauuuaauuuaaaauaacagugaguuuuuaagguaucuuuuugugggggcaacugagaauuagacaaaagcacuagcuacuuuuuggaaugcuuauguuuuuccagcauuuguauuuuuuuuuaacagcauuuguauauuuuaaguagauauguuuucguagucugagucacuucuuuauuauuuaauuuaauacugccuaaauugccugugcaauuuucuaauugcuuugcuuacuugcuugcuugauucauaaccaagccuuuugggcuacuacuuuuuauaauccaguaaauaaauacucacaaaacgacucucucaaggaauaucuaaauaccaaaaauuauguuuuaaaagcuuuguagaguacauugccaauuuuaauaugaaugacuuagauuauccccauuuuggauuaucugucuuauuuuagguguugucacagucuguaguuugucuaaaaaugugucauaaaauacucauaugcuccuucuucauagcauguguuuuccacuagaaauacgaccauuuaaaaaaaauaacaugugauacaaacugaguauuaaagugaaauacuggucuguagcgaaauuauuaaaauggugcuuaaguuugccuugaaagccagagaggacuacauugucuuuucccuaguagacuccucuuuuguucucaggaccccaaacacaaguacuaacaacuuuagggauuaaacagccauuguugagauugccugggaaacuuggucaauuucacuugccuuccaaacaagugauuuauuuuauuuucuuuaaaaaaucuuuuuuuuauuauuauacuuuaaguucuaggguacauguguacaacgugcagguuuguuacauagguauacgugugcuauguugguuugcugcacccaucaacucgucauuuacuuuagguauuucuccuaaugcuaucccucucccagcccuccaccccucaacaggcccagugugugauguucccugcccuguguccaagugaucucauuguucaauucccaccuaugagugagaacauguggucaaaacaagugauuuaaaauugaauuuaggaauugcauuucuuggggaugcuguaaaucuuuuuucuguauaccccauaguuccuaccacaauccucuaacgauagcaagagcucacaauuagcuuacugaaugaaugaaauguugauuuuuucacgaauaauuuagaucuauaauuaucaauaaaauauauuuuuaaguaauuaauacauaauauugugccugaaguaaauccacaaacauaaagugaaauccugaagcaauguaucuuauauuuuuaaaaaauugaauaaauugaggaagcuaucuguuuaaaauaugauuuuuuugguuauuuuauucuaauacauggugcaacacuauauuaccucuuaugaaaagaaucuuguauuugcugcuuauacauuuacauauuuuucaauaaaguagagguaauggauucagaacauguguauacacauuuacauacauguuuugcaggaacuuuauaggaaaaacacgaccaugcuuauuuuugauuuauugaccccuuuaguuugugacagaugccaucugaauuuucauguugggauccauuuuuugaccaugaagacacaaauuauucccaguaggcuggugacuucauuuagccucucaugccuuuuauuuuauugugggcacaucuggagacccauuaucucccaccaaagacccccgcccccaccagccuguuaguaauaucucucacccugaaacaauaagguaucagaugauugcagccucagaaacaaaagauucccacucccuuucagagcagauuagggcugugauuccccucccacccuggugagcugacacucaagaauaccuacguuagcccuuucuuuguucagagaggaucauaacggggucuuuauuguacucuuucauuuguuccagcagaaugucuccauuauuuuugucugcugcuuggcacaugcagcaguucuucaauagcaccuugaauggugguguuuuucuuuugucaugaagcuugagcuucaucuaaauaauuacuuuuguucagaaaucaaaccccacaaaccaaguguuuuugacagaaacacugacucugagaauguucuuugccccauguaaaaucagcaucaauuccugauuagauucucuuucugcccccauuaauuuccaggucguuuggguccugggaauugcuuguuuguggcuucucuaaugaccauuuuguguuuaauggguuugcugauaguuuagagcaauuuggaaguaccuuuaugacuagaaucuuauucacuguuuggcagaagaugaaggggauuaauuguaaggguauugaaugaagucaggugacucugagaugcuccaguuguuaaggaagggauguaagagguuaaacaccauguuucugaagccauagggcacaccauacauuuauccccagucauugcaauaagaacucuuccacuuccccuucccuuuccccuuccucccuccuucccucccccuuccuuccuuccuuccuuccucuuggcaaauuaacaaaguaagguuucauucaaaacuuauucuuuaauucaaaaacuuauaauugcucuuuauagagaacguaaaaaauuaaaaaggacuuccuuguuuuuguguguaagcuucuguuaaaaaugaagcauguauaguuuaaacuuccuuaugaagaauuccugagauuaauaggccuuuuagacuuagcacccuugcaaagcucauucuuugccucucgauuguuuggaaagacacagugguguaaguuaaaagccugaacuuuagaguaaaaauaccuagguuuaaguccugguucuccucuauauuaacugugugaucuuuggggaaguuaauuaaccucccugggccucaguuucucucauguguaaaauggagguaauggcaucuaccuuauagauuuguuguauuaaauauauuaaaugaauuaauacacauaaggcacuaauuguguuagcuauuuuuauaaucuuaaccauaauauuugucuguuuuuucaaacaaaauuuaaggauuuaaagagauaagauagacuuuagacuuucucacuaaaugaauucacaaucuauaucguuaagugauaacacagauaguaauacuuaaauugcuuaaucacuagauaagucuaguggggaaauuaaaacacccaaacuugagugccuagcuauuggaacuuuuagggcaacuuuggguccucaugacacauggacuuuuagcuucaauuugaagagcuuagaauaaugauacucaaagugugaccugccaagauauauuuuuuuaaaauguaaaauccagggcccuguuugcaccagcugagccagaauuauagggcaaagaggccaggaaucuagguuuuuagcaagcuucucugaugauucuuaggcacagugaaaauugagaacaguuggcauagaacagcggcucucaccuagauguucaugagaaucacuuggggagcauuuaaaagcugcaaauacuuagaucccagggacagcaauccugauugaauuguuuagccguggugcccugagcauucaccuuagcgggugauuacacuaugcagccaggguugagaaggagugacauuagaacacaaguaaugaaggugauugucaacaugguuuauuagaucagggauguaagcugacuugauauuuucaagaagucauuaugaugguuaccaggggcugggaaaaauggagaguuacuuaauggauauagaguuuuuguuugggaugaugaaaaaguucugaaaauggauaguggugauggucacacaacuuugugaauguacguaaugccauugaauuguacgcuuaacauaguuaaaauguaaguuuaugguauauuuaacacaauuuaaaaaguacuuuaaaaaaaccauuuaugauucauacauuccagcuggauacuggggcucacgccuguaaucccagcacuuugcaaggcugagguggaagaaucacuugagcuccggaguuugagaccagccuaggcaauauagcaggaucccaucucuacaaaaaauuuaaaaauuagccaaucaucgugggauguaccuguaguccuggcuacccgggaggcucaggcaggaggauugcuugagcccaggagugcgagacuguagugaucuaugaucaugccacugcacuucagucugggcaacagagugagacccugucucuaaaaaauagaaauuaaaggcgaguugcgguggcucacaccuguaaucccagcacuuugggaggcugagguggguggaucaccugagguugggaguucgagaccagccuaaccuacauggagaaacauugucucuacuuaaaaaaaaaaaaaaaaauuagcugggcgugguggugcaugccucuaaucccagcuacucgggaggcugaggcaggagaaucacuugaaccugggaggcagagguggcggugagccgagaucaugccauugcacuccagugugggcaacaagagugaaacuccaucucauaaauaaauaaauaaaagaaauuaaaaaagaauuuacacauacugaagcuuaauuuuuuuuucuuuucacaguaacaguguaucauguaugccacugauuccaggggacacuccccugcuuuccuccaaccucagaauggaaauagucgucacccaucuggcuauguuccagggaagguugucccauugcgucccccuccuccuccaaagagucaagcuucagccaaauuuaccuccaucagacgagaagaccgggcaaccuucgcauucucaccugaagaacagcaagcccagagagaaagucaaaagcaaaagagacacaaaaauacuuucauuuguuuugcuauuacuaguuucucauuuuuuauugcacuugcaaucauuuuaggaauauccucaaaauaugcuccagaugguaaguguguguauaugcacauagaacauauucuagaagacaaaagaggaggaaauaguagaauacuuaaaaaaaaauuuaucuuaaguuggcccuagcuaacuaauauguaguuagguaauacgaggugucacuucuuaugaaugagagcaauuguucaauaaucuguuggaaaugauuaaaugguugcucuuccuguccauugugccacuuuguugcagcacucagggaggucuuggaguaccucuuuuggaaaugcuuugagggccuucacuaaauucuuaugguagguaugauuuuuggacugcugcaauuuuuuuuuucuuuuuuucuuuuuuugaggcagucuugcucuguuguccuggcuggagugcagugguguguucuuggcucacuguaaccuccgcccccuggguucaaaugauucucaugccucagccuccugaguagcugggacuacaggcaagugccaccacaucuggcuaauuuuuguauuuuuaguagagacaggguuucaccauguuggccaggcuggucucgaacuccugaccucaggugaucugccugucuuggccucccaaagugcugggauuacaggugugagccaccaugcccggccgcaaguuuuuuuuuuuuuagucauacguauagugaacuauauuagauuuuuuuguuuaaguaagugacuaaaaauaauaauauuuguguuuguggcuugaaaugggcuugggaagcaguuccaaaggaaaaguuucaaauauuuuugaguaacaauauauauccuggaagggaagcauccuuuaggauauauaaguucugacaccuuugucuaaaaaucagucauuacuucauaguuaaauauuaugcagggagauuuuaauuucuuaaaugguauuuucuuuucaaguuaaugauauaucaauauuuugaaaaguuuugaagaagaugguugcaagucagccuuauuggaauaccaacaaagaauugccucauaaaagaauaccauccaucugucuaaaaucaaaggacucggggcugugaagagagaagacucuaacagccuggacuggguaccauauuugucuacaacagauuuuugucaaguuaaaugcuuccuuaaguggcuguaacaguucagaggcauuuuacuacuuauaagacuuacaaauacuuuauuauuuaguuuucuugggugcuuucaagggauuuuuaaaauuuuaagguucugggagagguagugcuaguacuucuaagaaaauaaaccucaaaugagagagacaugcacauuaauauccuuauggaccaaacaaguagaccacauuaugaacuuauaacauugauuuccauugcaugcgguaugacuuccucucuccuuuucccagcagaauaaccaaguucucugugcugauucauaauaaccaaguucacugugcugauucauacuucccaacucuucugcaguaaagggaugcuagaccagugggaaaucagagcugaagucuauggcuuugauugguguuuucauauuccaucuaaaacagggcauugcugauaugguuccuugaaccaacauucuuuaguuucacauuuuggcaguguaaagugcagaucaucaguggaaagaucugguaugcugaaauauuucagggucagcuugacugugguuauugcuguuacauaacuuugauaauauacucacugcucuucaaguggguagcugggaaggugggguuggcugagcuacuuuucagugcuuuguacagacuacacauuuucucauuaagugcauuuuacuggaaggaaacagacuggaauuuuuggugaugguucuaaugaaccaugcucuccugggaaauaauuaaaaacaauuaagagaaauuauauaaucauugaaguaggcuccagaucucaaaagacuggauuuccuucuuuauagcuggguacagugcuuguuauaaaacuauggagaauuucagcuagauguuguaugggaagagggagguagaaaaguuaaggaauccucauuauuaaggcaaaacaaauuuaagaguuuuuuuguuucuuugaugggaagaaaagcuuaaagauuguuuuuaguauaauagugauacucauugacuuaucagaagcauuaaauaucaacaguuaugauacugcugugagaaaaacuaauuccaugaaauaauugccaaggauauaacuggugaggcuaauuguagcugugguuaauaagagaaagcauaaaccuagggcauugugagagcucagaaacaggaagauguuugcauuaguguuaugcaaguucaaaaugaggaaucauuuuuuuuucuguauagaacaauauguuuguguagcacccuaccucucuacuuuuucucuuguuauuccuaaacauguaccugccaccuuaaugaaaggaauuucuuccuaugguuuuucaagcauaucuugcuuauucuuaccuuagcugaguuuaaauaaagccaccuuggaauucugaacaaccaaauggacuacuuggaucucaagggauaauugcauuacuaguguucucaugauccucuuauuuaaauacugcccauccuuugguguccagcucucaagucaccuguucaugaagcugccucaguuacuccagccccaugccuccuuugccugaggucuuuugaaccucgacugacuaccauauuguucaguguuucauuauuucauacuugguguuuuuucccuccaaagcuugcauauaaacucugaggaaaugugagcugauucuaugcuuuauaaauuuuaaaauaucugguacagaguggauaaauugaugcuccacaaauacuuggccauagguugaucaaaauugaaggcgugauuuuuuuucuccccucuucaaaauuauggcggaccuuaaaguuuucauacauuaaauagcuauggcuauuuuaauuaaauacuguuauauuuuuguuauuauaauaccuauucaagaggcaaguucuaauuccaguaaaggaacacuacaagucaauaaucucauuuucuaaaaggggaaacuugcguaucacucagcuugcuaaguaaucuuugguuucucuaaccuguaauuuccucaucucugaaaaugagaaguuaugucuuuagccacuugccucuuucauuuuguugggagagugcacauggcugaagauagugauguuucucagucuuggagagaggugcuaucaguacuuacuucaucauucacugugugcaagaaggaacuugugaagaccugaucaauguauuauuuagcaauuuucauuuuugauuuaccaggauguugugaacacauuucuuuucuaaaacagcuuucuagugugaaucccaagagaauguauaauuuugccucuuacuauugguuuauuuccagaguagaugauucagggaaacuuuuuuuuuuuuuuuuuuuuuuuggugaaguuuguccugaacuagaugcuagcaauuuaguuuugugguaaaacuuuaaaauggaaaugugaugacaaauuaaaggguaagaugguucucugcuggugggaaggcgugggauuuccauucuaauggcaggaaaucaacauauguuagcacauuuuuugcagaucugcaguaaauaaugguagugcuuagauucggcuauauuauuccugcauuuuaauggguuggauggaauaucaauguguuuauagaaaauugcccagaucaaaauccucgucucaggaauugggauccaggacaagauucugcaaagcaaguuguuaucaaggagggagauaugcuccgucugaccucagacgccaccgugcauucuauagucauucaggauggagguagguaaugguuccugccuaugggaacugcaagguugcucuuuaaugugggggauauuugauguuccuuauguagaagacuauuuuuaggcagaauaggcuuuaguuuguggugucacucuaaccauggagauuuggaaagaucaugagauaaaaccagagaauuuauccagagauaaaaaacauagaauuuaagagcuuagaccuuagguaucacucaaaucaagaccccugauuuauagacaaggaaacaguuccagagaggugaucucucagagcuaaauuuuugucacaauucugagagugauuuugucacaauucugagaguuaacaugaguaaacauauacaaaaauaagauucagauuuguagacucuuagauauuuuuaagagaaaugauuuaaccucuaaagugaguagguugaaauucacagucaugggcauugagaguauauuaagauaugaacucuucauuuuucccuuuaguuuucuaagcagauucuuagcgaauucuuuuuuccgaccuaauugcggaaguguauuuaacuuaaggugaaaucuauuuccuuguaucucagaaagaugauuuagaaguuggcuuacagggugguguucccugcaggacugcuuguauuuggggacaauaaagauggauccagaaauauuacuuugaggacucauuacauccugauccaggaugguggggcgcuucauauuggagcagaaaaaugccgcuauaaauccaaagcgacaauuaccuuguauggcaagucagaugaaggugaaaguaugccaacauuuggcaaaaaguuuauugguguggaagcuggcgggacacuggaguuacauggggcacggaaggcaucguggacguuguuggcaaggacccugaauuccucaggcuugcccuuuggguccuauaccuuugaaaaggacuuuucccggggccucaaugugagggucauugaccaagacacggccaaaauuuuggaaagugagagauuugauacccaugaauaccgcaaugagagcaggcggcuucaggaguuucugagauuccaggauccaggucggauuguugccauagcugucggggauucagccgcuaaaagucucuuacaaggaaccauccagaugauccaggaacgguugggaagugaacugauccaaggacugggcuacagguaggcauaccuucuucccagaucccuaucagaguccgugucugugugagaggagagugaggguggggaaaggagccacagccacagcaugacucaggcaucagaagggccacucuaccauuugcaugucugguagcuuugagacauggggcuggaggauaggacaccacauacaaaagcuauuuucauuggcuuugguuuacaaagcccuuugugaacuggagugccagacuugugaaaaguugagagcagaagugugguacugaaaaacagucaggcaguuuaaggacaauuugccucugaagauacuucuuccuuucguuaccuucugaagaucauaugaaacucaggcuaauugaggcaacuuaaugaguuuaaagguuagggcagaauuucaugcuaaguucuaaaccugucuuaaaaggcugaggggguagaauaugcaguuuuucuuuuucuuuuucuuuuuucggacuccuuugcaggcugauuggaaucugcauguuugauuggcacaggucuauggaccccuggcauauaugaggaaggaaaaaguuaaagggcuaggaaauucauccagauaguagaauucauuucugcuauuuaugguucuuguacccuauuccuuuuauuuuuauuuuuagugacagggucuugccccguugcccgagcuggagugcagugguacaaucguaucucacugcagccucaaccucccaggcuccagugauacuuccaccucagccucccaaguagcugagacuacaaacaguugcuaccacaccugucuaauuuuuaaacuuuuuguaguugagggggucucacuuuguugcccaggcuggucuaaacuucugugcucaagugauccuccugccucacccucccaaaacaucggcuucauaggcaugaaccaccacacccagccuucuugugccauauucuaauuaacugugauuuccuaacgcaguucugagucuaggggaaguagccgaccuaacauuucauuuaaaagacagaagcuuuuaauucugcugaaugcuuuuaguaaagucagggaauaucugugguggaaaaaguaagaguaccucaaaaccgacaugccguaaugaucuaguuacuauuuuuuccuuugauaguagguuguuggaaugggguauuaccuacagcaauucuagaacaggcuagaaagacaaaaaauagugaagaaaaacagucuguaacauuuuagaaauggcuuuuauucauguaggggauauuuaggagaugcuaagugcuggauacccauggaugcuuagacgaaaggacacugucucagagcccaugguuaaucuaguggauaaacagagaccuaaauagaugaugaucauacagugagacaugcugcaguuacagggugcaaugggagcgugaguauuaacagaaggagccucucaauuggccuagugaaucaguacaggcuccccaaaggcaagagacuugaaagaaguucgggagcgugcuguguagacaguggagaagaaagcuuuuucagaccaagggaauuccaugugcaaaaccucaaaggguuuuuuuuucuuucugguuuuuguuuuugaaauaugauacacaugcaaaaaagugccaaaaauaacaauguagagcuuaauaaguugccgcaaugugaugccuguguagccaccacccaggucaagaaauaggacauugccagcagcccagaaguucccuuccuccccucugcuaugcauuaaucacucucuuccccaccgaagggagccaugcuccugaaucugugggaucuacuaaaguuuagguuugccuguuuuucaacuuuauauaaauggaagccgacaauguuauauuuuguguccggcuucuuugcacaguguuauguuauugaaugcuauucauauuguugcauguagugcuggcucauuuucuuuucuuuucuuuuuuaauuuuaaauagagaugggggucucacucuauugaccaggcuggucucaaacuccuggccucaagugauccucccaucucagccucccaaauugcugcgauuacaggcauaagccaugugcccggccgaggcucauuuucuuugcuguuuauuuucugucguaugaauauaccacaguuuauuuauugguggccaucugaguggcuuuccaguuuggaccuguuacaaaauugcuuccuuaaauguuccuugauccaucucuuaauguacaugugcauguauuucuauaauauauaaaccuaggaguggaagcaugaucuuuucuaaguuagauaccuacuuuguuucauuauccaguaaugccagggauuacaacuuguauuucuucaugcuacuauuguuucuaguuuugcaugaucauuagcugugaccauuuugacuuucuuagguuccucucccuacugguuucuaaauuccuuuuaaaauauugcucuugauuucauagagaacuuagaguugugaucuuuugccagcguuccauugcauugacguuaucuccaauguacauaaacacauaggccuuugaagauaauguucuggugcgcugaaauuuucccucaaguggaggagggaaguaggaguguuuuggagauaaugucgauagaagagaaagaacauuguuuuauaguugcugaggcaguucugguaaagaaaggaagccugugauaauucuuccucucuuuucuucuccaaauaggagauaauauauugagacauucuuuauuugauucuuucugcuuuaucaagugguauaaaacaagcuacaaagcauugucguccaaagaguagcuaauccauacaggggcggcuguggaauuuguaaggguguaggcaugcuucgguuaacuuuuaucugugaauaucuagccaucugucagacacagauuacauuuguuauuuuuuuucuagagugggaaguugacauuuuucuuuucguguuuuaaaccaggagucuuaaagcagauuuucugguuuuuaaaaauugucccuuugcguugauugcuuuuggucacaaguuugagcaugucucucagauauuuaguaucagaaauguuuuuaggccgggugugguggcucaugccuguaauccaagcacuuuaggaggccaaggaggucagaucaccugagggcaggagugcgagaccagcuuggccaacauggugaaacccugucucuacuaaaaauuaaaaauacaaaaauuagcugggugugguggugggcacccguaaucccagcuacuugggaggcuaaggcaggagaaucgcuugaaccccagagguggagguuguggugagccgagaucacgccauugcacucuagccuaggcgacaagagugagacucugucucaaaaaaaaaaaaaaaaaaaaaaaaccagaaaagaaaaagaaauaaugguguuuucaaacacauugcugucaacaaauagacauauaguauauaaaauuuaaaaucuguuggauagugauucuacagcuuugauuuaauuuaggaacguuaagaaaucucugcuggcugcgguggcucacaccuguaaucccagcacuuugggaggccgaggcaggcugaucaccugagauggggaguuuaagaccagccugaccaacauggagaaaccccaucucuacuaaaaguacaaaauuggccgggcgugguggcacaugccuauaaucccagcuacucgggaggcugaggugggagaauugcuugaaccugggaggcaggagguugcggugagccgagauugcgccauuguacuccagccuggguaacaagagcgaaacuccaucucaaaaaaaaaaaaaaaaaaaaaaaaaaaaucuaacucaguucucaaccuugccugcacaccuggagacuuuaaaaaaucuugacaccuagggugcaccuuagaucaauuaugucaggaagaaggauaaaagaaggauaagacucccaggcuacugaagguugaugaucacuacucuaaccucuagucuauaauuuagggguuuucaaaguauggugcccugaccagcagcauuaacauaaugugguaaccuguuagaaauacaaauucucuggucccaucucagaaacugagagaguggggccagcaaucuaauucagcaugcccuuccuuucuucuguugauccugaugcguacugaaguuugagaaccacugcccaaaucagugguuuuuaagccuaacugcauguuccagucaccugggaacuuuaaaaacauaguaagacccugucuccaaaaaauaaaaauaaauuauugcaaacuacaaaugcuguacccaaccuuuugcaauuauuaacaugauucccuuuaucugggauggggucugugcauugauauauuuuucaaacucccuggguaauucuauuaugcaauuagauuuuugagaacauuguauuaauagaaaguuuaaaagagagcaugugauaaucauuuuaagagaaaguaaauggauuuuggccagaauguuaugugugauauggauguguauugaggaaguaagucaaugauuaauugaaauuguagucaucggucuuucaccuauuacagagcuggacaaacaaguauuuaaaaaguagcugcauuuccuucuaggagaacuaggugcagucaagguuuggaacugcagccucauauagaaaaaacauuagggauugacgaaaaugaaauaugagaauuaaacagcacucuguaauaacaucuuugucagggauuuugugaauaccaugacaaguaaucaaaugcacaugcucuuuuuccuucuaggcaagcuugggcuuuaguuggugucauugaugguggaagcacuucuugcaaugaauccgugagaaacuaugaaaaucauagcaguggcgggaaggcucuugcccaaagagaauuuuauacuguggauggccagaaguucucugugacagcuuauagugaauggauugaagguaggcaaguagaguuuauacucuuguaagacacugauaaguauuaugacagauuuuuuuuuucuaagaauaguauuauguucaaaugacaguccgccugguuagauuucucaacuaguugaaguugaaacuuaguuuuccuacugugcuuaaucuuuuagaacaaaauccaguaaucuuuuagaacaggggucuccaaucuuuuggcuucccuagaccacauuggaagaagaauugucuugggccacgcauaaaauacaguaacacuaauaauagcugaugggcuaaaaaaaaaaucucauaauguuuuaagaaaguuuaugaauuuguguugggcugcauucaaagcuguccugggccacauguggcccacgggcugugaguuggacaagcuuguuuuagaacaaagcugaguugggggugcugaaacuagaauagaccauucucuagucuagaaacaaucuucugggcuuggcgugaagagaugaucuauuagggaugaggaagcuggaaucaagccccagcuuucugccuccaagaugacugcuguuucuuugccucugccaaaaagcauaggugguagauaagaagcguuucuuagcaggaauuuuguccuguaaguggaguuuagugguccugucuccaguaccacuaaaaaaaaaguagucaucuuuuuuuuuuuuuuuuuuuuuuuuuuuuuugagacagagucucacucugucacccaggcuggagugcaguggcaugaucucacugcaaccuccgccucccagguucaagcaauucucugccucagccucccaaauagcugguauucuagacaggggauaauuacugacagacuucuagucaacguuuccuuuguaggaaauguuauuuacauuuccacauuagugauaaauacucauuuuugaaagaugguauguucuaguuaucguaagauauuguucaugucucauguucucagugacuuacuuucuggaagagguagaaaauuuucuucaggaaucagagaaugaacuuuuuuuauguuucccauucaguagugcuaguaggagauaauccgagacaggauuuucuuuuaaagccaagaaaaaauguguuagugacuaauacaaaucuuccccaucuaaccuucuggcuuuaaaaaaauuuaacagauagaaacaaauucuagugaucuuucaaaucaaaauuuauuugucuaguagucaucuuuuuuuuuugagacggagucucacucuguugcccaggcuggagugcaguggccugaucuuggcucauugcaaccucugccucccagguucaagcaauuaucugccucagccucccaaauagcugguguuacagguacccaccaccaugccuggcuaauuuuuguauuuuuaguagagaugggguuucaccaucuuggccaggcuggucuugaacucccgacauugugauccacccgccucagccucccaagguacugggauuacaggcgugagccaccauacccgguuagucaucuuuuucuaaagcauuacugaauuuuuguuuuuuuuugagauggagucuuguucugucgcccaggcuggagugcaguggugcgauugucgcucacugcagacucuaccuccugguuucaagcaauucuccugccucaggcucccaaguagcugggauuacaggugcgugccaccacgccuggcuaauuuuuuuguauuucuauuagagacagaguuucaccauguuggucaggcuggucuccaacuccugaccucaagcgaucugucgaucucagccucccaaagugcugggaugacaggcaugguugcauuacugaaauuuuauaugaaaaaaagaauguuucuuaauugcucuuaggggaauuuauuuuguuggcaaaaaugugaaauuugggguagggguuguuuuugccuccaugagguuuucuuuauuuguucuuaaccugcuuguuuugauucuuggagaguauaauauagaggcuuugaaagaaauugggcucuggaauuagauuagcuuuaaauugggggcucuaccauauuuagcuguuauucaaacucccugaucuuugguuucuucaucucuaauaaauauaauagcuccugucucucacgguuguuuugaugaauggguauuaugcaugugggaucucaacaacuauuagcuaucauuauuguuguuagaauuacuauuauuaauauuauuauuuguauaaaaucuuacaggcuuuaguaucuggcaagacacauauucagaaaacauuuuagauuuguuaggcacuuuauuucugugcuuuauagagauagaaaagcaggguagaucaagaguacaaaaacagaauccaagacuugcccagguuaaguuuuaucuggauaguuggcagagccggguacggugacucaugcuuauagucuuagagcuuugggagcuugaagugggaggaucacuuaagguuaggucugggcaacauagugggaccaugucuauaauuuuuuuuaaagacuguaagaauacauauuauugguuguuccuugcuugaauuuccccacuuuugauucuccaaagugaauguguucuucuuucacucauauugucaucccuuagaguuagcauauuuuuuuucuuuuucuuucuuuuuuuuuuuuugagacggagucucgcucugucacccaggcuaggguucaagcgauucuccugccucagccuccugaguagcuggaacuacaggcacgugccaccacaccuggcuaauuuuguauuuuuaguagagacgggguuucaccauguuggccaggcuggucuugaacugccgaccucaggugaucugcccaccuugaccucccaaagugcugggauuacagacuuuucuuucuuucuuucuuuuuuuuuuuuuuuuuugagaaagaucuuacucuugucucccaggcuggagugcaguaguccaaucacaacucacugcagccuugaccuccugggcuuaagcaaucuucccaguaucugggaguacaggcaugcaccaccacaccuggcuaaguuuuugauuuuuuuguagagaugaagucccacuauguugcccaggcuggucuccuggacucagugauccucccgcccuagcugccuaaaguguugggauuacaggaauaagccaccacgcccauccuagagucagcaucuuaaaguagccacaggguaguaugcuguuaauuagacgacagagaaguacugauauuuauuaaacagcuaucuuuugaaaugucauguuuuccuucucugucaguguuaugaaguaguucucaucuauuucauggacauuuccguuaaaucaguuuuugauuuaugacagauuauaucaugaauguuaagaagcagaaaacauuucuauacuggauagcauguaaaagaagccaaguuaugaaguuggaucagauuuucaguuccugucugcuuaacugggaacuaacuuugacuuucaaagaagauauuaggaaagaucaguaauuaguagucauuagauuacauaauuuacaucaucccaggaaaggagcugaguuggacaggggcaccaucaugugaccucagguuacauugcagaucauacuggucauacucauccauucaguagacauccguggauacauaccacaaacaagacagaguagugcauacguaaauaauguacccugcuaccuucacugaugcagcuuccaaggaggugagcaguccucccacugggaagguaugaacaauaccaggcaguauaccgagagaauaccggagagagagagguugcuuccaacaaggauguuugggaaguccuuaaagaauugccugaacuucauaaaaaggacaguauguugguuggucaagaagaauggaaggacauuuuaggggaagaauaaaucaccaucaaaggcacagagaugaaggguuuucugagacagauuuuuauguuauuuuuuugagagaggaucuugcuuuguugccuaggauggagugcaguggcacagucguggcucacugcagccucaaacuccugugcucaagugauccucccaccucagacucccaaguagcugggaccacaagcgugugccaccaugcccagcuacuucuaaaaauauuuucuagagauggggccucgcucuguugcucaagcuagucuugaacuccugggcucaagugauccucuggcaucggccucccaaaguguugagauuauaggcgugagccacugugcccagccacaaauuguuauuuuauguauuauuuuugagacagggucuugcugugucucauaggcuggaaugugguggcccgaucauagcucacugcagccuuaaccuuccuggcucaagcaguccucccaccucagcugcccaaggagcuggggauguaggcacacaccaccauaccuggccaauguuuuuuuguagggacaggggucucacuauguugcccaggcuggucucgaacugcugagcucaagugaucccccugccuuggccuccugaagugcugggauuacaggugugaaccaccacgccuggcccacaaauucuuauucuuaauauuaagauuguuagugugcuaauguucuauccauuuuucugugcuuggaucaacuugaagcacuggguauuuauuacagaccuauccucugcuugacaacuucugcuggaauauauguacuugucacauauuaggaugguuuggggucaguauaacaguuguugcacugaguuaaauauagcaagagauuuggggaucuagagccuucuucaaaaguauaaaauaaugguuuacuaaggugacaucuuguguuccuucauggcuagagguacauggggcacucaccccuugaaggcagggaucucucuguuuucauauuuuuauuacuuauaucuguagagugacuaauacaugguagcaugcguaaaaauuugcugaaucgugguuaucuuaacuuuugauuugugaaucagugugaggguucauuuuagagagaaaaaaauacuguuaauguaucacuuucuuuuucuuuuuuuuuuuuuugguuuaggcguuucucuuucaggauuccggguagagguuguagauggagugaagcuaaauuugcuagaugauguuaguaguuggaaaccuggagaccagauuguggucgcaagcacagacuauuccauguaccaagcagaggaguucacucuucuucccuguucugaaugcagccauuuucaggucaaagucaaagguauuaaacugcuuagaguacuucuugggaaacacacuauuuucuugggauuugauuccugaaauccuuuuuccucucagucacuaccaucacuaccaccaccaccaucacaaucaucaguauugaaagucauagcaguggagugcaucaaacacuagauuccagggaauauuagauaaaaauagcuauugagcaauauucuugcugcuaaugauacauauugcuucaguuucuuuguauaaaaaaaagaugucaacuagagaaauugauuuuccaaggucuuuucuauuauuuuaaguucuggguuacaugugcaggauguguagguucauuacauagguaaacgugugccauggugguuugcugcaccuaccaacccuucaccuaaguauuaauccaagcaugcauuagcuauuuuuccugaugcuuucccucccgcugccuccccuccauuuucuuuuguauuaauuuucuacuaucagauaauaguaaacccaaugaugaauuagauccauuuauuaauagaaguauuucuuaauuaaaagaaauccuaugguuuucgagugccuauuugauuaccaaaaacaaaaacaaaaacaaaaacucauugauauuuaaaauggaaucagauagguauuuucuuaagacuacauuuccuugcugggagcaguggcucccgccuauaaucccagcacuuugggaggcugaggcagguggaucucuugugguuaggcauuugagaccggcccggcccauacggugaaaccccaucucuacuaaauauacaaaaaacauuagccaggcaugguggcacaaggcuuguaaucccagcugcuagggaggcugaggcaggagaaucgcuugaacccaggaggcgaaggucgcagugagcugagaucaugucacugcacugcagccugggcgacagagcgagacugcgucucaaaaaaaaaaaaagacuacacaaagaaauucuuacuguaaguugcauauugaaagaaugccugacacuuaccgggcacucauuuugagccugguacuaggcacagccccuuuguacauugcuucauuuaugggauucauugugcauuucacucauucuauugcuuuucuuuugaacucaacauuauacauuuaugguauaaaacaaaagaguuuacaguaacuguucaguaagugcuucuuuaguuuuucaguaauuuagaguaauagguagagcuucaacauuuaaggaaaaauuuucugcuuuagaaaaaaauagugauuggcucaccuggccuuuuuucccugugcuuccgucaacauuguacuuuuccuucuugauaauacagggcauaaacaaaacaagaacacugccccaacaaaaaaaccccaaaacuaugauaccaucuggcauuaauuuuuuuuggaaauuccaacucuuguuaacaagucugcaugaugagucuucaugaacuguccucccaagauuuauguguauuuuuccuuccugaguuuauguaauaagaucaucagugaaaagcucauuauuaaagugcuucuacacuuccaguaaaugugggaauuuaaaagaaugcauaauaacauaaaauaagaaaugagaaagaaaagaugguaauuuaucuauuguuaauguccaguugcagauuacuucagcuuucagguaaaagcauaaacaaguugacacccugauauuaauaucuacacaccauuuguuuuauggacucacuaugcauuugguucuucauaugcccuaggggaggagaccaagagcguauggacagaaacuggagagaaagauuauagaucauuagauuccagauuauuagugcuguugaagggaggauugagcugcuucaggaaggaacaagcuuucugucaguguguggguuugagaauuggcagaacaguuaguagugaggguucaggcagugggugggggcuggacuagaugaucuuuaaauucccuguguugggaggcugaggcaggagaauggcaugaacccgggaggcggagcuugcaguaagccaagaucaugccgcugcacuccagccugggggacagagugagacuccgucucacaaaaaaaaaaaaaaaaaaaaaaaaaaaaaaaaaaaauuccccguguccugggauucugauucugaagugucagagaaugggagcagaugauaaguugucaggaucaucuugggguuauggaaugaagagaaugucuuuuugaagugaguuucauguuuucuuuguucuaauauucuuuuuuuuccuugcucauaucaaccagaaaccccucaguuccugcacaugggugagaucauagacgguguagacaugagagcugagguuggaauucuuacccggaauauugugauccaaggagaaguggaggacucaugcuacgcagaaaaucagugccaauuuuuugauuaugauaccuuugggggacacauuaugguaggcaaaaggauuugauuauuucuuugaaauccugguugcuaaauauauguuugaagaaacugucaaguuuuggaacaagauauaaauggauauuaaaagcaaaucauguuuuguuucucaaaugacaaugaggagguuuuagaugauuaaaauagaauguuaugacuucaguuaguugaccuggaccucuaguuaaaccauuuaagaauuguuccaugaagagucaaaucaauauauugggaagaaccaauuacagagaccaaaaaacaaaacaaaacaaaaaaaaacugaaggcucuugguugguauccaugcaugcgauuucugaaagaaucaauuaguuuuuuuaaaaagcauaguauuaccaaaggguuagcaauacuagcaagcacaugcaaaauauguuccuauaaaaauauuuuuuguaugcaaauuuuuguucuggaaaaauuuugagcacuuacuauaugcuaggcaguauucuauuaauauauacuaaucuguuggacuucugggcugcauuuuggcuacauguguuuuuaaaucacuuuuugugcauugaguaggcugugguuguaaguaguauuucuguuacaaggaauuuuuuuuuuuuuuuugagauacagucucauucugucacccaggauggaguacaguggcaugaucacaacugacugugggcucaauauccugggaucaagugauccucccaccucagccccgccaaauagcugggacuacagguguacaccacagugccuggcuaauuuuugcauuuguuuuuuugagacaagguuuugccauguugcccaggcugguauugaacuccugggcucaagcaauuugcccaccuuggccucccaaagugcuaggugugagccacuguaccccgccuguuacaaggauuucugaaaugucgaucaguacuauucccuuguuguuaguaauacgauugaaaaucuaguguuuaaauauauugagagugcucaaacuuuggaucacagaagaacuuuuaaaaguaacuuaagccaacaauauuaugugcuaacuaaaacacuggggaggaucuagaaauaaauaacuauuuaucagacucugauggagguuauagaagugaaagaacaagacgagacugggaaugaccaaaauauuugaacaaaucaaaacacuuagcagagaucauuauugcagcuuuccugauuacauuugccuuuauuccuaauuggaggcuauuuuuguggcucuuuaaaguauuugcuuuuguaaagaagcauuuccuaaauuauuaacuggcaaucugggaaaacaggaugcaaaagaaaaucgaauguuuuaauaaguauucuccuuuggauguuuucuacuagaacaauauuuuuugcuacuucccuauucugaaaaguaugaguuugauuuuaguaccuugacuuacagauaaugaaaaauuuuacuucaguccaucuuucuuauguggaauugaaacacaugggucagcagcagauggggcgauacccuguucauuuucaccuguguggugacguggauuauaaaggaggauacagacaugcaacauuuguggacggccugucuauucaucacagcuucucaaggugcaucacugugcaugggacaaauggcuugcuaguaaguagccucgcauuaggucaacccauauuauugaaauaguuaacucucuuuaauucucaugucuucucaauuuuauauauguaaacuguuuagccacaugccuugcucuauccugccuuuucugagcauuccacgauuuuucugucugaaggaagccuaccuuuccaaccacccagaguauccucuuuuaaauuuaauucaauuuuaugucuuguauuuuauuuuuauuuauuuauuuacaacuuauuuuuauuuuuuuccccugugggacccaagcagauuauccccuucagagauaaauuaagccugacauuucacuuugcccauucugcuaagguucaaaccuguuuuuccacuuguacugaacaugcuacacuggauagcgcuugucacuuaaaucacaaucauucuuguuaccaaugacauuaauauacuuuuauuucugcagauaaaagacaccauuggguuugacacacuaggucauuguuucuuuuuggaagaugguauugaacagaggaauacuuuguuccacaaucugggacuccucaccaagccggguacucuccugcccaccgauaggaacaacuccauguguaccaccaugcgagauaaaguguuuggaaauuacauuccugugccugcuacugacuguaugugaguaauuggcggagagaaaaacccaugagucagggccuuugacuuuuggggaagagguuuugggggaaguuuuuagugggcaggaguuuuuaugaagaauguuuaaaucaccuugaaaaaugccuugcagggcuguuucaacuuucuggauugcucaucccaacaauaaucugauuaauaaugcagcugcaggcucacagguaaauaacguuaaagugaccucagauguuuuaauguuuuucuuguuuauaaauagucugguuuauuuggauuuaaugucaugugugccaguguaacccaagcaugacauuguuuucugguacuacuuguuuaguugagagcagaauacgguagagaugauuauucuauuucuccuaaauucuuugugcccguuaguaucuuuuuuguaauuuuuuuuuuuuuucucgagacagagucccggucuguugcccaggcuggagugcaguggcgcgaucuuggucacugcaagcuccaccccccggguucacgccauucuccugccucagccuccugaguagcugggaccacaggcgccugcuaccacgcccagcuaauuuucuguauuuuuaguagagacgggguuucaccuuuuuagcuaggauggucucaaucuccugaccucgugaucugccugccuuggccucccaaagugcugggauuacaggcgugagccaccacgcccggccugugcccauuaguauuuaugaguuuaauaagagagaugccaaagggggaaaagaagugggcuaaucacuaggguuauguuauuuccagaguguauuuuugguguauuaaguacaaccuuucuggcuucucauauuuaagucauauguggccaaguaacugauaauuucaauuucaggguguugauaaaaauaggcuuacgucaggcacaguggcucacgccuguaaucccagcacuuugggaggccgaggcuguuggaucgcuugagcucaggaguucgagaccagccugggcaacauggcgaaacccaaucaucaccucccccuacacccuccaaaaaaaaagccaggccuacugguguuugccuauugucccagcgacuugggaggcuggggugggaggauacuugagcccaggagguggaggcugcugugagccaagauugcgccacuguacuccagcccggguaacagagugagaccccgugucaauaaaaacacacacacacacacacacacacacaaaaaccccacaaaaaagaccuuagcuuuucuuuaugagaauggauuauuuuggagaauaccaugacaguugucacucuggucagggggcacacccuuuuguugaauguaaggcuuuauauacaagugggaauuucauuuccuugggaaagcagcaaaacucguuaugaugaauuaaaacacacaugagaauaauuuuuaagagacuaaaugauauuuuuggguaguagaaauguccccuggauaaguuuggagaaauuuguauuuauuauugagaauuuuaguguuacuaaaacugcucauuuaaaaccuaaaugaaucuuuuuuuuucucccugagacagggucuugcucugucacccagguugaaguguaguggugugaccuuggcuuacugcacccucugccuccugggcucaagccaucuucccaccucagccuucugaguagcugauacuacaggcacaugccaucauaccugcugagauauauauauauacguauauauauauauauguauauauauauauauauauacauauauauauauauauauacguguauauacauauauauauauauauauagagagagagagagagagagagagagagagagagagagaagguuucgcuguguugaccagacagaucucgaacuccugggcucaagcuauccaccugccuuagccucccaaaguuuuaggauuacagucaugagccaccauacucaggcuaaaugaaucuuuuuguuuuuuugaggugaagucucgcucugucccccaggcuggagugcaguggcgcaauguuggcucacugcaaccuccgccuccuggguucaagcgauucuccugccucagccucccaaguagcugggauuacaggccccugccaccacggcuggcuaauuuuuguauuuuuaguagagacuggguuucaccauauuggccaggcuggucuugaacuccugaccucaggugauccgcccgccuuggccucccaaagugcugggauuacaggcaugagccaccguacccauccacuaaaugaaucuuuuaagauaguaugcuaucgagauuguaacuguguugaagacugcaauuaaaaaaaugaaauuugcagugauaccuaaauauucauauuuauacaucauggcuauuuaaaguuuuuaaaaggaaauaaauaccuagcauuguuugcuaagaugaagcaaaagauuaguugaagggaguauuuauuugagauaacaggaaaaaaggcaucagugggugaugguuugaacucauaucuguuauuuucuuuaaaaacauaacacauaaucugaaggucccugucaauugaagauucuauuugacagggcagaaacccagacauuugaucauuuuagguuuucauucauugauuuuucaucaaauauuuuugagccuguaugagguuugugcuagaguuucuaacuggaaagugaguuuuugaguaaagaugaccaagaaguugaugcacagccaucuucugaucuauguaacauuaugcgucaacagucagaacaaagauuucuuuuagcucuuuuuagaagucagggcuugaagauuaaagcaaauugccgagaguucaugaaaaauagaaggugaggcugccagauacccuuacuguggcucaugugagaaaagaagaaagcguugcauguauguucguccuuuuuauucugugagcuguuuauuuucucucuagaaaaacuguuccgguaaaagcuaauuugggcaggguuuuuccucccaaaguaaaucaaaccauuuuuuucauuguaccuuuccacugccuuuuacaaagcuccuuuuaccuguguugacaccacuguguuuuaacaggaaacagcugcuacuccccuuauccccgucccacucccaucuccaucuccauugcauccuaggaugguccacucugcccucagcuuauggguuaugguauggaguuuucuucugacccuccaggucuuaucccgucaacuugucuguuuugugcccagaagaguugagguagcaaacauuuuucagaguaguuuguuuuguuaagacccauuuguagacuuuuaucauggaaaauguuacacauggcauucauucugguguguagguauaaauauauguuuuccauaauuccucucucaucucuccucccaauggacucuauuuguuacagcuaguaaguacuuauuagguauauuauauuuuaauuaucucuaucuuucuuauuagacuaugaauuauuugagaauagucuuacuguauaccuggcauauagugggcacuaaauaaaugugugcugaauuugaauuaaugcuguccuuuuacacuguaugauuaaguuuuaacaaacuauuuaaucgaaguuccauaaagugaaguuguccuucacauugggcugauuuuuaauugaguuguaaaauaaagauuugucaugggaauuaacauuuauuuccauuuuuaugucuaauuuuugagugucaaaaaauuuuaaacuguuauguuccuauuaaggucaguaauacugaaauugaacagacagggcccagccugagacaguauccugauucauacguguggugguuuuuuuuucuuuggcaaaaauuugccucaggacaggaagggcauuagacuuguuugaaagaagucagugaucucugcgugcugguggacaguuguuuaauaggcaugacucaucuauugaacagguuuggagguaaacagauaaaaaccauauugcuuaacaucugugcugucuugguuacauggaaagccgauuugguuuuaauucugcauaacuuuuaacguagauaaugauggaaaaguuuugaaagugaauuuuuauaccagccaauuauuucucuuuuguccaauccugcaagcaaaauuaaauuugcuuuuuuaaaaaaauacaugauauaaccacuuugagacguguguacaacuuuuuauugucaauucugaaccugcaauaaugaaaaauuugggugaaaaagauuaaacuugcugaugaagaaguuaguuuaugagaguguuucauagauaucuguauaaauuaggcuuuuaaugggcuuguccuuucauuuguaggaugcuggaauaugguauuuauuccacaaggaaccaacuggggaauccaguggauugcagcucuuggcaaaaccagaacucacuccauuggguauauuuuauaacaacaggguccauucaaauuuuaagguagguuucuaaguuuuaacaauuaguacauaugcuagacaguguaaaggaugaacuauugugauuauauuuuaguccacuuugugcugcuguaguagaauaucacagacuaguuaacuuauaaugagcagcaauuuauuuggcucacacuucugaaggcugggaaguccaagaucaaggggacagcauuugguaagguucuucuugcugugucauccacgguagaagggcaaggagaaggcgagagagcuauagaacaaauuugcugccucaagcucuuuuauaaucagcauuaauccauucaagagggcgaauccguuaugaccuaaacaccuuccauuaggcucuaccucccaauacuuuugcacuuucuaacacaugcuuuuugggggaugcauucaaacuguaguagauuauagcugagaaaugucaauuuuugguagaacuugucaucagagaaaguaauuuguaauuaaaaacagacaccuaaccccucccuguucaggauauauagagagcauuccauuuauacauaccuauugcgcauacagguaugugcaacacauacaugcacguguaaccugaauaauuacauaauggauuugauucauguguccucauccucucccuuguuucuucucaccucuuccucccucucaacuucuuuccaaucuuuaaugucguuaccuguuucuagggagguacacauuaaauaauauccuucuagggguugauaagcauaauucaucucuucuuuuugauucacaguggcugguagaguguccuauuaggcauuauacuaauuauauaaauagugaaauauugcuuaagaauaauugaccuaauuuaaaaugauacagaucaaguaaccuaaaggccauuaggaguuuccauuuuuucaugaaauuuggcucuaacccuucgcccccuggugauaaauacauuugguuuauuuugugcucacaggcacuuuaauguuuuguuaugugugugaugcccagauccuuuacccugaugugacccgcaccagaguucaaggaauacuuugcauuuaugauacucagaggauccuuuaaaaaccuaaguguguuacaguuugaagagcuuagaaucacuugaugaagaguugaggaaaaacuauacaaaacugauuuuugugagcugaauaguugauuaaguuaauguuuauugaaaauagcauuucauaguagaaauccucaauuuuucuuaauuguaaaugguauaaaaagcaccucauucuaauggaauuuuuuuuuuucuuuuuuugagacagagucuugcucugucgcccaggcuagagugcaguggugcgaucucagcucacugccaccucugccuccuggguucaggcaauucucugccucagccuccugaguagcuuggauuacaggcaucugccaccaugcccagcuaauuuuuguauuuuuaguagagacaggguuucaccauuuuggccaggcuggucugaacuccugaccuugugaacugacugccuuggccucccaagguguugggauuacaugugugagccacuaugccuggccccauucuaauugauuuuuaaugugcaguaauuuacucaauuaauaagaauauuaaauuuaauugacaugaguggaugauuagguguuaauuuguuaaauuuggaaaugucuguccaggauaauacuuuauagccaaaggagauugaauucuuggaguacucaaaaagaaacaugucauuuuggaauaacucauaaacacauacaugcacacacaggcacacacccacaugugugcgcacacacacacugguccuuauggcuucaacugcugaugccucccgaaucuguacuaguccagguuggucaggcuuauccuacugcuuacugaguacccuuugaaugucuuauggacauaaauaaaacauguugcaaacuaaaauucuuauuuuuaggcccagaccuauucucauaugucugucucagugaacaaaaccacuacucagcuguggccugaaccaaaaauauaugagcuuuuauugcuuucauucccucacccacagaauuuuaucaauuacaaaaugauaucaauucuacuuaguaaauaauuuucguuuuaucuguuuuccacuguuaguauggccaugagucuagaucaucuuuauuucucuucuggauuacugaaaucaucuucuaccuuauuugccuccuuuuuuuuuuuuuaaauucucuuucaauccauuauccauuuuauagcuacaguguuuuuuccuuaacuugcaguugguuacaaugcguuuauuaaauuccuauuguccugacuucuguagcacaucaauuccaugugaucugauguuugcuccucuuuagccuucuccauuauauuuccuuccuucguacauuuuuguuuguccaucaugguuuuguuuuuuuuuuuuuuuucuuuggcuguuccaugcucucugccaucucuagacguuuguacaaacuauucccuugaguuauuuucucuggcucuucagcuccuuccucccaccuccuccccugcaccaccaauccauucuuuugcuuaauuucucuccauccuucagguuucagcuuuaagaggucacuucuuuuaggagacauucccugaauccucucaccuccacccacaaaaaaggccucuccagaugcccuucuuuucugcucaaaccucaucugcuuccuuuaucauaugcuuaucguuuuggauuguaauuauuuauuuaauugcaugucuuucugcuaguuuuuguguuagcaacaacaaggaucauauuuuucuuguuaacuaauguauaacacugggugccuaccaguaaguauuuguugaaugacuaaaugagugaaaugaguuaaaugaguagaaaauauccaggaaaguagcuguuuuuuuuuuuuuuacaguaccuuugcuguugauucccugccccacuuuuuuugguagaagugauaagcuaaaaucuauuuucaugaaucauuguauauguuguuguaaguugggauucauauucauuccaguccauuauuuauauuuuucaggcuggcuuauuuauugacaaaggugucaaaacaaccaacucuagugcugcugacccaagggaauaccucuguuuggacaauagugcaagguaaagcuggcucuuuuaagucacacucaagcuauacuuugccaaagcaaaacuuucuaacuggaguuuauugugcucuuucugugguaauacauuuaaaauaaaguuuuagaaguucguaaaaggguuuuuggaaaaccacuuauucuguugucccagguccugugacuggucuuuuaucuuauugaaauacuaaagagguugauguuuuucuccuuuuucauugcuauaaauagaugcuagagagaguugcagaaagagaaagaaaaaagaggagauauguugagaaaguuuccaaauuuggugugcaguaugauucauugaaaaauaaguuaaacuaagauguuuagucucauccuugaaaaaccaaaccauauagaauuuauucuuuguggucaaaaugaauacugcauuuaauauuucaaaaggaaugaucccaaauuugaugagcaaccugguucugguucagcccuuuguagccucagauuuacaucauagccaggcucuagguuacuuucuuuuguaaucacaaaaugcauuagguauggaucagcauuucagcagaguucucuuacaugcuauauaugagccaaaauaaagaaaaugucccagaugaaaauaaacuuuucuggaaaagauggugacuuaaagucauauucaguagaaccuguguacauauuauuauuuuccauacuucaaauugauugaccaguuuauggaguugauagagugcuagauuuaauaggcuuuguugacagacacuuaggaaaagaauaccaggccugauuguucuucaaagaaucaaguaggaagcacaccauagguuggugagccugacuucagggugaggcagauucucacaacacuuuaauaagacaugaggucagaagaaaacuggggaaagucuaguuugucuugaggauuccucaaacaucaaguugagccugaaauauguugaugcaaugaucagauagcauuugagaaaccaagaaacugugggcguuuuaaaaaauaaaacacaaagaacuggauaccuaaaagcugaucaacaaaugaagugaaaaaauagaagagauaaacuuaagaagaaaaaagaguauauagaugacaauaaauuaugaacuaagaggagaauauuagcuggcaaauaaagaauucuaucuagaagguuacugcugcuuuuuuagcuuugaagaguuuauuauaauugguagaacuaauauaauuuauuauaauugguagaaaguaauguguucuuugcuuagcauugccaaaaaauccauaaacacaauugguucucuucccugccuuaaaaacuuauuuauguauauauauuuauguauauuuauaguaauguguauguguauauaugugaauauauguguguauauauaugaauagaguaaauauauuugaguucauugauguuuuaauuagacuugacaauaaaacaauuuacucauaauggcuuaaguaguuccuuacuagguguguguaugugauauuaugaaaaugguuaucuuucuucucuccauuauuuauuucucuuacuaguuuauaacuacauacauauugauaaggaauuggacuccauuuggaaguuguuauugaaaagaacugauuauagcagaaaaggaacaagagcuugugcauauacugaacuaguguuuagacuaugcucauauauauauucaugcaauuuagacaugguaaaaaugauaaaaacuagcauaaaugaguaauaaaccagcucauauauuaaacaccaggcuuagaagauccagaagauauuuaaucuguucaucaaagaggaagcugacugaacaguuaaucagggccgggcgugauggcucaggcuuguaaucccagcacuuugggaagccaaggcggguggaucaccugagaucaggaguucaagaccagccuggccaacacggugaagccccaucucuucuaaaaauacaaaaaauuagcugggcaugauggcagauaucuguaaucugagcuacucaggagacugaggcaggagaaucacuugaacccuggagguggagguugcagugagcugagaacaugccacugcgcucuagccugagcaaaaaggcaagacuccaucucaaaaaaacaaacaaaaaaaccuguuaaucacauaagccuuuccuugugucuucaagacgugaaaauauaggaauccaaagauggaaaauuuuaacugaagaaagcucuugguuugaaauuaggaaauuuaaucuacaagagugaaagggcauuagaaccaccuaguacauuuaaagcagaggacaauuaagagacaguugagaagugugcugaaaacucaaugaugauaauaagaaaaucgggaaaaaguaacuauugucuauaugccaagugggaaagaagauggaaauaaaggguaucaaagcaaguggucaguuacugauuacuuuuuuucucccuguacaugccugggcacugugggggugucgugauugauuuauauugauaggaaguucagagaaguugagaugguuacagcagagaaucagaugcugccuuauaguacucuuuuuuuuuuuuuuuuuuugcuuucguuuagaacaguaugucuccguuccggaacucuuccaucugcuuacuauuauguaaugacuacaaagcuguuuggcaggaacuacaaugccagagaguagauguuggcuuagagucaaacuuuuuaccucuuaagucagagcuaguuaggguaaagggacuugggccauauaaucuaaagauggauaugacacucuuuaucuucgcagcuacuaccccaguuuauaccacacaugcaucugucugaaacacaugaagauccuucugacuggucuccuuagaguccauucucuauaauccauucuccaaauagcaaucagugaucucuuaaaagaacaaaaaagaaauuugaucacaucccuuccuugauuccaugcuuccauugacuucccauugcauuuccaauggagacccagaucuuuaccuagcccuugcccuccucucuauucugucucccuugcuucuuucucuccagcaaacuuccuugcuguuccugaacaugcuaagcucacucaugccuaaggacauuugcacuugcuauuuucucucgauagcugccucugccaucauauccauuuagugagcaccuacugugugccaacagcugugguauuagcauuaggcaaaugauguuuccucacugguugaaaaucucuaccuguugaauugguuucugaaaagcugugauuucuuuuuuucuuccguucguuuuguaagauuaagacagaaaugauuaaaaaaaaauagguggccuuauggggccauuugaguauuugaauaucauguauuugaguauuugagcaucauggggccguuugacuauuugaguuguuauaguggacaguuuuugacaccaacuguuuuuaccuuuucaguaagguccuuauaacuguuuuagagagaagaaaaagaaaaggugaaguucaguauuuauaauaaauauguuaauuaaauacagucuggcugggugcgguggcucacacuuauaaucucagcacuuugggaggcugagguggguggaucaccugaggucaggaguucgagaccagccuggccaacauggggagaccuugucucugcuaaaaauacaaaacuuagguggguguggcgauggaugccuguaaucccagcuacucagaaggcugaagcaggagaaaugcuugaacccgggaagcagagguugcagugagccaagauugcgccacugcacuccagccugggugacagagugagacucugucucaaaaaaagaaaauauuaaaaaauacagucuauuuuaaauuuaggcauuuuaaugauauugaacccaguuuugucuauaucuaaacauuuaaccagcauacaacucaaauuauacucuaguucacauauauguauguugaaauauauuauuaauuuauuaaauaaguuuauauugguaacauguaccuuaaggauuuguaaacacacaugacauacuuccugaucuggguuuuuuuggaaaugauuuuuaugcaauaauauucugcaguguccauuuuaauugauuuuucaaaaacaaacuaagaagauguaaaagcaguugguucucuggaaacuugugguuaaauaaauguaauuucuucuuugaauguuuaaaauguaaguaaguuguaucuuaagaauuuuucauuuguuuuggucaaauuuaaauucugcuucuugacacuuaaacuuauaacuagcuaauuccuauggcuuuuauguuauauuuuuuaaaauucuuuuuuuaaccccuagauuucgaccucaucaggaugcaaaccccgaaaaaccacguguugcugcucuaauugacaggcucauugcuuuuaaaaauaaugauaauggagcuugggucagaggaggagauauuaucguucaaaauucagcguggguauucucuaccaaguuauuauaugaugacacugauguauuauuuuucagauuuuuuuuaaagccaguagcaugaaagcacagugaugauucuuggaaucauauuauuauuauuaagacaggacaagcucugaggaaguaugcuagaguuaaaagaccacaaauguuugaaguugucucauucuggugcuuuuauuggaacagaacuuauccggugacaugagaguuuuugaugaaauugaacagaaaccgggaauuuaacuuuauauaacaagcauggucuaugucagagcgcuaaauaaaacuaccuggaucuuuucccuuccucuugaaaacuccuuaguuuuucugaugcucuucuauugccauucaaaauaaaagcuuuauaauuccaacucaguaaaucuguugacuuauaucuuaacaugacuugaggcaguaaguaucucacuuuuuuucccauuuguauaauuuuaggaguggucucaugcauguugagcuaagauuuaguguucaacagucuagaaaaauguguguguguauuuuuuuuucuggcacugaaauuagcuucuuggcauuucacaucauuucugaguuuuuucauccaaaaaacugauacuguguugaaucuguagaaauggcuucagaaucauauaccacagucuaguuguuuuuaaaacauaguuauaaaaauaauaauuauagcuaauacuuugauacacugcuuacuguuugccaggcacuguuccuaacauuagaaauuauuauuuuuugagacagggucuugcccugucacccaggcuagaguucaguggugcaaucauagcucacugcagccucaacuuucuaugcucaagcaaaccucucaccuuagccucccgaguagcugggaccacaggcaugugccacaacgcccugcuaacuuuuaaauuuuuuguggagacagagugucccuguguugcccaugcuggucuugacuuccugggcucaagcgauucuccugccucagccucccaaaguguugggauuacaggcaugagccaccauaccuugccaacacuagaaauuauuuaguauguuuaauacucucaagaauccuaugaggaagguuauauuuucauuucaacuuacagaugggaaaagugagagauagagguugaguagguugccaaaagucacacagcuaauaauugacaaagcccggauuugaacugggugcccucacugcagauucugugcuccuaguuauugugaaaucaaauuuuuguguggucauguagagaguaaauauugggaccuuuuggauuucaugauaauuaaauauugagagaauuaccucuuuuuacauaauaugguaaauuaaaauguucuucauucucucuucuuuuacagauuugcagauaauggaauaggacugaccuuugccagguuuguaauugcuuaaaaauacuuacuuauuuuaaagcuuuaaaauaacccuugauuuuuuuuucugauaauacacaggaauguuuuauuauuuuuuuuaacauaaaaaaaauuagcaaccucuuccugaugccacuagagggccaaaaauacauuuuuuuuuuucuggauuaauugaauucauagcaaaguacuagguuaauauagcuggaauuucacagaaggauaauuucugcuuagaagaaaacacuugcgauuuagacuaaaguuuuuaaaaaguaggggaaaaaagaggaagggaguaaaaguagggagaaaauuaaaaaacuaauauuugcuuucuuagaagcugcucuaauuuagcaaguuuaguucuuuaagaacuaaacuuuuuguucuguauguuuuucuacagauaauagucauucuaguugucauguuaaauaugcuugucauuuaauucuuauauucaggacaaguuuguucuccucauucucaguguuauugcuugagacuagagcaaucaauuauugcugcuaaauuaaaguuuguuuauauauaauuuguaaaucauuuauuaauucauaugagggcuggacauaccggcucacaccuguaaucucagcaguuugggaggccaagacaggaggaucgcucaaagccaggaguuugagaccagccugagcaacauagcaagacccugucucuaccaaaaauaaaaaaauuaaccuuaaccaggcauaguggcaugccuguaaucuuagcuacucuggaggcugagauggcaguauccugugagcucgaguucaagguugcugcuccagccuggcugacagaaugagacccugucucuuuaaaaaaaaaaaaguauauauauauauauauauauaucuuaagagggauauauguauguauauauauauuaggcuauaaguagguauagguauuuuuauaguuuaaaagcaauuucaaggcugagugugauggcucauaacuauaaucccagcauuuugggaggcuaaaacaggaugaucacuugaggccaagaguuuaagaccagcaugggccacauagcaagaccccaucuccacaaaaauuuuaaaaaauuaucugggcaugguggcacgcauguguggucccagcuacuuggaaggcugaggugggaggauuguuugagcccagcaggucaaggcugcagugaaccauguucuugccauuguacucgagcauugggugacagagcaagaaccugucucaaaaaaaaaaaaaaaaaaaaaaagcaguuucugaagacuugugaauguguauuagaaaagcuauugacuucuuuuaaaacuuuuagcuuuucaguuauagcaugccuacauuugggaauacauuuaaauuuucuggagaaauguagcuaaugauuguucgcauuuuaacagugauggaagcuucccaagugaugaagguuccagccaagagguaucugaaucucucuuuguuggggagagcaggaauuacggcuuucaggguggucagaacaaguauguaggcacuggaggaauagaccagaagccucgaacauuacccaggaacagguaagcauugcuuuagcuguggaguguuaaauuuaagcaauaaaggaaaaccuaacccucagggaaguuucugugauaauccuggauggauugguuccuaccaugagacucuuuuccuauuuuaucauuuauuacuacuacugcuacagcugcuacugcuacuacuauuauaauuauuauguguauuauccuccugaaauuuuggagcauuaguuauuaaacauuucauagauuuaauuaucaauuuuauaacaaagaaacuugucuuguuucucauuccuuguauaagaccuuauauaaacuguuuuuuuucuuccuucuugagccauagaaaguugccaaacccuaaacuaugacauuaggucaguuuuuccucaauguguguuguugguuuucagaaauaacuacuggaaaaaggaaauuaccuacugaaaagaguccuaggaaaugagaguugauugaugccaaaguuaacucaaaaccccaccacagcugucuaauuaauggcaguuuagauguugaagggaaugggguaggcucuuggcauguuuucugucaucaucaucacagagucauuaaaauuguacuuagcacgucuucaaagcuuuaaggaaacuauuaacuaauaauucauaucucaguucugaggcacaguuuggacuucucauuuuacuugugagaaaaccagguagaaaaauauucaacaguguuuuuaggccucacaucugagcccaugucauaauucuuuaagaaucaacuccccuagaggagugcugucgcagaauguugggcuagaacaaggcagaggaaugggacauacagacuguagcuuuggggagugguggcgcagagugaggacucgggggagagcuguacuauuuucuggaaaaaggucaccaugcuuggcuucucaccccuugugcuuguuguuguggaauaucgagcacugcuaugugcuacacucuguguggaacucguguuagcccauagaagccauugggaaaagaacuucauggauuuuuuaauugcuaacauguauuaaaugcuuaugauaugucaggcccuguuguaaauauauuuauuuaauccucacaaagcucaaugagauagguucugccagcauccuguuuuacaaaugaguaucuuacuaaagguagagaagguggaauucaaacccaguuagguugucuucagugcugugcucuucacaauuaggcucuugcugcuguuucuaagguguagauuuuuuaaaaagcuguauugguugucauaugggcugcaaugugauggucgccaaaucaauuucacucuguauuuuauauugaccuccaguuuuauuucaaaaugcuuuuugcuguuugguaaggaggauuuuccaaaaucaaacuuucucauuauuuaauggaaacagcuuuaauaugaucauaucuuuacaacuuguauuaguccguuuucacacugcugauaaagacauaccugagacugggcaauuuaaaaucaaaagaaagagguuuauuggacuugcaguucuacauggcuggggaggccucacaaucaugacagaaggcaaugagagcaagucacaucuuaccuggauggcagcaggcaaaaagagagcuugugcucucuuuuuaaaacagggaaacuccuguuuuuaaaaccaucggauaucgugagacccauucacugucaugagaacagcacggagaagacccgcccccgauucagucaucucccgcugggucccucccacaacacgugggaauuaugggagcuacaagaugugauuuggguggggacacagagccagaccauaucacaacuuuuucuacaggggagaaccauguugagauguauacuuagaaauauuaaauacaucaugaugcgaagguuuucaaacuaggcuauuugguuuucuugcuagcauauaugcuuuugcuguaaaacauugccuaguuguagaauaauuaguugcuauagagauccucugccaugcaauuaaagaauuaauaggagaggaacuuaaggaauucagaauauuaccaguuccuauacauuaauuacaguuauugauuuaugauuaguaggcuaaggaguuuguguuugaacagaaagggggaaaaugaauaaaacaaaauucucagucuagcuaacccuguugacaugguaagccuugagggcucauguuuucacacuuuuaaauguaucauuucaccuuuguaccaucauuuaguggcuugagaggugguucucugccuaagcgcagacuugucuuuuguucucaugguuggagauuuggaaacgaagaccaaaguaccugagguuccgaauaaaagaucuuaacugaguugauucuaggaagacaaagucaccucuucagagaggccuccauucugucuaaaauagcaucuuucuccccacccaaucuaugauaauguugugucuuauggucucuauagcacuuauuuucugaaaugauccuuuguuuuucuguuugucuuucccacuacagcauauguuucauucaaucagguaucuuguuuuggcuccuacuguauccuagaauuuugcuuaguucauaccggauauuuagcugucuucauaaaacaaguaagugaagugcugcuaaggggacagcccauaugcauuaaacaaaaucuuguauuuccacaggacguucccaauuagaggcuuucagauuuaugaugggcccauucaucucacaaggagcacuuucaaaaaauaugugccaacuccagauagguacagcagugcaauuggcuuccucaugaagaauuccuggcagauaacccccaggaauaauaucucccucgugaaguuugguccacauguaaguauguucuguaguucuuacguagugacuauggugaaaaaaggagggauagcacauucccaaagacaaaaacgcaaaggauuugcaccgagucuguacgagugggaggagacauacacacagagccagcuccuaauuccaugcacucucucccauugaguucaaggggagaacagaagucccgugugacucuggguauguuugacauucaagucauaccuugauagggaaaaugacuucaagugaugauacagagguuguagaguuucauaggaacaagaggacauacgauuuuggaaaauucagugaaauacgcugguuggguagcccauuuccacuaagagauuuggauccuuccugcuauuuuacuugucugagggcuauucuucugggggacuagagaauaagagguugugaauaaagcagaauacuguggcagugugauacaaauuagguuauuucuuuuuucuuuucuuuuuuuuuuucuuugaggcagggucucagccugucacccaggcugcagugcacugaugugaacgguggcaaagucauggcucacugcagcuucaaccucaauuggauggauggcucaagccauccucccaccucagcccccuaaguagcuggguauacaagcauaugccaccacaucuggcuacuuaaaaaaaauuuuuuuuuuuuuuuaauagagaaagggccucauuagccugggcuggucuuuaacuccuggccucaaaugguccucucagcuuggccucccaaaguauugggaguguaggugugagccacugcaucuggcugaaauuggguuauuucugauauaaacuguuggaagguuuuuaugaagauugcagauagacuguaaaaauuaccauuuacaguacaguagcccacaggaaugguuuucuuaccaauuucaccaguauuaccuguacccauaacucacaggacaaucugauuacaugcccccaggcuuucaucaucuugccaguuccaugguggcaauggcacaagacagagaagucucaggacaucuagcugccuguucccacaggcagccacaccugggaaauaagucaucauucuuucauucacauccacccacaaacuuaauaguugcccaauuuaaaauagagcuugauagguuuaucaaagucuaugucugguuuucuacaacagcuuggguguggaucagaggcacaaguacaaauuggagugucagcuugguuggcugguucuuuuuuaggccaugugacuccaggggauggguaggacuaggcugguagauggcacccacauaaaucagcaggaugagucuuggauccccuguccaguacggagacuugcuguuuccuuacugcccauguggaccuccccguaguucucuaugcauccuguuuagugaucacuggcauaggcauacugaaaagcaguuuguuagauacugcauuuguuguccuaaaguuauaacagcauaauacaauccauauuguuuaaguccagcaguucauccagucuggaguuuucuaugguggggaugcucugaagcuuauaaaaggagcgguuugcaaaauuugcuuuacuuaaaaggguggaaaauaugcucuaagcuuuucucagauuuaaccacguaggaaaagagaaguguggaaccaagaacuugccgcuacuuguccuagacgucacaguuuuccauugaguugcuuaucauuuagauguucuguugauuuaaaaacacaccagggcaaaaagugcauaaaagcauuuaagagagguaucugccugacuucaauagcguugguauuauauaauuuacugcuaauaagaagcagcuaaagacuguaaaacaugucaccugcagcccauuuugcagcuguacauuauguguuugauaaaggcuuuaaguaaacucuacuggaugugaaaauuguugagcugaguuuggucuguauugaggagcgagauaguaauauaagcuuuuuagcagauucuagugaguuuaucaauaacucagccauacuaagucaacacuuaaauuguguuucuguuuugaccuguacuuaucuguuuauuuuuuugguggggggagucauaugaacaaguaacugaagcauuuggagauaaaaugauuaacuagcucugaagauaacuuaucauagauuuuuuauuucauugagauauaauuuacauguagggaaaugcacagaucuuacauguacaguuuauaauuuuuaacaaauauaugugacugcauagucucccuucccacaacucuucugcuuucucuccccacaaaugaguuuugucuggagaacagguaauaguuuuuaaguggggaaaagaagaauacaaauaacgaugaaguuuaacauuugcccauuaaacaccauaagguuuugggaaauuccccccaaccccagcaugucauuaauugaguagaaaacucaggcugacuugagugccauagcugacaacuaugaacuguaacucagaacugcucuaaccuuaaagcaaucacaauggaccugcaguugagucauugcaggggaugcugagauagcaggagcccucacuuugugaugucuuucuuuuucacuguggucaggucucucugaaugucuuuuuuggaaagccuggucccugguuugaagauugugagauggauggugauaagaacuccauauuccaugacauugauggcucugugacaggauacaaggaugcuuaugugggaagaauggacaacuaccugauccgccauccaagcuguguaaaugugucuaaguggaaugcagugaucugcagugggaccuaugcacagguaggcuuagcaaauguauaaugcucaaguuccuaccagcuccugccagcacugcuucugugagaaguacucuucagcuuuucagugugauugacauuuuccaaaguaugaucuaucuuccuguccuguccuguccuuucuuuucuuucuuucgauucauuaggagucauggacuccuggaauuuuucuuaaaacuccccaacuccagaucuguuuaagaggugaaagagugagucccagagaggagagcugauuuacccuggguuaaaugugguuggaacguaguugggacaagaacccauguuucuugacucuuagguuuucuugccacacuacagcuaugcccucuaagagggauuuuuauccuuugcuuuuggggucaguaaucucuacuuaaugaaagaaucugacuuuugaggcaaaauaucaauaggucacaugaaaagugagauguucccggggacagagcuggagauuaggagugaguggacaagaaaggaauccaaggaaaauuuccuaauucuauuaugauauaaugucuaugaaaauauggaggagaugauauacauugagaaacaccucuuugaagacauuaagcauuaauguguauuaacuugaugccuaguauaagaggaugaacuaauuugcaacguaguauauaugguuaagagcacagauucuagagcuagacugccuggguuugaauucuggcuuuguuauuuucuaaaguaugcauuggaaaaguuaauuaacuucucuaugucgguacacaauggggauaauaguaguuacucucauaggaggcuguugugaagauagaguacaugcacauauguaaagcauuuagcauauggccuggcacauaguucagugcccgcugcucuuaguauuauuuaaggagaagagcuguaaguugcaaaggugauuuuaauagugacauuuugguggauggaagagauugcagaauggagguaccagcugcccaggauuuugaaaggagcagauccugcccccacccucugccccaugcagacaauuaaaggguaggaauuuuuauuuauuuauuuauuuuugagacggagucuugcucugucgcccaggcuggagugcaguggcgcaaucuuggcucacugcaagcuccgccuccuggguucacgccauucuccugccucagccuccugagcagcuggacuacaggcgcccgccaccaugcccggcuaguuuuuuuguauuuuuaauagagacgggguuucaccguguuagccaggauggucuugaucuccugaccucaugauccgcccaccucggccucccaaaaugcugggauuacaggcgugagccaccgcgcccggccaggauuuaauaauagacugucagaggagauaaaggaaauagaugaucagaacauggagacgagaauuagaggaagagcaagggauuuuccacauagaauugggcugugauagcccuaaagacaggaaagaagccccuuucuuugauuugcugcuagauguucuuuucguagcaugggcucuuccuggggaggauccgugcugugcuauuuccccucuacugagcucugcucacuuugccggucaaagguguguuuucgggcucccgcuugucacuucucugagcccccugaauuacauguuguuuccaccaccugagcuuucaauaauuggagcuucuuggaucagaauucuucuuuguucuucugacuuugaauuacgacaauuaaagcaggugauuuuuaaauuuuaaaacuuaaaaaguuuagauccuuaucuauagacuaaacaaagggcuuaagaggaauaaagacgggagagacuuucugguuuauuuuaguggggguauuagcuucuuuauugcuaugggauuucucauuuccaugagcaaaaauaaaaaauacuaaaaaaaaaaaguaauacuugccuaagucccagaagggauggagaauuaacuacaguagaauaaagaagaaaggaacaugguuuauaaugugauuuauuuuuuccauuuaucuuauucuuaaucagaauugccuuccccaaauuaaguuuacccaucaaugccuaggaacuauagacguucuagaacugaaacaaaacuagaaaauaaaaacuaaggccgggcaugguggcucacgccuguaaucccagcacuuugggagguugaggcagguggaucaccugcggucuggaguucgagcccagccuggccaacauggugaaacuucaucucuacuaaauagaaaaaauuagccaggcgugguggugggcacguguaaucccagcuacucgaggggacugaggcaggagaaucgcuugaacccaggggcagaguuugcagugagcugagaucaugccauugcacuccagccugggcaacaagagcgaaacucugucucaaaaauaauaauaauaauaaauaaauaaauaauaagcuuuuagccuuuuuguagcuacaguuuuggcuaaaguucuugccagccaugaguauucaugcaugugugcguauaucuaucugucugucuuaaaguggcagguacacacuaaugaaaacuauauuuuuuaagugaucauaaauguuucuauaaauaugugguuaugguagcucuuuuauaaauuaccauugcaacuaccaaugugacauauuuuucauuuauucaacauucacucaguaaagcauucaguccuuugaauaucuaauguauuugagaauauuaaccugaucuauauuacaaaucagaguaguaauucuguuuauagaugaagaaagaaauaagucaucuaauacuccucagggggcacugggaaucguaggacuauggaccagaaauuuacuccugagaauuugaaauuugggccagaagcccaguucugcagccauuuguuguuacuuagaaaugauguaguaugccaaaaaugggagcaauuggaucucaagauagaaugaucaugauuuaacuauuuguaaauauuuuuuaguggaauaugugcuuuuuuuuuuuuuccuuuuuuuuugagauggaguuuuguuuuuguuacccaggcuggagugcaauagugcuaucuuggcucacugcaaccuccaccucccagguucaagcaauucuccugccucagccucccaaguagcugggauuacaggcacccgccaccacaccuggcuaauuuuuguauuuuuaauagagacgggauuucaccauauuggucaggcuggugucgaacuccugaccgccagggaucugccugccucggccucccaaagugcugggauuacaggcaugagccacugugccuggccgaauaugugcuuuuuaaugaccugagggauaaagguacucagggagaaagauggugauauagggagaguuaagguuacuaaggcaggggacagauaugcaguguauguacagccuccuauauauauauacacacacacauacacauauauaaauguacauguaaauauacauauacauaaauauauauaaauauauguuaaacauaaguauguuuaaauuaauauauauuauauauugaguauauauuuaaaugaagacaaucaauagucuuaaaaauguuuccugucuauuuuaaaucuuuaagcggugucaguagaguauuaaauaauugagguaguuaaaaaggacauaaaauugaggagucaauauggauaagauuauagaaaugacagggaaaaauacagaaguauuguagauuaaaugucaauauucugcugcugcuuuaauauucuggagaauuugguuacagauacugauuuguuuuaggagauuuguucuaagaauuuuccuuuguaggauacauuuggggauggcuuuguuuuggcauggcaaguagcucuaaugccacuggaauacauucaggacuuucaaauuugucucaguuuaauguuuuuucaguuguugcacaguacuuuauaacuuuuuuuuuuuuugaaugggugaaaaauggcuuugugggcugacguaggucauggaaaauugaaagccaaagcucuaagauauauaaguuuuucaucucuugguuuagaagaaagucucuuagauuugaguagaggauaucaguuuucacauuaguuuacuaauuuuuuuuuguauguguguucuuuagacugagagauuucuuugacaagcuguauaagccacagaaguuuuauauucugaugaauaagcuggccuguagugguggaagcgaugaugaagaucuuggcuagcagagcacauggucuguuuuuaccauuucuaguuuaaguaggcugcacuauaaguggcugaggauguaguuggcugcugcucacuuagucuggcacagaucacagaaucucccuuuucaaaguugagacacuugacuuugugcugaaaaugucuuuuuagcuguuuaaauuuucauucucuucccuuuacuucuugauuauuuuuucaaggucuauguacagacauggagcacucagaaucuuucuaugaccauuacacgagaugaguauccguccaacccuauggugcuccgagguauuaaucagaaggcugccuuuccacaguaccagccugucgucaugcuggagaaggguuauaccauccacuggaaugggccggcaccacggacuacauuucuauaccucgucaacuucaacaaguauguuucuguuacuguuauuucaaauaguugagcaaguaguaauuuaguggagaaaaagaauaacuuaugucuccuuugcagcaagcaaagaaagccaauuuuacauacuuugcuucucuuguggggaggcuguauauuuuguguugauggaauuaaagagauuauacaaauugaauccugucauuucaaaagcuuuuuuuuucucuguggucaaguuauuaugcacauaaagccauucaacgauagguuuuaauacugcugaaugcuuuaauucccucuagcugggaugggaaguaguuuucuaugcucuuccaguggagcauuugcuuaccugaaaaauuaaaagauuuuugaggcugaguuuagacuuggcagaagaaaguagugggauggauuaguaaugccugcuaggggcaagaagugaaagaguugggacaugaaggccagguauuugcuagcccugccugaaagcacuauuuuaucccuucuugauuucucaguugucuguucuaaucacaggcaauccaaggggcuauuuuuauaauugauuuauucaaguguuuauuguguguaaguugacauaaaggugaaugagagaaguacuugccuucuaggaguucagaguagacagguagaaaaaacucaaguagauagauaaaccaaagcuauuuuuuaguggacaaaugauagagcaacuauuaaauaauucugccuaagggaguugagccaggcugcagugaggaaugauucugaugaagcaaucugucuuguuauauuaauaaaagcacaguguugggaaagggccaguucuccugggggaaaugauggagucagugugauggggacauagagugugucaggggaaaugacagaaggugaaacaaggaaggugggaugggacuauuuagaaagggagggguaaaccacauguaucuuaucaaucuagauacauguggcuauuaacccaugcgacuccaugaaacugcugagauauguaccugaaaaauugaaauggcuuguucaccugagucgucaucaagcccugacuugucagaacacucuuaaaacauccaguugaaaugaacauagaaggacuagagcauguaggaauucagcuuuaagaaagucacuuccaaggaugaugaacaucguggcagaugcccuuguucugagauuguuagggcucuggcaugugcucugagcugaaccguuaccauuacuguuacuguuuuccuguaauccuugcugcggcccucugugccccacccacacagucaaccaagccccaaggccaguacucauuccugucucuuccuuuucccucaucacuccaucuuauccguaacugcacccuguugguuccagcuccuaaagucaucuaaaucuguccacuucuuucuacccacaguguuuguggcuaagucaagcccucaccaucucuugccuggcuccguggagcaguccccacuucagucuccccaccuccaauccuuaguccacauuguggccagagugagauuucugaaagcccaaucuaauaucaucagugaguugcagagaagucaaugaaagaaacaaacaauugucagagaggauggagaaaugucaaagggugaucaguacucuauaaguuauauugggcagaauuaugaauuggaggugagguaugacaauaaaaugauaugcaguguuuuguaaaguaccgugcauaccuuuccaucagauacugagcaaguaaagacauuuuaaagugaaaaaaaaugcugagccuagaaguuucaaaaauccacaugggcaugaaauucagucauacuuguuuaauuagcugaaaguuuauaaaaauuacacgauggucagaggcaaaaggaagagauggacaauuuuuuaccccucaauuuaagauaauuauagggaagucauagauuuugucauaaugccauuucugaaaauaacacuuuuagaaguuaugaaggcaguacuuauucauuaaacaaaauaaggaaaauauagaaaaacauaaagaaaauggaaauaaucuacaguucuccuaaccaaagcgaggcauuguaaacauauauaguacauuccccucuuucuaaccucaaguugcuuugugucuauggaugugccauaauuuuuuuaacuaccccccuuaccccaugaacauuuagguuguuucuccugcccgcccccccgcauuuugcuauuauagacaauaauucauagaacaucuuuucuaucuuuugucugcauuuucuaguuauucuuuagugggguuauuuuuuucacuugaaaaccuaggugaacaauauuuuuuuuuuuuuuuuuuuccuugagacaacaucuugcucuguugcucaggcuagaaugcaguggugcaaucuuggcucacugcaaccuccgccuccuggguuaaguugauccuccuaccuaagccucccagguaucugggacuacaggcguaugccaccacacccagcuaauuuuuguacuuuuuauacagaugugguuuugccauguugcccgggcuggucuugaacucaugcacucaaguaauccaccuaccucagccucccaaagugcuaggauuauaggcaugagccacuccgccuggcuaugugaagaauuuuaaggccuuguuacauauuauuuaaacauuuuuuagaaugacaaaaaaguuugggaaauagugaugaugauugaacaacauugagaauguacuuauugccacugaaccauauggcuaaaaauuauuaaaaugguaaauuuuauccuagguauauuuacuauaauaaaaaggucaaaaaagagagaaaaugauaaaaaguggaaauguuuuuaauuuuuaaaaaggauuaauuuuauauuuaaggacacuaagaaaauccuagggccauuuagugauaugcaucaaaagcuuuaaaaaggcauauaccuuuacauacagcaauuuucccacuaggaacucauccuaauacauuuauaaaagguaaaauuauaaacaaaaaaauuauuuagaaugcuuuugccaauguacaguuccacucuccauauauuaguguuucuaucuuguacaccuauacccaaccaucucacuuaauuuucuuaucuuuuuagagugucuaagucuguuuuauccaacuuuuuaauguucuuucaaauccucuuaaaacuaagaauuuuuagggcuggacacgguggcucacgccuguaaucccagcacucugggaggcugaggugggcggaucacuugaggucaggaguucgagaccggccuggccaacauggugaaacccugucucuacuaaaaguacaaaaauuagccgugcaugguguugugccccuguaaucccagcuacucgagaggcugaggcaggacaauugcuugaaccugggaggcggaggucacagugagcugagaucgcgccacugcacuccagccugagugaaagagcaagacuccaucucaaaaacaacaacaacaaaaaaacaaaaacaaaaaaaauuguaaaggcucauauuuuugcuguauaucuauugauaugagaaauuugagcaacagaugaaggugggugauuuguuaguaugccaugguucagaacuuccacugucaguggcccaacacacagaagaaauuuaaggaggagaaaacuaugggcaggaaguggaagaaguggcacaugaaggacaguuaucugcauacgcuauaguacuuaacagauaauggcugaaguguaaacuaauuuuuuuauguuucuccuuuaaaggaaugacuggauucgaguuggccuuugcuauccaucaaacacaaguuuucaaguuaccuuuggcuauuugcagcggcagaauggcucauuauccaaaaucgaagaauaugagccugugcauucacuggaagaacugcaaagaaagcaauccgagaggaaauucuauuuugacuccagcacgggguaauucagugaaaccagggaaugagaauuauuccuauuuuucuuuaauggugaaauugcuaguucuucagcaucgcggcuguuuagugaagcagcugauguggguaauucucugcacaucuucucuauuagagguuuagaggggaacuagaauggcucguaauuauaguuggcaguagggaucgagugaagauguuugcuguauacguauugaggcaauuuagagaaagaaauuaucccuugucgaugaagaaucaguaggcccaguuggaaauuacaauaauuuuuucccauaauaauguucuucauaugauuauuuacaugugauauaguucauauuucagugaaagcucauuuuucucuuccugacuuaggcuaucuuacaaguugaccuugaguuuuugaaaaucacuguguaacuguggaauauuugcuuucaacuuucucuaggcugcaucuuuccacuuuuuaauuccaauccuguucuucugggguccuguugguuuugacugcuuuuacccaguuacagucucucagccugugggcuaugguaggcuccaucuccuguacucuuccagcagguagcguguuccuucagccuuucuccucacgcagacauuccuccuauaugccauugucuaugcacuauaaagauaccaauggaaagaagaugcauuucuucugcaaacucaccguccauugaggaaugugggcauguaaaucaagucauuagagaaggaaagguugaaugcucucgguucuauauucaauguggcuuuuggauugccucagaaguucagccuagaguaaccagugacauccugagagggugauccuggagcuaauucuugagaaacacuuaggaggagauggaaaaagaagugggugagaugucuuacacagaagagacagugugcacaaaugcaugggggcaugguagaacauggcauugcguguuuggggaaaggcaagaaguucagaguggggagaaggguggcgagauugacuuggggaaugaagucggggcucaguuguuaagugccugguuagccuuuaaauaagaugcaacucauuugcccucccagucccccaccagccaguguuaucagcuuaaaaguuuuauugucauaauugucuccaauuuuuaauuuuucuuucuuuuucuuucuuucuuucuuuuuuuuuuuuuaagagacgguguaucccuauguugcccaggcuggagugcaguucacaggcauaguugugguacacuacagccuugaucuccugggcucaagugauccucccaccucagccucacaaguagcugcugccaccacacccagcauugauuuucaauuuuuguuuagacuuaaacaacuaccuggacuuucauucuguagaugauagaacuuccagauucccacuugauuuuccacaagaauaaaaagaauauccacauuuggaaggauagucuggugacaaguuaaugauuaaaaguguaaaaagauggaaaauacuuucugaucuggguauuucaagaauccugagguccuaauucuuuuuauuagauuggugcaaaaguaauugcgaauugcggguuuugccuuuuuuuuuuuuuuuuuaaugcucucaguccuagagauacucagugugccauuugagcugauuuauaccucauaaucucaacuuuguacuguuuauugaccucauuaaaaugugaauucuucauuucuaguaaucaaucacacuugaucaaguuuuuuuagaaucuugacuuccuuugguuuggaaggacuggguuugcugauagagauugaacugcuaccuggaaguuagacuuuuucauucaucuuggcagugggaagauaauucagaaugggugggauggacuguucauuuugccugguuuuggcccuaauauagaccgaaggaacccagguccaucugcucuucauaaauaucacaggaauugauuugagacuuuaucuuggccuuagccaaagaagucacaguuccuguuuuuauuauuucaguuuuaugccuuaaccaaaaugauuuaugaaugagaacaacaaaaagaaugaaccacacuaauuuaccaaauccuaaacucaacacauuauguauaaaguguuccaaggaauuuuugagccaaaccaaauuucauccccccaaauuaccuaucgaacuaauucaaaccagaaaucagcuuugauauguuccacaacaauggaagcaggguaugacauauuuccuaaaguguuacugcauuugacuuaggacccuugaaggauagaaagaaaacagaaauaacuauucauuuuguaauuuauguuuuaaggaaaaguuacuaauuggaggaauaucccuuuuggccaugagcugauuugaggaauuuuguaaguuuuugagaauaagucuaacuacauggauugguuucuguuuugugcagguuacuguuuuuguaucucaaagccaaaagccacaggcauggccacaguuacuguucaucucagggaugugaaagagucaagauccaagcagccacagacucaaaggacaucaguaacugcauggccaaagcauacccacaguacuacagaaagccgucaguggucaagcggaugccggccaugcucacuggacucugucaaggcuguggcacucggcagguaaacaaggaugaaaaguggucuguggccaaggagaaaaagucagaggguuucuuugcaauaggagcacuuuucuuugaaacaucuauauugcccauuuauggacauugcauggcaucuccugaauuuuggcccaugcuaaaaugugaagcgcguaagaagcaaacuaguucaaauuuaugacagagauacuugccccugugauacgucaguuuaccuugaacaacugcagauuuuccacaguuuaaaauuagagguugcuauguugguccucauuuuuuuucuuucucagauguuugauucuguugcaauaugacuguuggauuuacaugccagugauguaaaaaagauacuuuguuuuguuggcacagugugaaauuucuuuucaaaaauacagcuaauaugaaaauuguuuccuuuuuauaagguggaaauccgcucuuauuuuugaagcauaugcuauuauaucuaucuguaauuaaaguacagacuaucacaucacuuuaucauuuuuauuuaaaaaaaaaguaccgacugacuuugguucgaaaugcaaaugcuucuucuaacauucuugauuagauggccgccuacuggaucucaagaaagcacugcaaugaaagugaacccaaaauaugaacuaaaauugggcauacagaaggaguuccaaaggaaaucagauaauuccaagugaaaaaacaaaggauggagcugcccugauuuauauuucacacaaacaaauaugggcuaagggaaaugguucucaaagugugacccccagaccagcagcaucaggauccccuggaaacuuguggaaaaugggaauucuugggcccaacccucauccuacugagucagcaacuguggggcugcggccuggcaaucuauuuuaaccagcccugcagcugauucugauacauguucacauuugaguuccacugauaauuuuuuuuaaaaagcaauaauuaccacaaauaugcauacugccuauuaauauggagaaaacuaaaucuuucuuuucauuucuuccuauucuaagugauuuaagaaaacaaaauuacuuccacuaguaaguuccauauuucucucucuuuuuuuuuucauuauuuauauccauucauggcaguaagaccaggaagaaagagguggauuuauguuucccacuagaauguauaagucuuuuuuuguuuuguuuugcuuuuuguuguuguuguugagauggagucucucucuguugcccaggcuggagugcaguggcaugaucucgacucacugcaacuuugccucccggguucaagggauucuccucccucagccuccugagaagcugggacuacaggugcaugugaccacaccuggcuaauuuuuguauuuuuacuagagaugggguuuugccauaucgcccaggccagucucuaacuccugaccucaagugaucuguccgucucagcuucccaaaguacugggauuacagguguaagccucugcacuggccaauuuuuuuuuuuuuuaauggcaacucuacuaucagucuuagucucucauauuucugagccaccucuacucucucauacaaguaaaaucaaaaaucaaccaaccagagaaaccaacaacaacaaaaacaacccuguauaugaaaguuauaugauuccuugccaggcugauauaauaaucugacuguuaaagugacauuuugagguagucuuuguggggaaguaaauuuuccagccuaauucucaagcuggauuuguuaagacccuucaauacugaagagacuuuguauaaucuauaauaaacauuauaacuuauaaaaauaauuuaauuaacauuggaaauauucuaggccuauguuguuaaaugauuccaugcacucauacuuagcauucuuuaucuuuugugcaugaagcauugaucagaauucauuuuuuuaaaauguauugauuacugacuuugugcaguugcaaaguaguugaagucgcugggaacaucgcuuuuacuugaaaauuuguggguaauuuuuuuuuucuuaaauauagaggcggggucucacuauguugccuaggcuggucucaaaguccugggcucaagcgauccucccacuuuggccucccaaauuguugggauuacagaugugaaccaccaugcccggccuaauuuuuguucugacugucaaaaccaaacacauuuauauuaggaguaaauaggaaaauucacaggaauuuuugaccccaaacuuggagacuucaaagaacuacccagcuuccgacuugggaucauuuugacuguuuauuuuuuguuuuuuguuuuuuuugagauggagucucacucugucgcccaggcuagagagcagugguacgaucucagcucacugcaaccuucaucgcccaggcucaagcaauucuccugccucagccucccaaguagcuggaacuacagauguguaccaccugccuggcugauuuuuguauuuuuaauagaggcuggaguucgccauguugaccaggcuggucuugaacuccggaccuaaggugauccacccaucucagccccccaaagcgcugggauuacaggcaugaacuaccaugcccggcugauuguuuauucuugcagggaaguuuuuaacauugguuuauauggacaguguaccucuaaguguuaaauugugugagaguuaaguguuuuugaaugagaagagagcccuuagggaggagacagguuuuggagacugggaguaauuuggaggaguacagggaaaagggaagggcauuccugggaagggaacagcaucagcaaaggcagaguggcaaggaagaggguggagugcuugugggaaagugaggcccugccugaguguaacagcacagggaaaaauaggggccugucuauaaggcacaacucuguuuauggaaugccuugcaggucacaaagaggaguugagaccugcucauguucaaaguuaguaaacguuucuuaacaggguaguccuuguuaucuacacuucuuuccucauuccuagagugacugagggaccauggucugaaaaaaacuuuaaaaaauauuugugccuguuuuuccauaaaauguuuacaaagauuuaaauauaaauauaaagcacauuuauuuaaucaguuauggaacugaagugaacaacaagaauaauauuuauuugaaacugggauugcuccagaaaaugaggaacaaauauauacuuacuguguuaagaauaucaagauggaauucuaggucaugaaauauguacaaaaaguucagaauaagaaauacaaccacuggcuuuaauuauaauuaacuuuauauugagggaaccuuuuggaggaagguaagaguugccauaaauauggaacuucuucucugucuaggugguguuuacuagugauccucauaaaaguuaccucccugugcaauuccagucaccugauaaagcagaaacccagcguggagacccgucuguuauuucuguaaguaccaucugguguugucuuagucuguucuaggugguauaacaaaaugccauaaacuagguagcuuauaaacaacagaaauuggcugggugcgguggcucacaccugugaucccagcacuuugggaggccaaggugggcagaucauaagguuagaucgagaccauccuggcuaacauggugaaacgcugucucuacuaaaaauacaaaaaauuagcugggcguagaggcgggugggugccuguagucccagcuacucgggaggcugaggcaggagaauggccugaacccgggaggcggagacugcagugagcugagaucgcgccacugcacuccagccugugcaacagagugagacucugucuccaaaauaaauaaauaaauaaauaaauaaauaaauaaauaaaaauaaacaacagaaauuuauuucucacaguucuggaggcuggaaaguccaagggcaaggcaccagcaaauugagugucuggugagccugguucauagauggugccuucuuacugcguccucacaggguagaacgguccaggggucucucucagccuucuuuuauaacagcacugaucccauucauggggguuacacuguuguguccugaucacuucccaaagauucuaccugcuaauacuguuaccuuggagauuaggauuucaacauagaaauauuuggcaggacacagacauucagaccaaagcagauguguacaccgucacagcuucuugcuuuuaucuucuaucuuggugacaugaauuacuucuggcuauagucacugguuugucaucacauuuucuauuguugguagcaagcaauacaauagagguauaaauaacuccuaaacauuuguguuuuuaaauacauuuaagaaauguuuuuuuccugaguagauuguguuuauucauuaaccuuauucuuugaaacuuaaaauaagcuucaagauuguuuaagauaugggaaaugaaaguuuuaacaucucuucggccuuuuauuuuaagguugccucuucucuauuuuuucaguugaggaaaaugaagaugcaaaguguuaguugucuuuucuaaguggcuugauggaaguauagacaugaguugcagugucaacacuagcauuugcgcauagagcaagguuagccacugagaaccaggucucagcauguggccuguccaaaaucagguugaccuaggugccaccauacaaagaacucuuugggugacagguauccagccuuucagguaauacucagccaaggccugugccaucucauguggucuuuuuaggggcuugguuuuuuuaguggugggcaacauaaucacaaauccacauauauguggagaaaauuaaauuuuacuuuuuuucuuaauuuuuuuauugucauaaaguacacauaaacuuuacuaucuuaaccauucucaagugggcaguucaguggcaugaaguccauucauauuguuguacaaccaucacuaccauccagcuccggaacuuaaguucuacuucccaacucugaauuaagacuaucccuauguaacuguagcucaaagacucuugguuuuuguuguuguuguugucguuuguuuguuuguuuguuuuugagacagggucucccucuucacccaggccagagugcaguggcgcaaucucggcucaccgcacccuccaccucccaggcuaaauugauccucccacguagcugggacuaaaggcacaugcuuuagucccacuugguuaaguuuuaaaauauuuuuuauagagauggagucccacuguguugcucaggcuagucuugaacuccugggcucaagugaucuuccugccuuggccuuccaaagugcugggauuacaggugugagccaccacaccagguuaaaguuucuucaagucuguguuuaugcuuguuccccuccuuuagcaguccugcauuuuguaauacacccgugauguaauuuuauuggcaugaaauuugcuagcucagcaucugaaugcagucagcugcaugaggaaccugaucccagccuguuagcaugguaacuggugggaguugcaugagggaagcaggugggugcugagucucacuguucuaguaguuuacuagguaauagagagagagagagagagagagagagagaugggggguagagagagagagagagagagauggggagagcguuuugccaaaaaaaaaaaaaaaaaaaaauaucaggcaggcuaugccccagagucugaaaacauuguuugacucuguuguuacacacugggugccugggacucuagaaaagucauauuuauccccaaugcuuuuuacauucauuaucugaaaacucuucccuaagaucugggauugcauuagggguuuuugguuguuuuuuuuuuucuuuuuuuuuuuaagauagagucucgcucugucauccaagcugaagugcaguggcuugaucuuggcucacugcaaccucugccuucuggguucaagagauucuccagccucagccucccgaguaacugggauuacaggugcuaggcaccaugcccagcuaauuuuuuuauuuuuaguagagaugggguuucaccauguuggccagggggcuggucuugaacuccugaccucaggugauccacccuccucagccucccagaguguugggauuacaggcaugagccacugcacccagcugcuuuggggcuuuuuuuuuaagacagugucuugcuauguugcccagguugaccuugaacuccuagacucaggugacccuucuaccucagccucccaaguagcugagaucacaagcaugggccacaguaccuugcuuugcuuuaguuuucauggaaaguauuguggguuuuuuaagcaacaggcuuuggggauacuuuucaugggggcagucugaauauguugaggacuguuggguauuuuuuuucuuaaguguaccucaauuuuaaguagugagauuuaaaaacauaaggaaaucauaucuagucuuuccacauauaaaauuuacuucaaaugcuuccagaacuauuuucacuggauuggugcaauuagcuaaagggcuuuuuuauuuauuuauuuuuuuuuuccugagacagagucucacucugucacccaggcuggaaugcaguggcaccaucuccgcucacugcagccuccaccuccuggguucaaaugauucuccugccucacucccaaguagcugggaucacaggcaugcaccaccacgcccgguguaucucuaaguagagauggaguuucaccuuguuggucaggaugaacuccuaaccucaggugauucacccaccucaaccucccaaagugcugggauuggauuacaggcguaagccaccacaccuggccuuaaagugccauuuugaauaccagugagaucaaaagugauuagaaguaaaauuuaaauauuauaauuuccccaggcauggacagguguagugguaagaacauuucuccuuuguuagccuuuagcauacuuuauaauuuuacaccuuauaaacaggaacagugccuauggguuuaauuagugcuuaguuguuuuguuuugcuccuucauuuuuggcugagaaauuaaugauauuuggaaauaucuggaguuccuuuuucuugaaaaggucacaaaccacugauuuaaagaggaugacuuugaaaauuuagcucacaauaguugugaaauaaauguaguaguacuuuguagcuuaaauuccgguaaaauuaucacuuugucauuuugaucucagaggagagcuauuauuuguagcaaacuacaaauauaaacuaacguggaauuccuguggaucaaggcaugauacauauuuauauguguguguguguauucuuuucugaaccaauaugacaauaagccaucuacucugaaguacagaggcagccaucuaucauugacuuauaaagcuuugaccccagugagaguguguguaagaaggaauaccuugaacacuucagagugaagucacccagcuuagcugagugggggccaccaugccuugcucaaagcagguucuccagucagcaaacaucagucaaggcagaaucuauaggcagugccuaggaacacagacgcaauuucagauggugaggaaaaagcaagugaagcacacaauuugaaucuuggaaauauacuuugaaucauggguuuagaagacacagggaaagggccggaaaaaugagucauccugcagauguucucaaaaugaugaugacagcagaagauguuuuugcauucucaggucaauggcacugacuuuaccuuccgaagugcaggcguccuccuccuuguuguggauccgugcagcguuccauuccgcuugacggaaaaaacgguuuuuccucuugcugaugucagucgcauugaagaguauuuaaaaacaggcaucccuccaagguaggucaagcuugugcuguaacagggaaaagccaccuuaaagauguggagugcuccaaacugauaaugccuggucaaguccgauuuuuuacucucuggacauucagggcacuaugcaagguguucauuccucuccuaccucagauugacgcccaugucgucuaagcugcuuaucauugacaagccauugcuuaccuguggcagaacuuggauguugcaacauuuugcaaaauggugggaaggcucuucagaggaaaagagcucauuauuuggaacauuacuaucccacuuuuuauuuuauuuauuuuuugaguuucguaaaacaaauaucagagcauuauacuuuuuaguauuaaguugauauacuuuguccacaacucccucagaaggcuuauuacuauuuugaagugauuuuccaggcaguuuaccuuugcaacccucugucgcacugacggucuuggacagcauugcacuaugauugugauacaggaagucaucaccugggucacuuggaaaugacuggaaaagaguaaauugauuuuugaaguggcugagugugcaaucgcucuuacagagcacuagucugauugguuuucuuugaugucucugaagaaagcugcacaggagagaaaccuuucuuuuucuggguuggugagacccugccuggaggcaaggagaugaacucaggguguuuucugccuuugccgcagauguugauuuauacacccgcuuucauuuaauggaaccauuaaggaaggaacuuaagcuuuccccaaauuaaaggccuaucuagcuuuagaaucauuuuccaauagcuuaugcuuuauagaaccggaugccaauaaauucuaugaagucacuggauuauuuggauguaacauuaaauguauauaugucguucugucuucuggcuuaagacacuuguacagccucaauuuucuugcaggauuuaaagauuuuuccuaauguugaaaauacaugcacucacuuccccuaaaacaauccaggacauaaaucucaccacaaguauuuaggacaacaugguaguccugcaagguaccccauagauuuaagagguaaaaccaacucauuaacagaaaggcuuuuaagauacugguaaugcuguuucuugaucugccucugguuaugcagauagguuucguuugcaaaaauucaguguguguguaacauuuuaacaaaguguuaagaagguauggagcaacuggcagugacuucuagggagacugagcacgugucuauguguauaggguugcggggugaccuguaaaugaucuuauggguaauucugaccuauugaagaaggucaggucugcaggguagccgugcuuagacugcugcacuaauuuuagauugugucaccacugcuuuagaaagacuacaguaggccaggcacgguggcucacaccuguaauccuagcacuuugggagucugaggcaggaggaucaccugaggucaggaguucgagaccagccuggccaacauggugaaaccucaucucuacuaaaaauacaaaaaacuagccggcauguugguggcaccuauaaucccagcuacucgggaggcugaggcaggagaacugcuugaaccuaggaggcaguuugcagugagccaagauuguaccacugaacuccagccugagcaacagagcgcgacucugucucuaaaaaaaaaagaaagaaagaaagacuaccauaaagaacccauaccagcaugaaacuuaagguacuuaaucuuaagaaccaucgagacccacauuaagacauaccacacaaauuucaacuuccuguagguauccuugaugacucugaaaauaaaucaaucuaauguuaccuuuuaauuaauaagagcuacucagagcccccuaaacacugauuuguucuugaaaauuuuuguuucaguaauaccggccaagaguucaggcacaguggcucaugccuauaaucccagcacuuugggaggccauggcgggacgauugcuugaggccgggaguucaagacuagccugggcaauguaaugagacccugucucuaugaaaaauuuaaaaauuaucuggguaugugggcacauaccuguagucucaccuacugaggaggcuaggacaggaagaucccuugagcccaagaguuugaggcugcaguaaacuauacuugcaucacugcauuccagcuggggugacagagcaaggacccuaucucuaaaaaaacaaaagaaaacaaaaauaguugcccaggcuggagugcagugauguguccacagcucaauguagucuugaccucucaggcucaagugacccuccuacuucagccuuccaaguagcugggacuacacgugcacaccaccagccuggcugguuauuuuuuguuuuuguuuuuguuuuuaauuuuauuauuuuucuaauuuuuuguggagauggaguuuugcuguguuucccaggcuggucuugaacuccugggcucaaaugauccucucaucucagccuuccaaagugcugaaauuaaaggcaugagccacugcacccggcuggccaagaacauuucugauuaaaguuuuugaaagagugaguuuguauguguacacacacacacacacacacacacacacacacagaaaauaaauacauuauuaaauauauugcuaaaggauaugcaacagaaguugaauaaaaggagagacucuguuucugaauggaaaauuaauaaauguuaauuucauggaccaguuucauggaagauaauuuuuccauggacuggagguggagggggaugguuucaggaugauucaagugcauuacauuuacuuaguuaaaauauaaauuugacacauuuccauuagugucccaaaagguacuuuucuacuguacuugacaguugauacuguaguucaucuggaagaauaaaugagaaaguaguaaaauauaaacaaauuacaguaauacaagggcuuguuuuuaucaaauauuaaaauggaccgugaagccauaggccagcauaguuuuggcagagaagagcaagaucagagaagaacggagaauccacagauagguccaaguauguauguuggcuuacuaugugacaaaaaugguaauucaaaccauggaaaacacauuuagucguuuauuuauuuuuagaauuguguuuauccauuuauuuaauaaauagauaauagaacuuaaauaaauagaguauuugaaacaaaacaaaaccauucucccauguuacaguagacuuacucccugauagacaauggagaaggaagggugagggguggaugacaggaaauuacugaauaggcacaguguacauuauuugggugauggauacccuaagugcccugacuucaccacuaugcaauccuauguauguaaugaaauugcacuugugccucacaaauuuauacaaauuauaaacaacaacaacaacaauagacuauucccuaaaagagcugugccccagaccauccacuaggucagcaguccccagccuuuuugacaucagggacugguuucauggaagauaauuuuuccauggacuggaggugaagggggaugguuucaggaugauugaagcacauuacauuuacugugcacuuuuuuucuauuauuauuacauugcaauauauaaugaaauaauuacacagcucaccauaauguaaagucagugggagcccugagcuuguuuuccugcaacuagauggucccaucugggggugaugaucaacagaucauugggcauuagauucucaggagcacacaaccuagaucccucacaugugcaguucccaauaggguucugcuccuaugagaguugaaugccacagcugaccugacaggaggcggagcucaggcuguaaugcaaguguugugggguggcuguaaauacagaugaagcuucgcucgccugcucaccuccugcugugcaacuugguuccuaaucuacugguacccauccauggcccagggguugggaagcccugcacuaggugaacguacguaaaugauuugguuuauguaugcguuaccccuuguaagagcaacgugugaagcccaugguggugggguggaagagugggaauuggauggaaaaucaucuagacuuuuuucuuuuuggaguucugcuuuuaucuaauauuucuauucagcagucaguucagaaagauacucaguagaaagauacucaugcugaaggauugaaauuggcucugacuuucuaaauuucacauacagguccauuguucuguugagcacaagaggagaaauaaagcaguuaaacauuucacacuuacuaguaccucugggauuagccaaaccagcucaucuuuaugacaaagguuuguauuuguauuauuucaugaaguucuuacagggccagcaacauagguaauuuuauggugcaauucagcuaccagaccauuuucaugagcuuguuugcuggaguggguaucauuaagaugauuucuaaauaagggcacaaugugagaggaaguguguugggaugugguuuguuaucuggggcaaaagguggguggugagaguucauuugcugauguaaggaagugcagaguuuuuuaauagcugccuuuguuuugcucaccuccgacucaccuccuauauucucuugcuggaauguagcuauaaaaauugauuuuuuuucuuuuucuuuuuuuuuuuuuuuuuuagggaguaccauauuuuugggauucaguggaaacuuuaaaccaucauggacuaagcuauuuaccaguccugcuggacagggccuuggggugcuugaacaauucauaccuuugcagcuggacgaauaugguugucccagagccaccacuguccgcagaagagaccuggaacugcuaaagcaagcuucaaaagcacauuagagacuaacuguaacuuaagugcugggggaaaaaaaaugugaacuaacuuauuuaauuuauggcauuuuaaaaugacacuguuaacccaacggaaccauuuuccaguuugauacagaauggggagaaaagaaagcguuugaaauuauugcuuggauaccagcuucaugcaccuucuaguuguacaaaauguuaaagacguuguuuguauuuguaaggcugguguauucagagagcagaucucuuauuccucacuuuccacccccguauuuuguaaugaccaugagcaauguuuuuacuuuuuguauaauggggugggguggagugggggcuucugagagucagccugaggucuuuagaggaccagcuauuguagcaccuuggauacuugaaguuuaaugcucaguugggucggguggcaguugacuugguggcuggcauguucagcagugccuggggcccuguuucugggcagccuuugaggauuuucuaugauauugaaugacaguuuuaaguggcaacucaggcccagcucaugcccuuuuuugccuggacaugugcuauuuuuauucacuuauauaucaauuacuuguaaggguuaaacuuucaaacaggaaguauauugggacaaaagggcucuuggggauuagauaucccuuuaaucugugaccauugggcaaaaaauuuuccugcagcaaaagucugaggcuguugggaccauuuuugcagcuuuaauccuuagccucuuuugacuguauauuuguguuuaaaaugcagagcucaacugaauauuuccuuuuuuguuuuguuuuguuuuguuuuaagaaguagguuguuuuccugaaccguaaacuuguaucauuuuaacuugcacaaaggaagucuguucuugguauugcucuugcacuuggguuuuuuguuauuguuuuguguggauuuuuuaaagcuuuucuguucacccuccugccaggaaaaucccagaaagcuuaaugauaccccaaaaugauuacacccagggaggaaaaaaaggagcgcuuucuagggucagaaucguggagagaauacucagaaaugaaccucuuuaaagccuugcaggaaugagucacucuuacuuaaugaaauguuaaagccaauuaaaaagcaugcugugaugcccagcuucccuuuccacagggugcaugcgucuccugcuggugaaucacaugcggcaagaggcaacuggcuccacagccugggaugcugccguaccaagaggaaagaagcagcaaaaugccuuuacguuguucuaaacccccgacgcauaaaguguagaggagggauggccaagggugggugguagaaaguguguucaggcugacacuggcaaugaguacagauaauuucacuuuccucuucuaggggcaaaggcugauggccucuaccuuuguauccaggagaaacugcagagcagcccugugacuuuacaaaauaugcuaccucaaagugcuaccgauaaaccuuucuaauuguaagugcccuuacuaagggcacaugucuuaaucaaaguuaguuuuuuguuuucugguuuguuuuuuuuuuuuguauauugaugaaugagaucuuaccuauuaaauauauuauuggauuaugguuccugaaggucauuagaguguguguguguguguguguguguguguguguuuuaugacuuaaauaucuuuacguguguuuuuuagagcuugguucuuuaaagauuuggagaagauauguaaauuaccaaggcacuugguuuuucuguuuuauauacuaauaaucagggccuaaguuaaauaaaaauaugugugcauguauuuuauauauguguguaugugaauuuauuuauuauuuauuuuauuauuauuguuauuauuuuugagauggagucucgcucugucacccaggcuggagugaggugaugcagucucagcucgcugcaaccuccaccucccagguucaagugauucuccugccucagccucccaaguagcugggauuacaggcacccgccaccaugcacugcuaauuuuuguauuuuuaguagaagugggguuucaccguguuggccaggcuggucuugaacuccugaccucaagugauacuccugcuuuggccucccaaagugcuagcauuacaggcaugagccaccgcgccuggccuguaugugaauuuauaucucuaucuauaaauuuaaaauuccagauuccagcuguaaagaaguuacugacggaagugaggaagacacuugguggacagaauccaccaaguaaauauuguaagaguaagcuucagaagggcagggacuguauucuccaaggcagagguucuccaucuuggcugcacacuggaauuaccugaggagcuuuaaaaaaaaauauagaggccuggacuuuacucccuuccccccagauucagauuuaauugguguugggugcagccugagcacuggaauuuuuuuuaaagcucccuggaugauucuaauaugcagccagguuucggaaccacggcacuaauauaauaggcccacuguuuaacuccagucuguaauuuuuuugugacuaaaacaaa

SEQ ID NO: 18781 - RNA, 2420 nt, Homo sapiens
aacuuaucauagauuuuuuauuucauugagauauaauuuacauguagggaaaugcacagaucuuacauguacaguuuauaauuuuuaacaaauauaugugacugcauagucucccuucccacaacucuucugcuuucucuccccacaaaugaguuuugucuggagaacagguaauaguuuuuaaguggggaaaagaagaauacaaauaacgaugaaguuuaacauuugcccauuaaacaccauaagguuuugggaaauuccccccaaccccagcaugucauuaauugaguagaaaacucaggcugacuugagugccauagcugacaacuaugaacuguaacucagaacugcucuaaccuuaaagcaaucacaauggaccugcaguugagucauugcaggggaugcugagauagcaggagcccucacuuugugaugucuuucuuuuucacuguggucaggucucucugaaugucuuuuuuggaaagccuggucccugguuugaagauugugagauggauggugauaagaacuccauauuccaugacauugauggcucugugacaggauacaaggaugcuuaugugggaagaauggacaacuaccugauccgccauccaagcuguguaaaugugucuaaguggaaugcagugaucugcagugggaccuaugcacagguaggcuuagcaaauguauaaugcucaaguuccuaccagcuccugccagcacugcuucugugagaaguacucuucagcuuuucagugugauugacauuuuccaaaguaugaucuaucuuccuguccuguccuguccuuucuuuucuuucuuucgauucauuaggagucauggacuccuggaauuuuucuuaaaacuccccaacuccagaucuguuuaagaggugaaagagugagucccagagaggagagcugauuuacccuggguuaaaugugguuggaacguaguugggacaagaacccauguuucuugacucuuagguuuucuugccacacuacagcuaugcccucuaagagggauuuuuauccuuugcuuuuggggucaguaaucucuacuuaaugaaagaaucugacuuuugaggcaaaauaucaauaggucacaugaaaagugagauguucccggggacagagcuggagauuaggagugaguggacaagaaaggaauccaaggaaaauuuccuaauucuauuaugauauaaugucuaugaaaauauggaggagaugauauacauugagaaacaccucuuugaagacauuaagcauuaauguguauuaacuugaugccuaguauaagaggaugaacuaauuugcaacguaguauauaugguuaagagcacagauucuagagcuagacugccuggguuugaauucuggcuuuguuauuuucuaaaguaugcauuggaaaaguuaauuaacuucucuaugucgguacacaauggggauaauaguaguuacucucauaggaggcuguugugaagauagaguacaugcacauauguaaagcauuuagcauauggccuggcacauaguucagugcccgcugcucuuaguauuauuuaaggagaagagcuguaaguugcaaaggugauuuuaauagugacauuuugguggauggaagagauugcagaauggagguaccagcugcccaggauuuugaaaggagcagauccugcccccacccucugccccaugcagacaauuaaaggguaggaauuuuuauuuauuuauuuauuuuugagacggagucuugcucugucgcccaggcuggagugcaguggcgcaaucuuggcucacugcaagcuccgccuccuggguucacgccauucuccugccucagccuccugagcagcuggacuacaggcgcccgccaccaugcccggcuaguuuuuuuguauuuuuaauagagacgggguuucaccguguuagccaggauggucuugaucuccugaccucaugauccgcccaccucggccucccaaaaugcugggauuacaggcgugagccaccgcgcccggccaggauuuaauaauagacugucagaggagauaaaggaaauagaugaucagaacauggagacgagaauuagaggaagagcaagggauuuuccacauagaauugggcugugauagcccuaaagacaggaaagaagccccuuucuuugauuugcugcuagauguucuuuucguagcaugggcucuuccuggggaggauccgugcugugcuauuuccccucuacugagcucugcucacuuugccggucaaagguguguuuucgggcucccgcuugucacuucucugagcccccugaauuacauguuguuuccaccaccugagcuuucaauaauuggagcuucuuggaucagaauucuucuuuguucuucugacuuugaauuacgacaauuaaagcag

SEQ ID NO: 18782 - RNA, 1286 nt, Homo sapiens
cccuuuuuuuuuucagaaacacacuacaauaguuaauuuuauuuguucaagaacucauacugcaagcauuaaaccaagcauagucuuugauucugugagcccaaauucacguugaagaagaucaaagcaaacugggauccaguaaauggaugaaaacuaaaggcucagaguuaaucacauuguaguuuuuaaauuucuacagccuagagcucaguagucacaggucuuuuagguccuucuggaugucccacgggguaucuguacuuuucuugaacugagcaaccucaucauccuuuagcuucugguugauaacgcugguuaauccccgggcauugaggauauauggaaggcucaggaagacuucauucucgaugccauacauccccuuuaccauuguugacacgagaugaauccuggauagauuuuucaacauggauucaaugagaucagccacacuuaauccaauaucccaguggguauauccauuuagcuuguugacuucauaggcauuuucaaccaccaucuuaugcacuucuuuccaauuuucacuaucauugucaguuccuauuucuggauucaauuccuggagagaaaaaccugucacauucaugccaauccacacagccacacuugagucacuauguucccccaaaauccuuccauggcagcugcugggaugaaugccaaauuuuucauccauaaggcagugaaaucuagcagaauccggauuacauccacuuccaaucacaugguguuugaguaauccacuuauuuuccagguaacauacguaagaauguccccuagguuggaaaccacaauuaugugcaaucagaagugugcuugacaauuugaggaauaaugaauuugaagacauuaacauuuuuucugcaccaaauugagacgccucucccccucuugcugaaggacuccugaaguuaccacuacaaucuuauaacuggcagucacagaauaaucuuuaucugccacaauuuuaagcuucuugagaaauaagcucccaugcugcagauccaucauuucuccuuuaagcuuaucuuccaaaacauccacaaaagcaaauucaucagccagagauuuucccagaaugcugauagcacacgccauaccaacuuguccaacacucacuacagugaucuuauuguuuuggacuguugccucuucuuccgcaacugguacaaugaguuuuuccuuaagaguugcuauuuugcacaggagagagaaggcucuggaaagugcuguaacagcguguggaggagacaaugucagc

SEQ ID NO: 18783 - RNA, 4117 nt, Homo sapiens
gucauguuuuaaacuacugaguuuuuuuuuuuauugcaaaacauuuguuacagaaauuucagaaaguuuuucccgugguaucugccaacuucugcucugaauuguauaucuaaacaaucaaacucaaagugcauugugaauccaauaauagaccuuuaaaaaagaacaauucuucuaaggauuuauauauauuuauagugucgauagauaugcauaccgugguccauccauacacaaagaaggaaaagauguauauauauucagcaaacccaauuuuaaaaccauuguauuuguaggaauucauuuaaaaaugauaucugaauaauuucccccauuauaaacuaggguuagaacguuuacaaaugagagucuagguccuauauuaugaaauggcuaugaguacaguauacugcacguacuguuuuuacacagcgguagcagcaauauaaacucaggucagacgcaguagugacaggaagcagguaagucuucauaccaugcuaugguacucuucuucugaaucucucucacaaagacucuguguucaaguuuagaauuauguggcuaacaaauauacaugcauauaucauucagaacaagaguaacucugaauaaggcgaguuucuuuuccccccucucgguucucaguguauuuuguguguacacucaccaagucacuaucaagaaucugauccuguuggcucuaaaucagaggucccaaacuauugccuuugggacugaaugcugcuggcagacauguuuguuuggcuaggacaguguuuggaaagcugaauuugaagguguuuguggugggauguguauucugucaugccuuacuuacaaacccuacuucuguugacuuucaccaguccaguucacacauuuguguuuucuggauccggccccuccauguguuugaauuugcagccucucagucuaugugcagauggcugguuuuaaugaugugugggaagcugcggugaagauguguaggacucuugagauuuagagaggcaaaaauuggacgaggucaaugugaacaccagccgggguagaggcaggaggaggcuaaguuggugggaagaucaggccugggacaaagucuaaauguuugccuuuuuccaagcggccgcuguuucagcuuacugugcgagggucaacaagguauaaagguaaugugggcaagggucuguuggucuggugaaaaagcagcuagucuuagacuaagagaagagaagcaagaagaggggagaaagaaagccgcacauccaggcacaaggcugaauuucccccuuugccccauaggccucagccaccugucuccuccagaggaaggcauggguccugauuggcacugacacucuuuacaaagccuauggacuucuagccauacacaugucuuuucaguuuccagcacacaaacauugugcaaacgcacaagggccugcagguuuaaggaggcugguagacuagguaagguaaggaagggaaaauucaccucauucuuauugccaucuggauuaccuggucaccaaaauccucucuuagaugaccuguagaaacagucacguugcuuucauuagcagugaugagugcaaggaaaucaucagagaaaagguaacacaacuaccuucugagaggaauuaaaagaaaaaaauugcuuuuccuuaauuggaaccagccuuucuuuugguugacuccaaucugagagacagaauauccaacuuguaaaaagaagagaaagcuuaggucaaugcaggcugagaggaaaguuuugucuacucauuuuaggagcagucauuuucaaaacugugcaaauuggcuccucucuuuaacagauguugaauggcuucuaguaaugaugauuuucuaaaagaguaaacucuuuagaaccacccagugcuucaucagacacccaaacacacgccucccacccccaaggugaagaagccacaagacaaggagggaggucucuugucauaucauuggaucacacauucacagcgaucugcgcacuucugcacuaucacaaauggacuuuucgcucucaucuccggcuuagcaauuugcacccaguagcucugaagaaucagaaaugugucuugcauauaucacagaugcacaacaccuagaccuuggcagacccaagagguguuggcuugccaccucugggucccauggcuauacaaccugcaguuaauacuuuauuucauauuauuuguucagugcuuaaaaaaaagauuuaaaaaucccuugguuacuuuuuuuuuguuuuuaauuuuucaaaacugaacauaauccccauaguaagaagcccaacuguuugagugaauucuuaacuggcuuaagcgucacagcaggcaauaguaaaauguuaagugccuuagaaaagucaaaagaaaugcauaaagcagugcaugcauuuuguugacacaaaauuaagaccagguuuggagagagauuacuucauuucagucacauuguuauuguucaaggauagugaguuauaaugcaauaucuaggccaaauauauaaccaccuacacacuaguaucacuuuaucuagaaacaacauaguguuacuaaaugaacauauuuauaaaauacuguacacugcuucugcaugggguuggcagauguaaacagcuaauucaacuggaguuuaaaauaucauuuuaaguucauuugucauauagucuuuugcauaacaugccaguucaucuuucacaaaaucacaacuugccuaccacagcucgcaggacucauuagaggauauacaucagcuuacacacauauuuuacagugguccaaaggaacaugaaaagcaucaagcagaucaggaacaaaaaugcccgguucacaaagaugcuaaauaacauggaauugggaacauaauuaaucauugcaacauguguuucuuuauugaauguuacagauuuauaaaugauuauaaagcucuccuguaacguucauuaauacaaccacaugcuacaacuacgcuggguuaaacauggguuacauacauguuuacauguguuuuauaauacagcauugcccaacauaugaaugguauagccuauagauagagcaugauggaugaccggguaauauuuaucaucuuuaaagaaauuaaacagcccaaacauucaggaagauuagacuguacagacucagaaaguaaaaaaguacuauccaguuaucuaccauaauauuaucuauagaaaccauauuuuagaauacauuugaaacauucagaagaaacacauuuuguguuuuuaugaguacauuuuucucguuugauuauucuuauauauauauuuuaaaaggggaacuuucaaagugcuaaauaauauccuagaccuggaaacuuauacauuuaaaaaauccaguucuguaaagugcuguauucugacugcuaauacaccuuuuggcuugcagagauaauacaaacuagucaugaaaauuguacccaagcuuuccagcuccucauucaaaucuaucaaggaggggcccucuaacuauaaauauaaaguauauugguuaagcaggagaccuccauggucauuuucauaaaacauccuuaaauuuuuuucaaaaggaacaagcaauuuagaacaaaucauuacauauaguaguauguaaaaauuggcaccuuugaagcagaugauuaaaccgaagcuauuacuuccuugagcucucuaugacuuuauuuacgguccucaguaacuugcugcucauaaacugcuuaauucacaaagacagguaauuaacguccccucgaucagggaugugguggaaucaaugggcugagcauaagcugacugcacaaggccacagaaucaaugccacauugcugcacagagaacccagaaauggaaggaaauggacugaaaaauaacacacauacaugugcacaggaaggaaauggcucauggaaguuacacaguuugugucuacagucauuuaaguuuggcuuauauauuucacacguuucacagacguuagaacuuaauuuucaugcacaacaaaagaaucagguaauugcaagaucaggacuguugaguauuucguuucccaguuccuauccuuuucucucugaaaucacgaugaauggaaac

SEQ ID NO: 18784 - RNA, 3217 nt, Homo sapiens
uuuuguuuuugagauucauccuucuuguuguagguaucagaguucauuccuuuuuauuuaaaaugcagauuuuugaaguagcaaaccaauugcucagcaagaugaccagaccuaggaggucccucuggucuaaaaauucuaucaacuugcacaggaaaugaaggccugagaauuacaucagguuaguacagaucacauugaagaagcagccgagcacaugaauuucugagcuccaggagcccaggaggacagggagagaugaagccccggugaaugauagaauauauuacagaggaugacagggcuauuuguucaguuccguuaugagcucagcaaaaugugacaauccugggaaauauaaauauauauugcuauauuuauauguguguuugucucgggaggccuggcggggagugguggguggaagaguggguuuccuggaggauuugaguaggcagagauaacugggcagagcagagucugugucaggcugcaucgauacauauucaauaaauaaacauuacaaugagagcuaauacugcuugagcacuuauuaugagucaggcacugugcucuguuccuuacaugcauuguuucauuacaucuguaccucccuauguacccuauguaaccagcgucucagugcccugcccacacccccuugugugcucuugcauaguccuguacgcccucauuacuuugugcugugcacccagcagccagcaucguggcucuguguuggaggaugguccuugagcuacuagaauugcuuugcuucucaguauagagagcagaagugccugggacuucaccugugacuaccagguacugugggacgaaugcucccagcuccccaugugaccucuccugucucuggcacaccucugcguggacuuuauuugauugucaauguugcuuggacgccucucuucccuuccuagucccacucucuaccuccucuaccaguuuccuuuaaggacacuuuuuguuuuuuucuuuguuacccagacgagagugcaguggugccaucuuggcucacugcaacuuccgcuucccagguucaugugggaacacuucuuuuuuuuguuuguuuuuguuuuugagacagaaucucgcucugucgcccaggcuggagugcaauggcacaaucucagcucacagcaaccucugccucccagguucaagccauucuccugccucagccucccaaguagcugggauuacaggcgcacgccuccacacccaacuaguuuuuguauuuuuaguagagaugggguuucaccauguuggccagguuggucucaaacuccugaccucaugaucugccugccuuggccucccaaagugcugggauuacaugcgugagucacugcgccuggcccuagggcacacuuuuuuauaaaucaccucaucaugaguccuuaucucaggaccuacuucuagggacuccacacuugggcaagguacuguuaguacagucauuuugcaaaugaggaaacuaaggcuguuacacacacacgcaucuccauaacuccugcucagccuccagaugagcuuucucaggcacccuuccccaacccauuugucuagguaauguuccuugcuuauguucuacuuuuuucucuuuuucuauuuuauuauuauuuuugagacagggucuuacucugucacccaggcuggagggcaguagcauuacuauaacucagcuauaaugcagcuuuuuuuuuuuuuuuuuuuuugagauggggucuugcucuguugcccaggcuggaaugcaguggcaugaucuuggcucacugcaaccuccgccuucuggguuaaagcgauuccccugccucagccucccaaguagcugggauuacaagugccugccaucauacauggcaaauuuuuguauuuuuauuagagauggaguuucaccauguuggccaggcuggucucaaacuccugaccucaggugaucugcccgccuuggccucccaaagugcuggaauuacaggcgugagccacugugccuggccuaucaugcagcuuugaacuccugcucucaauccuccugccucagccuuuuaaguagcugggacuauaggcaugugccaucaugcuuggcuaauuaaaaaaaauuuuuuuuuuguagagacagagucuuccuuuguugcccaggcugaucuuaaauuccugggcucaagugacccucucuccuugcccuccugaauugcugagauuacaggcauaagccaggaaacccagcuacuccgcuuauguucucagauucuuccuuguuucccuuuaucuuggugcuagauuuacaaugaucugggugauuaucccaucaaugaccaucuccccuacuagagugcuggcucugggaagccaggauccaugucuuuugcucuuagcuguaucucuaggacccuggcauaguuucuagaacauaguaauugcuuaguaaauauugacugacugaaugaaugaucugaaguuucuccaguuuccucacaggcgcucacuggucuccuggauaaauacuuuucagccuuugcugagaaaugggcugggaaugcauaauauaaaaccccugagagggacacaaggucucccuccuacugccagucuucuggggguguuuagagagaugcaauguccagggcaaugugacaguauuuuacuccagaggaccaaaauuuagcaacuagaagcugauucuagagggugggccuugaaaguuauguagaauuugaauggaugauuaggaggaaauaugaaaaacauuuuaaugaaauacuaugucauuuaaauacacacacauucugaauuaaauacacauucuuggaucccuguucuucucaacaaaaguacacugagucuccaguucucauuaggaagcugauaaauaucuauuuccuucuauuccugccacaguaacuccccagcuauauaaaauuuacaaacugcuuuggaagcauuuguggaaaaaagugccagagcucuguaugugauuauugaaauaaaugcugauugagagauuucccagguggauacuuaaaacagacaugggcacauauguacacucacaccccacacacaggauacuuuaggcugugaucaauggagauaaauuuucccaccugacaguugacuguaaaucaaucagugguuuuaauagucaccagauuucugcuccuguuugcugcugucucaggcaaucauucacccg

SEQ ID NO: 18785 - RNA, 1300 nt, Homo sapiens
aaccccuuggccgggccaucgcgggagagaucugccggcaaacucugggagcgcaauuccugcaaagucaucuccucccgcacagccuggccggccugcccgccacgccccgcccggggacagcagcacccgccucccccacucccuccccacccccgcagcccauggaguuggggugcggugcuugcuauguuuagaagcugaugucaucucgacacccuacucugcaguguuccuaggaggaccgcagggcagguuuuccucuuccucgcgggcgugggggauggaagguggccaaggugcccugcccucuccccaacacaggaaccccacacccaucuacccgggagauuaaaagaaaaaaaaaugcaacaccgccagaguuaugaaacaggguggcgggggcgguacgugcacgcggagagcgcaaagcaagggccugggccgcgcggggcucccccccgguccccgcccacucccacccccgcgcucccgggugcaggggcuaauuucaagguuagcucacgugggcgugggcgcccggagcuccuugcacgaguuuggggcggguuccuggucccccaaucuagggcaguuuguucaacugcaguaaagggagcuugauguuccagcagggaagggauuucugagaacugggacuguccucagaugaacucgccuccucaggcugcugcggcggcggccgccugcggaagacuuuuuaaaagggcgaugccaggccggggcgcgcgguccacgaguggcugagucgcccgccaguccgcggccggagccgagcgcccgcccccgagcgcgggugauucaccgagugccgcgcugggccggucggagcgcggggggcugcgagcuaaacuuauccuccugcauaugcaugaacgggcggccuuucugcgcugcagaggagagggcuggaguuuugcggaaggcugcuaaguggggcgggagcaaaguagggcggcgugcaaguuuucgcgcuugccugagcgcccuucccccuccagccccuggguguuagcugucauuauggccacgggcguuccaccagaucgggcuuuaccugauuguauuucaaaauccaggaacaucgccauuguuggaagcuuuaucccuuuagccucuccccuccucaagcucgccuccuucucuaauuccccugcuuucaacaaaaugaacacugguuuccuccacauauguuccgugugccuagguggggucgcuggagcuggaggggcugggcccugaaagggagaggucuggaugcagcccagaaugaggucca

SEQ ID NO: 18786 - RNA, 2434 nt, Homo sapiens
aguucuaucauuaucugucuaauaagauaaauaagucacuucucuguaacucaguuuccacauuugugaagugagggaagagaaacauguccuaaaaaccaugcaggggcucuggaaagaaaaagagcuaagaaugguggguuuuuuauaaaaguuacacaaaugaaugguuuuugucuccguuuuucugaaaguggguuaaaaauagccuccaaauaaagcuaaaagaauuuauuuagacuaaauugcaccagagaaguagaggaauuaagagauaugacaagcaaagaugggauguuucaauggaagaaucucaggcaguaaaaaggcuaugcuguaaaaccagaacuuuuguuagcacugcauuuuuaagaugaauuggucauaguuaauguauuggauggaagaauuuuuaaacaucugccccaaaguaugcugcauccaaaaaauauauaacaaaacgaauucuuacucauuuguguuuauucuuggacuuauccugacauaaugggguuuuuuuaauuauagauucacacugcauuuauucaucaccccuguccucucauccauaacucaaauuuacuaccagcaacacaaaauacaaagauguguccaguuucacuacagcucuucgcguuuacaagugucgagcgcuugcuuucggaacgcccuugugauuggccgagccaaugccagugacaucaaccaacuuacuuuugauuggaaggcugguugcugggacuguagcguuugcaggaagucacuuaacuguuugggagcuggaaaaccgaagcugaaguucucuuuugccauaggaacgagcgcaacugacuaggaaagaugugucccaaagcuccgcaagcuggaacgugagccaggaggcccggaccggccacgggaccgcgaggcacuccgaaagugugcggcugccccuucccugccucccagcuguuacccuuuuaaaugucaguguucgaggcuguagggguagcacgaggcagcgaaacggaacagucggauuggccgcacgccucaguucuagacgcaccucuccaccgaaggccguucugacuggcagggggagaaaguaaacagaguugaaucacccuccccacuggccaauuggaggggguuugguuugugacgugaugggauucugcgaaauuguuacugagcaagagaaugccggaacggugcggaccggccggagcagggguucagaagccgucaguggacucgggaaaaagugucucuuagaccuggcgcucggcgggacccucgccacccgcgucggggugaucgggugaauguccuggggcuuuggcucgacggcgaggcggccgagggcgugcaccucucuugcaguuuccucucccagcgccucgggggcguuuucagucgaauaaacuugcgaccgccacguguggcaucuuuccaagggagccggcucagaggggccggcgcgcccgucgggggaucgcggccggcgcggggcaggggcggcggcuagaggcggcggcgcggcggagcccggggccguggaugcugcgugcggaggcgcugccgguuacguaaagaugaggggcugaggucgccucggcgcuccugcgagucggaagcgccccgcgcccccgcccccuuggccgccgcgccgugccgcgccgcgccgcgcucgucguccgaggccagggcagggcgagccgaaccuccgcagccaccgccaaguuuguccgcgccgccugggcugccgucgcccgcaccauguccgcggccgccuacauggacuucguggcugcccagugucugguuuccauuucgaaccgcgcugcggugccggagcauggggucgcuccggacgccgagcggcugcgacuaccugagcgcgaggugaccaaggagcacggugacccgggggacaccuggaaggauuacugcacacuggucaccaucgccaagagcuuguuggaccugaacaaguaccgacccauccagacccccuccgugugcagcgacagucuggaaaguccagaugaggauaugggauccgacagcgacgugaccaccgaaucugggucgaguccuucccacagcccggaggagagacaggauccuggcagcgcgcccagcccgcucucccuccuccauccuggaguggcugcgaaggggaaacacgccuccgaaaagaggcacaagugccccuacaguggcugugggaaagucuauggaaaauccucccaucucaaagcccauuacagagugcauacagguuagcggcgucgcccucucccccggagcucugggguuaguuaaccuuuggccaggcagcguuccugggcguucgggacacugcacucggccgaaagggugcaaacauguuggauaagaugcgguuuaacucuuuaaauaauuuaaaugugcauuggcggaaagcuca

SEQ ID NO: 18787 - RNA, 42648 nt, Homo sapiens
cggaacucccgccggcggcccggcucacgcggaggcgcgcccgaacugucgcggccgccgccaacauggccgagaccagcgaggagguggcggugcuggugcagcggguugugaaggacaucacuaacgccuucaggaggaacccacacaugugagucgcgcgccuccgccgccuccgagggucgucgggagcgggcgggggcggggccaagcguccacccgaccucgggcggcgggcggacagcggguccuggcccacgagcccuucuagggaggaggcagagccgugucgggcgggaccguugucggccgccgcuggcccggcuuuccgcuaccgggacgcgcucgcggucgagucccuagaagugaccucaaaaaaucaaaacggaacuacuuucucugucccuccccaccuuuucauaggaguucacgaaacuccagagacgucccccguaggucgacauccuuccuguguuuaagguacucgggcgcacacaacgauguggguccguguaugccuuguaaacacaacucuugagauucaucccggacguuggcaagaggggguaaccgauccucuuacuuuuaaugagccucaaaccccucaguuuacuaacuaaaggugguuugaggcugcuuuugacuuuagccuuacuugccacaaaauuguaaagugacuccgauaauacauuguguuuugaaaggugaacagaacauucucaagagaagcuucugugggcgcaguguggagucugggauaaagcaaaugaaaccuugauacuuuuuagcauaagcggauucauaguuacaaggagcauguuaacucauuuuuaucccaacacugcugcccucuuuaacgggacacugcagaacugacauauguaucucuuccauuuuacuugaaguacugugggaagauaccgcaagagucuacuuuuuguaacacuuugcuuuuauguaacaagugaaaagaaagcuauugagagagagagagagaucuacauuauacaaagguguagggaagaagcaacaauguaccuccuuucccauaccucuuccuccucaaagaaaagaaacauggcauccaguucugcauuacuuucauuuuagcuaguuguuuuuggaguuuauuuuuuuuuuuuuuaguuuauuauuuuuuauuauuauuuaauuuauuuuuauuuuauucuuuagacuggagcucaugauuuuuuuuuuuaaguauucuaaccgguucagcuuuucugccuaaaaaaguugccaaacguguaucuuaccaaaguguucuuuuccucuaaggugaugauuguaaaacaguuaagaagccguuggauguuuugcucccuuguggcacacaauuggagacgugcaacugugccacauuaaaaacaaaacacugcuggccucaaaacacaccugccaccucugacagcauccacuucccucccccuuaugacugcugccuuuuucaaaaugagaguguuuggaaugauuuccuggcaguauccauagugguugcugagccuucuaaagaaugcuuugaugccuugcuguauaucagucuuucgauuucuuuuugagaaugggagccuuagugcaaguaagagacgaccucaaaaaaaaaaaaaguuggacaaaugaagaguguauuuucucaucacugguauuuuucuagaagaaauuacagcagagauuagaaaucuaauacaaaaugucguaaucaucuuauguucucuucuuugagguagacuaaaagagcaucauuauauuugaagaaaccaagauugaauguucauuggcuuggcaguuuuuaacacagugcaguuuggaacaugucccaguucuuguggaucacauuuauggaaacucuuaaaggacuuuaaugccccucccuaauccuuuuucuacuguaaaaccucauuaauauauccucaauguauaauuuauuaguaauaaggauuugggucauucgagauuuaaaacuuugagauaaguuggauauucggaauaauguaaugauuuguaauauaggucuuaaacauuuaaauagcuuaacucauuguuuaagacuagucaucagcuauauuugaauacauauuccccacaguaaaacuauuuucaauaauauuacuaugcaucuuuguaagugccuuauaauuugggcuuuuaaaaauugccugcgcuuucuucccuuaauuuagcccauuuacucccaaaauaaagaggcuguguuucuuuuuuuuuuuuuaaggcauuguuuaucuguaacguuuguaucuaacuuuacuguaucuaauuacacuuucaguauuauacaaaaauuuuuuuguuuuucuuguccaaacuuaagaucgguuguaauuuuauuggccaacaucuacuucauuaaauacauugacuuuguuuauguagaaauauuuagccagaaggaguugaggaugcaguggugagauguggauuuuguuacuguaugaugugaauagguaccuucucucagccucaguuuccucuugaucuugugaggcugaugaaaacaggaaaaucaccucacacagugguacuuaguugccacucaauaaauauuagaccuucccugaaucucuguguuccucaccaaaaauauauuggacaaaugauuggugaauaugaagcacuuuauaaaccuggauaauacuauauaaaugcuguuuguaugguugaguauuagauaaucauauuggauucucuaaaacugaaaacuugaccuagggauagucuuuaacuuaguguauggacccugugcuaauguagaagacaacaguuuauaauguaaacagucacguuaaaauuaaucuuauccagcaaguuauuguuuuuucuauuaaauauugaacucacuguuuaugaaguguuguggguaccaucuuuacugugugaaauagaaguuuaaaauacaguucuugaacccaaggcacuaacagaaauuucuguaaugguggaaauuuucugugucugugcuguuccauaugguagccacuagccauaguagcuauugagcaauugaagugucccuaauaugaacagggaccacauuuuaaauuuuauuuaauuuaaauggauuuguacguaguggcuccaugugccuagugacuacugugaugcauagugcagguguagaugagaccuaagacuaacugcaugaacaguaaauuaacccuccaaaguaguuuauaguaaaaguuggauaggagcaugaugagcaagugcuaugggagucuaauagaaguggagaggaggcugguuaugucucggauaggggugcuaguggagguggguuuuaagccaaguauuaaagucuggguaggauuuguagucucagagggagccagagaccuccacagggagcagugaauugaccuaaacaagcaaaguguggcugagaagguacaguagggccagauuauggagauccuugacucucauuuaauuucuuucauuccauucauacauucugcaaaagaguaccuccauuugacaggcacaaugcuggucucuggguauacaggguuaaaaacugggugguuuaaugaacaaaccacacauggucccuauccuaauggaacuuuaaucagucaacauacagauuaugaaaagagucauaaaaaguaagaaggguacuuagaauaaaaacagggagacccaauuuagauuauaaggucaagagguucuuucugaggcaauagcauuuaaacugagugagacaugaggggugaagaaaagcuggcucaaggauguacacuucuaaggcaauggguaggcaccagugaacauuuuuuaguaaagaaugaugaaaggcaauuuuagaucgucugcaaggugaacugaagaauagaaagccagagucuacugggcuucuuauaccugauuuuuauuuauuuaaauaauaguguaguauaguuguaaaaauuugaguuuagaguuugauagucuaagcugucaaacuggauuugagucuuugcuugucguuuauuaacugaguagacuuagacaagacucuuccucuguaaaauggggucaaaauuccuacuuuaugagauuauugugcagaauaaaauauauguaaaaccuaaccgugcauggcaaguaacaauaaacacuaguaauuuguguagcuuuuucuaaauaaggucaguaauauaauuucagugaaacauaaguugauaaucuuuggaauuaaugagaaagccuauaagguuucugaaauaucuaaaucaccaggagaauuuuaauuaucaauaugcaacggucaguuccuuuagauauauuuuacuagcuuuccuuuuuggucaugcuggaaagaauuccaguucuuuuggggggugggagcagaacaaaaugaaaauaacuacuauuuagauuuaaaauguuuuuaccauuuccugaauccuuggacuguuuucuguuugguugcuccacacuauaggauucaguuugaguauuuggguaccauccaucccucccagaagguaagcugguugaugcaacuuuuguggauaauaaguggcucuguucugguugaugguguuucugagaaguauagacagagaagcugucuaaacauaaggaacaaagucaguaucaguguuacaugaacugugaacaucaucuggaagccaaugaauggaucccuauugugaagugaggcgcucaaagagauguaucauacuuugaucuuaaguaaaugugcugguucguuccacauugcucugccuuuggagcagucugugaugaaggugaccuaaaaagugagcaccauuagaacuugauugcugucccaaaccaucauaucuuuaaaaauccuaugaucuucuuaguuaugcagguaauugaauaccuuguuaaauaccaggaauguaaauggccagaaaccuaacaguguaaaagagugaaauuuauuaguaguuccucucauaagacuauuuuguaaagaaauaacuagagauauguuugauauuuauagcacauucauugcaaccauuaaaaauaucaaaauugauuaugugggaaaauguuuaaugggaauugcucaguuuuuuuccauaaaggauuauagaauauguucaauaugaucccacuuuuugaaaauacucaggaaaaaaggauguauacccagcugggcacagugacucacaccuguaauccuaacacuuugggaggcucagugggaggaucacuugaggccaggaguuugagaccagccuggucaacauagugggacuacaucucuaccaaaaaaaaaaaauauauauauauauauuagcugggcaugguggugcauaccuguagucccagcuacucaggagaucugaggugagaggauuucuugagcccaggaguuggaggcugcagugagugaggauugcaccacuucacuccagccuggacgacagagcaagauccugucucaggaaaaaaaaaaaaaaaaaaaaaaagauauauacccaaacauguuaauagcaaaacagggauuacaagugacuuuuaggguuuuuuuuguuuuguuuuguuuuuccugaguuuuccaguguuucuuuaguauggaauuagaacuuaaauuuccagaaaaauagaaggaauugaucuaaauccuguuuugcucuuuguucuagugucagggguuuggggcuaaguauuaggaggcccagauucuuaacuuagccacuagcaauaugaccuuagauaauccucauaaaccucacuguaccucaguuuccucaucagaugaaaugacagaggaaugcagucccuuccaacuuuaaaaugauuuuggaaggaauccuauucgaaauuggcuagaaaaaaguggacugugacuuaagggaugagacacagaagucugaagucaaacacacuauuauuuggaagcuuacugaccuaccuauguuuacaaaguauguguaauguuuuuuagaaagcagcauaacacugugucuuagggucacauaacuugacaaaggcuuaaauucuuugccucggcuuuccauuauuaaccaaugaacucuacugguggaucuuugucuagcacuucauaguuugccacauuuucacaugacauuauuugguuuccauaacaggcagggaagauacuauuccuguguuucagaugaggauacugauggcaagugacuugccgaauucucauugccugucaguggauagaauggaaacuaacuagaacucuggacuuccaaucaaguacuuuugucuuuacacccuacuaccucuucauguguuuuucccccuagugcucuacauuaucuguuaagacuguuuuuauucuccucacaugaaaauagcugcuagguuucucagucauaaaauuugaaagcugggugaaaucuaucccauuugccuuacuggagguauaauacaauucuaccauuuuacaaaugaggaaacugaagucuacagaagccaaaaugaccugauacugauauguauguauauguguguguguauauaucuauuuccauccaggacuuggacacaugcuguuuucaguauacuuuauuaggagaaaaucagagauaauguucuuuuagagggacaagaagugaaaacuauuaauuugaauauuaucacuaaaguaccaggauaaucagccuuucaggaagcagcuauugggcaccugcuauauccaagccauucuuauuuuauaaaguauuucuugaaagaacagacagucaaagcaguguguuuuuuaauugugcagauggcucuuuucuguaguuuagauaccaaauuauuagcugggcauuuuaauccuaguuuaauuagugagcaagacagguuuuuauauugugaauuuaaguuuaaaaaaaaaaucccccccaaaaacaaaccauacccagaaacaggauucuuuuauucuuguuacuauaacaguuauauuguugacucuugcaguucuuugaaguguuguaaguagguuauuauaucucagagaacagaauuuccugaaauaaucacauugaguuuauuuacuuauuuaguuuuacuuuauuuuuuaauauucuucauguaguaaaacacaaacaucagaaaauaccagagauucagucauauauuagucaaguauagcuagauauggcuaggggucauaauaaugaauuagauagauuucaggauacuaccaaauagagaugcacaaaauauauuuugaaauacugggcauugaccucaggugcucuuucagcuuuguccuuauucuuccuacaggacuuuguuuauauuauuggaguaguaaagugguaacauuuuauuauggauauugacacagauccccagcaagacuuuagcucuuugaagucugagaccacuuugcuuuauucuuuuugaauuuuagaaccuaagaaagcacccaguacauuguaguuaaucagaaaacuuaugauaguauugauauaguauaucaaaacaccuuugagucaacggaaccaauuguaaggauaaaaacccauagaucccacagucuucuugagaguuaaauuagcuugaaagaauuguuagugucuugcaaccccuaagauauccuuuuuauugauaaaucccugugccacuaaugaagugaucaguagaaaguagauuaccucuaagcuauucaguuuaguuuccaggagggguuuuauuuuaaauccacagccuccuaccaauuugugauaguggcccaacaaaaagacaggguguuucuccuacuuuguaauucaaccaauuucccucuuuugggucuaucaaaccacuguguucuugguaaggggaugccagggacauaauacauaaugucacacacaaacucugaaaaccaguucauuauucugcuuuuuaaagacauguuuaaaauaucuauauagacacucuaaaaacauuuauuucaacuacucuuauuguuaaaaaguuucuuguuauucauuaauuaaacagaggacauucuguuugagaaaggauccuuuguguaggcaagaauuauaacuuccuuuagaguugaaaggcaugugaauguguuuugcacaaauuuuuuacguuugcugguucauuuacuaaguaagucaaaugcccuacauauuguuuauuaaaucucugccuuuaauguaaauuuucagcuuaaguugagguggauugagggauauagaugcuaccacagaggaaaauuauugaauucugaaauguauuuuguguuuuaacauuuauuugggugguuuuuuaauucaggaaaauauaaagaagaaaaaauggcccaaaaucucacugauaaaauaacguuuuuugauacuuuguuucugguccacaugcauuuauuagcaagcaagcauaaacacauuuguugacauuaaaaaaauagaaauacauacaauuauuagauaauugaaacuguauaaaaauaaaauccuuccuuaccaccuuucucucuccaaaaauuucuuguuauccuuccaagaaaauuuuuaaugcaucuauauaucuucuaaagaaauuauacaaaaggauuugugcuguacacuguguucagcauuuugcuuuuuguuuucauuucauauaucuuggcaacuuuuuuuaugucagcauaugcagaucuaccucauuguuuuuuaauggcuugauuauguggaugggccuuuuuuuuuuacuagucuuauauugauaaacauuuagauuguuucuaguuuuguugcaacauugcagugaacaucugauucacauauuuuggcauaggauaauuucugagcaguugaauugcuggaucaaaggguauguuccuucaaaauuuugaaagacuuuuuuuuaaguugccauccaaaggcaagaccaguuuucacuccugucuacagagaguacagcauacugguuuucucauacucuugccacuauuagcaucuaccaaucccaguaagugagcuaaauaauauuuguaaggaagggggaaauaugugggguuuuuaaaauacucugaaauuagaaaaauguugaaaagguuaguauccuuauuuuuaauucuuuuuuauguuuuacauauuaagagaugaaauuggccugaucccauguccugaagcuagguauaaccggagucccauaguccugguugaaaacaaacuggguguggagagcuggugugucaaguuccuuuuaccauauguccacaacaagcuccuuuuguacagaacaagaaagcaauggcugaacagagaugguaaguaugaaucauauuuucuucauuugguuuuuagaagcgacauggaauauaguaggaagagcccuucucugagugucagcauuccuggauucuaguucugcuucuucuguucacugucucggugggugcuaaccuuucugucaagugaguaguuucuacucaccuggacaaauuuuacaaccacagugauuauauagaagcccucaagcagaauuucagggcaccuccuguaaccagagcaguucagauuuuaucaguuuauguauuggggucauugguaagauuucauuugaaggaaaaaaaaaaaucugaaugucacugaagaagacucuagucccuauaggcucagucucugguuucuaauccuuuaguauuuuuauaggcagcaaaacucauuuucauaguaguccaaaugagauaauguaggcaugauagugguagugauauuaugaaccagcccagugauuuauggaugugccauuccacugcaaguuccaguugagcucuggccguuuguauccuguuccugugcugaaaugagcaaaacaaaacuauccggcauucacuucuuccauuucucucagacaguuuuuuuuuuuacugcaucagacaaucccuaaucauuccaucuggucucuuuucuugguguucugccauauuaagccuccaugugcacaaauucuguuuaucauuguaugcccaccucaggucucacuuuuugggagaagacuaauuuaagaccauguccuuuacuguuuuuguaaagcuucuuccccuucccauguacggcaguaccuucaaaagcgcucaauaugccuggaggcugauuuugaauaagaacuuuguuuccuagagaauuuuaguugccaguuugguagccauuaccaagggucuacucauaccagaugcuguccugaguacugugggggauaaaaagaugaauaaauacauggucccuuuauucaggaagcuuacaguugagugauaaucucuuugggggcgagagauguacagaagaguguugccuaauguaugacauacugauuuccuugaauuucugucagcacuaucuguaacauacugucauuaauugguuaauaacacuuuucccuuuuuauaccauagaaagggacucugaagguuuaaugagcaguguuuucuauuuucugugugacuguuucacucaguccuuuguuauauauuuucuuauuagaaggcugugccuaaguuuagccauagcccaaauuuauggcauacacuuuaaggcauggguuuagggauaaacuuaaagguaagcaaguuuaucuguuguuagacccucuuuaauucugcauuccaucaccgugcuguaguuuucaguaacacugagguaaaaaguaacaccauaugacuccaucaaguuauuuuuugccaaacaaagcuguacuguuuauauucuggugcacagaaaugcauaaucgaaccaauguauaacuaacuuuaguuaggggauagaaugauuaucuuauagaaaagaaacugaauuuuaaaaagugagaggcuauaguugcccauuuauguauguuagcucaaccuacccuuucuguggucuuccaaguccucuccauuucucuguuuuuguccuucuggacacuauugcaggcuuugcugugucuucuuaccacauaguuuuaguuuuaguaggcucauaaggaaccuugcggaauauuaaaugguuaagcucacucacaugaauagcuggcaucuaaacuuugaauucagcugcaaccgugcauguguacaaaagcagcuuuugauuugauccuaaccuacauccccauggaagcaguuuuuaauuugacuauuuugagggggguggauagcauaauuuaguauggugucacauacuacucagguuauauauuguauuaucaguaaauauaagaaagugaauuuuggguuugacagaaaaagauaucugaaaauaaaagaguauucugccaaaccuaagaacugaagcaauuagagcacagaggugaaucuugcuaagaaaaacaugucaaaaauguuaggaaaaagcaguuauuucaugaaaaugcuacaccuuuaaaauuauuuguuauagagaauauauauuuauaagaagacccaagugaagaaagaugacaauuuaagugacaguuucugaaugucugucugugugaucgaucaugcaagaauccuaggcauccaccuaaaaauguauucuguaacugaaggugaccuuuacuccugggauagauuuuuucuuccuaaccaaacugaauucuuguuuucauuaaccugcugaauuccuuagauguuuaggaauuaucccuguuuaguuaguuaguuagagauugauuuuuuuuuuuuuaagucugugauaguaauacauucgguuugggagaggacugauucuguaauucugauguuugagaaauccauaacagauauaagaagcaggagggaagaccacagcauuggaguucuuucuggacagagcucucuggugcaacucuucaggagugcccuccugccaucuuuucuugcuccucucucuuuuucacagcccccacuuagucuauaucugagcucucucuuuaaaagcugucuucugcucuccauuucuuuggcugaccaggccuucauuauuucucauccagacaaauguuauuaccucauaaccagucuaccccuuuuccaggcucuuuugugacccauguccauuaugccaguagccagucauuucagacacgcuugaacagcauuucuuaaaaacaguuugaccacgcuuuucugaaauacauuauaugcucaucuuauuucaugauacccacagggucaacguagagucgaaacuccuuagcaugguauucaagggccuucacagucuguccccaguuuuuccuccaguuuauauucagcaucagagguugcagauucuuagcacacaggcugaagcuaaucuagauacauuuugguguggcuuguauaaugucuuaaaaauugcuuuuuauuaguuggauaaaucugauuucugucuucacuugaaaaaucauaaggcuugguugaguauacaacuuucuaccuggcaauaguuggcugggacauacagccucuacucuucguaacugggcaugucuguuccaguuuaucacagccuuuucaagcucuugagacacugcggcagaguguuaguugauacuucuugucaaauuuccuuugcuacuuuuuugagguucauuugaacccuagaaacauuuauguuagcagcuauuugauacauauguucauuacagccacaagcagcauucuuccauucuuugacucuguguguacuacugccuuacuuccaugccuuugcugaggccaggcucaugucuuaauguuggcauuaucagugugguugccagcacaugcacgugcauacacauacacacacuuaacacugugaagccuuuuugacugcuucaggaagcaauaauuauucccugcucuuuuauggaagcccuuuacucagauggcuugcauaauaguaucacuugucacacuguauuuuagcugauuaaacaaccuuuuuccuggcuggaaugugaguuuauuaggaaaagggauuguggaucauuuuuauuuacucagaaccuuuacauguucaacagacauuugucaaacgaguaacaagaguuuguaagcaagaguuuuuagcuuagucuagcuauugauucugugacuguguacuauaauaaacaaggccucucugguguuuaccauauagcuuuaacucaagcuucacuucuugugguaaccugaauguauuuuggaggaaaagaauuacugauuuaaguuggccuugaauuuauuucuagaugcacgaaaaccuuucucuguuagagacaguugucaaauccagugaccauuaccaggugacuacuggccuugggccauuucuagaaugcagugcagcaagaaaagcauauugauuuuucuccaacuucuguagcauccuuuuaucuucuccuuguuauagcugaaauuuagcuacuuuucuauguauaaugugcccugauuucuuuuucucccuguggcgugaugauggguuagucauauauuguaguguguguaacaaaggaacauuuauuugcugguauauguucuguuguuuggagagagaccuguuuaauuucaagagacuguggagauuucaguagcucaugucuuuugggugaaacugcagaggaaauggcguauuguugaugaaauugagagagucaaauaguuacaaccguugauuauacauguucuuuuucaggucuuugguucaguccugaccugcagaaggcaaaguuauugccuguagugugguagagugaaagagcaucugcuuugcaggacagcagaccuggauuuaaacugaacuugucagcacacugaagucacuuagcaaugacuuagcaaauuacuuaaccucuuucuuccuauuuccacaccaaaagaaggaaauacuaaucaagaccucagaggguuguugugaggaucagauucuuuaauuaugucugauacuucuaaucuaguuucuucuccuaguccuuucucauuucugucauugcacuuuaccccuagcuucuuauaucagacuggaauauuuacugaaggaagucuugucugagccugaguccugaaugaggaaguuuuagcaguuugugaaagaggagaagagaagggccuaugguuguauauguuacuagguaccaccgaugguggucaaggcuguugauguuuuaaauucgaagauucuuaaaagucaaaaaguaucccucugcucagcagucacugcuuagccagcuuaggaggaucuuuugcucccucuggaggcauccagucccaauaucauuuguggaacuggacuagaaaauacaggcuuuguaacaggaauuaccauucaguccuuacuguaugucagagacuguacuaacacuucaaggauuuaaucaucuaauauacccaugauagcuccaucuuacauacgagaaggacauuaaggccuagagagauuaagugauuugcccaagaauucccaguaagugauggagcugggcucugucugaacccaguagcugcuguugcucucuuagggagagaccugccaguagaggaaguguuacuuugauaagucuuccuguaucuucacauaaccauaaaaugaaaagcggggacuuaaguacuugcuguguuaguuuuugccuugugcugcuguacagaagucucucauggaggauggacuucuugucuucacuugugauggagggaggaaggaaauuguguuagaaguacaaacaaauagcagcuaccauuggucagacacauuuucuuuaauguagaaagggagauuccaagggacuaugcuaauuuaccuagguagaauaaucacuuuuuagaaaauuguagaugucaaaagaaauuccagaggcuuucccaucauuuacaaaccuuuccauguaacuacuugacuacaaagggguuuuuuguuauugcugcguauuuuacaaguuuggaaauuuagacaguuuuacuaaaggaacaaccuccucauuauuccagacuuccuuacuuauguugaaaauacucauuucuuugucagucagugauggcguuuaauuguacucacugugugucaaaaagcuguggagaaauggaaugaauuucauugcucacaacaccaugagguugauguuucacugagguuucacugagugaguccuuguuucacugagguuccaagagguuagguuauguagguaguaaguggagaagcugggauucaaacccagguaguauggcuuuaaggaaggccuauccucuuaccacuccucugugcuguggucagacauggagcugcuuuuggccagggacugugcuuacucaucuucagccagcucaguaccuggcuuauuguagaugcuuacaaaauuuguugagugaaugaauaauuugaacauguauuagagaggaccugcgugcaaaaaauuugugguccaguuaagaggacaauauuuauguaaguaacaaaaguaagauacgcauaaaacagaugaggccaggugcaguggcucacaccuguaaugccagcacuuugggagacugaggcggguggaucaccugagcucgggaguucaagaccacccugggcaacauggugaaacaccgucucuacuaaaauacaaaaaauuaucugggcaugguagcacgcgccuguagucccagcuacuggggaggcugaggcaugagaaucgcuugagccuaggaggcagagguugcagugagccaagauuguaccacugcacuccaacuuguacuacaaagugagccuccgucucagagaaaaaaaaaaaaaagcagagaugaaagauuuuuuuccaacuagguagguuaggaaagccuuuaaacuuuuuuuuuguuaaauauuaggagacgggaagacaugagccagaaagaauagcaagcagguaaaucugaauuauguuccgagaaaagaagguaggcggguaggacguguguucauaggacaguggaguuugacucagguggaauguaacauguaaaggaaaguaauggaaggccaagcugaucaggagauugagaccagguuucagaagguuucacuuccugguacauuuuaccaguaccuuguguuguagucaugcucugguauccauaaucucuuagagagcagacuaugugugaaguuccaugcauuuuuaucuuugcucauacuuuuuccaguaugguaagguggugccgugaccacuuuauuuauuuacagucuuccauguauaauuccacuaagaauuaauugcagcuucuuuggugggccccaaaaugugguuuauguuucuacuucauaauuauuuugccuuauauaauuauuuguuuauauagucucuccaacuugaagauaaccuagaggcaaaauuaggucuuguuuaucauuacauucaaucacucaguccuaagggccuacuuuaaucuuuguccauagucaauacuuggaauauuuguggaauuaaaugaauagugacauagaauauuauauuuauuuuucuugauaaacauuaaguuagugccaaaaacuacuaaaaguaaaaaaaugaagagguuaauuauucuucauaggcauauuguguuguaauguauguaaugacuuggaggucaaaauaaauguguacugauccuacuguuuguugcucauuugaauugaauauuccaauaugcucacuaguaaugaaaucaugggccccaaauaaauguuaaucuccuauuaagauagaauaaaauaauugauuuuauuguuagcuagaauauuuuuaaaugacuauuggauguguuuauguguauuugcucuuagauauuaaaaaguuuauauuuuacuuaaacacugaaaaugucccaauuauuguaggcagacauuuuguuugcagcauaauugacuuguuggaaacaauuuugauguugacuuugccacaugcuaauugggugacuacgggcaaauugcuuaaauugcagaauuucaguuucccuaucugaaaagugggauaagaauauuuuggauugugauuaugagaauuuagugaaauaauauaaaauaaagugcuuacugccaugccucauacacaguaaugcuaaauaaaugguaauaauuauuuguauuguuuuauuacaugacauuuaauaagagcuugguaggguugccuuaauuuaguacugugccccuagauagauaaccuuaauccuaaaauucuuuucaguuuuaguaagacaaagacaauaugucuaaacuuugcuaauuuuguucuuucaaauagaggcuuauggugcuuauuugaauguauaggaauucugucauaaauauaaauagcuaauggaugugaauagcugguucauaagaugaacuauauguaguaaacaaugaaaauguuucuauuaacaaauguaaauuaaaacaaaugaauuguaauuuuuuaucugucacauucauuuuuaaaaauauauauaggucaguuauagggacauaaguacacucauguuccuuuugccaguauaaauagauacagucuauuuuaaagacaaucuggaaaugcuuaguaggagucauacugauuuuuaaguuguuuugacauaguaguucugcuucaggaaauauagcccaagaaaauagccuacaagacaaaaaguuuuuaaaaauguuuauaguaguaucaccuauaacguuaaaaacaaacaggaaacagccuaaagaguaagguaauugaugguauauaggacuaagggauuguuaugcaacuguuaaaaauacauacucuagcaauauaggaggaugcauaugaaauaauacuuagugaaaaauauagaacaaaguuguacauuuaucauugcuauaccuauguaaaaauaugugcaagaaaggauaauuuuugcaggagaauguaaaugaauuauguuaaguggguuggauucugagugauauuuuuuuccuuuugaaaauucgcacacaccgucaauacuugagauauuugugaaguuaaaugaauaguggcauagaaauuuuguuucuuuccucgguaaauauuaaauuaguaccaaaaagcacccaaaaggaagagguuaauuagauuauuccuuauaggcauaucauaaaauuguuugugucaucuuuuaagagaguuacacuuaccaggagagggucuugagaguaaucuucauauccuugacagcuuagaagagggaauuuaucauuaaaguuaguaugacaugagagauauauuaguauaaugugauagagagaaagagaaccuuaaaagaaugagaagccaagcuuuaaaagguaggacuauuuguuuuuaauaugacuucucuuuauuuuagaauugauagaugucacauguacccugcugcuucuaaacccagacuuuaccacugcauggaacgugagguaugucauuuucauuagugauaugauaaaguuuguccaaauuucugaagacauguaagccccauaaguuguuagcuuuugaaaacgaaauauaaaccauuuuacacuuauuucuucucccuauucuuuauaccugugacaauucuaaauaggcauuuugccccuuuuuguguggugucuucauaaacuuucuugccugaaauauaaauugucauguugaguuacaguauacuguuugauacaugcuuuuauuuuccuucauuuuuuggggugggagacuaaugggcaaugggcauaacugguuggcuuauaaggcauauaacauuauaucauugguauuugagaagcacugcaguguaguggaaaguguaugggaugagaaagagggagucaugcuugccucuggcuuuuucccugagcaacugaaaggauggaauugccauuuacugaaauggcagugucuggaagagaaacagauuuagguaggcgguguuuguuauaggccaagaguucagauugggacauguuagauuuguguccaaguaguuguauauuaauuuaaaguucaggaaaaaggucugggccagauguaaacuugggaauuacuaacauauagaugguuuuaaagccaugaaacuguuuuaagauccccaaaaguguuggcauagcuagagacaagaaccaguucaaagacugagcccugagacauucuauuuucuaggguugcacaauccaguacaguagccauuagccacauguggcuauugagcccuugaaaugugauuagucucaacugagauguguccgaagugauaaacugcacaucauauuuugaagacuaccuagcaaaaaauggaaauaucucauuaauaauuuuuauauuacuugcugaaauuauuauauuuuggauauauugaauuaaauauauuuauacuuguguuuaauauagcuguuagaacauuuuaaaucauauaugacucguauuugugacucacauuauauuucuauuggacagcacuguucuagcauuugcaagaugaggaagaaucagcaaaggagacuuuuaggaagguaccaugaacuuaaaauucagagcuuuuuuaagggcagggaccaugucuuuuuuuuuuuuuuuuuccccuuuguuuccuuagcaucuaacucuagugccgguacauaauagacaugcaguuugcaaauugggcacggaaaucaaauucagugaaaaagaaaucagaguaauagggaaguaggaaugccauuuuucuucauguucuuguauuccucaccuauagagaggaauucaaaaguccuucaacaaaaaaauucucacuagccuagcauauaugcauagauagguacauacacacacacacacacaccuguauacauauguguauacacacguguuauucauuguauauucuauaagcccguugagcauaggagaaaaaaaccuaggccuaagauucauggaacuuaguccuguuucaucauccucaccaauagagaggaauucaaaaaugcuucaacaaaaaaugaucucacuagcauaguguauauaccuacauacauacauacacacacacaccuauauacauauauguauacacacauguuauucauuguauauccuauaaaccaguugagcauaggagaaaaaauccuggccuuaagauucauggaacuuaguccuguuucauaaguuaacuagcggcugacuuugaguauaacuuuuaauuaucaagaguuuugguuuuuuuaucuaugaaauaaaagauuugaauuaggugaauuuuuuuaugauucuauuaaacuuuuaaaaaaauaugucugguuggucuuaugaagggaaguugcuccauaaaucuaacuugagggauguuuaugacaguuaaucuugaaaauuguucuaguuagaugauuaguaagguuuugugcuagaugaguagaaagggaaucuugauuuuuaaaaaauccuuuguggauauguguucuaguaaauuuuaauucauaucaguaagauugauugacauagaaagacaucaaaucauagguacauuuugagcaacaaacuaccaacuucaaaguaaauucuaacccuauaaggucucuauugcguaucaaauacacagaacuuuauuuuuaauuguuaguggaucucuucuguacuaacccuggaaggcauugagugauuuuuuaaugcauuuuucaaacugcuaaagaauaaugcaauagacgucuaguucaauuuguggguauugcagucuuaggggaaagaaauagaggcaaaaauaaguuuuugaacugaucuccuguaauuacagugagugauacacauaauuuagaauuucagcugucuuuuuuuuuuuuaaagaaaacugcuuuuuuuuuuugcuuuggaaauuugugaauuaccugaugaaagagguugacuuaguaauaauguccuauuuucuucaucagucuauguacuuagaguaagcaaaacaccuuugagcaacuagaauaguugaugccaaacuccagugauucauguucugaacucauagccuauugauuuaaauugguaacuuuauuuugugcagauuugauguuugguucugacauuuugagcuaagaaaccugagcaaguuacugaacuucuccaggauucaauuucuucaucuguaaaauugagguauuuggccgggcaugguggcucacgccuguaaucccagcacuuugggaggccaagguggguggaucacgaggucaggagaucaagaccauccuggccaauauggugaaaccccaucucuacuaaaauacaaaaaauuagccgugcgugucagugcacauguguagucccagccacucuggaggcugaggaaggggaaucgcuugaaccugggaggcggagguugcagugagccaagagcgugccacugcacuccagccuggugacagagcaagacuccgucucaaaaaaaaaaaaaaaaauugagguguuagggaaauuuuuuuuauauagauaaaaaacaauuuaauucuagcacccacauugugguuucuaauaccauucuuuaaugauguuagaaauggcugauucuaggaccagagcaggaaguauacaagaugagcuuggagcaucuuauagagccagaaaguaaggaaguauucaaaaauauauggugggauaugaaaaagggacauggggagcaacugaaagagcuuccaguggccauagcuggaaugauuugagcaacaaaauaaauaacauaguauuggauuauaccccuauccaucagcccacugaaaugaaugaaugaauauauaaguaagagacaauagacaaauguucuguuaauuuaucuagauaaucccccucuacaagguagagcauaacucuguauuucuuaagguugagcugugcaccaaauaaaaaaaucagugacuuucuugcaaaaaguagugaagaaaccugaacucagccagguaauccagauugauaucaacaaugcuaagucauguugauagcacaugccucugauaugaugcagugaaaaugucacuuuaccucuuuggucuuccucuccagaaucuguaacuccaguuuaaugaugagaaaaacauuauacaaaauaccugacccauauucucaaaacugucaaagucaucaaaagcaagguaaauuugaguagccaagaggagcauaaggagacauaacuaccaaauauaagggauccuggagggaacuuuagaagaggaaaaggacauuugguagaaacuaaggaauucuaaauaaaguauggacuuuuaauaaaaauauaucaauaucaauacuguugcauaaauuuugacaaagguaccaugguaauauaagauguuaauagcagagaaacuagguacagggcauaugggaauucuuuguauuauccuuacaacuuguuuacgaaccugaaacuauuguaaaauaaaaaguuuauuuuuaaaaaaagauugaguaucagcaauuucauauggcucaaugaugauauuuaccuuacaggauuguugugagaaauuauguaacauauguaaaucacuuuacacgguucuugacucagaggaaguguucaauacaugguaguuuuuaaugaggauggccauuauuauugucauuucagacagaguaaagauugagaaaagaaaaagaguagucaguuuuauucaaacaccuuacaugccucauugacaucagugacuuugucaucacaagaccuaguuguuuuuaguucuguagcacauuuuuccagagcccaucauaguauaucuaaguuguuugagcuacagcacuuuuugaaucuguuugugaguggaaauuguaucuccagucagauucuuauuugaauacauuagagcaguugauuuuuuuaaaauguagcucuaaggccagguaugguggcucacaccuguaaucccagcacuuugggaggccgagauggguggauugcuugagcucagaaguuugagaccagccugggcaacauggugagacccugucuccaccaaaaauacaaaaaauuagcuagacgugguugugugugccuguggucccagcugcuugggaggcugaggcaggaggaucacuugagcccaggaggcagagauuucagugagccaagauugugccacuguacuccagccugggcaagacagugagaccccaucuaaaaaaaaauauauagcacuagauuaugugauugcuguuaauguuaccacauaucauauuuccucuuaaagugauuuuugaaaaacuuguuucagcaauauccaacaccuacaaauguucaguacuaccccuagcaauguuuauuacauugauauuaaaauuuugcuugauuccaucaggugaucuuuuucaguguccauauauuaacauugauugagguuguuucaagcuaagaugucuucccaaaaaugcugcuuaauucaaaauaaagauauuaacggaguccccauuuuuuucuuuuucuuuuuuuaaaauucuguaccgcagugguugcaaaagagagugcccauaauuuaagaaacuuugucaaaacucaguuguaggguaacugccucuuuuuugaagaaaauuuugauuaucuccccuuauauauggauauauaugggaauaaagguagacaguuauaaauaauaagaggucuuaaauuuaugaaauggaaauuaagcauaauacaauaaauucauuauaguaguuguuuuuuaaacuuuaaugggcaucauuauugccaggcuggagugcaguggcgcgaucuuggcucacugcaaccucugccuccuggguucaagcgauucuccugccucagccucccaaguagcugggacuacaggugcgugccaccaugcccagcuaauuuuuuuacuuuuaauagaaacaaaguuucaccauguuggccaggauggucucaaucucuugaccucgugauccaccugccucggccucccaaagugcugggauuacaggcgugagcuaccgugcccagccaaugggcaucaucugaagagcuuguuuuaaaacacauauugcugugcccaccugaguuucugacucaguugguucugggcugaggccugaggaucugcauuucgcauaaguuccagaugaugcugauguugcagucaggguucacuuugagaaacauugcuuucaaacgugguuaaaauuacauagagcaauauuuuccuccuuuuacuuuauagguauccugacuuacuguaugaacaaaauguuacugauuucagaagaaaaauaauccaagacugcaaaagcaauuggcuguugcaagaaaaaaauauauauuuuauauauauauuauauauauauaaugacaaauugguuuccugaacauugaaaggaaaauaguuguuuucuuuaucaaauaaaacuuuauaaauaguaugucacuguuggaaagaaaauguauugugguauuuaggaauuaaguccgucuaaguagauaugguauaagagcuggauucugguuuucucuggcuuaaacuucucuaaaauaaaugaauaaucagcccuacacaggaaggacauuuuaagauaaauaauaacaaaugaucugauuuuauuauaaaauuauagauacauugagaauucagugagaguguaauaucagcacuuaucaaaaacuuaccugagaaauuaaauguaaauuguauuuaccugagaaacagguauagaaagcucuugcaugacauucuuuauauaguuggcccucuguaucuguagguucugcauccauggauucaaccaaccgcagauagaaaauauuuggggaaaaaauugcuuucuguagcgaacauguucagacuuuguuuuccuaucauuagucccugaauaauguaacaacuauuuauauagcauuuacauuguauuagguauuauaaguaaucuagagaugauaugaaguauaugggaggauguguguagguuauauggcaacacauuuuauaucaaggacuugagcauucgcagauuuugguauccuugggagguccugaaccaagcccccacaagauaccaagggacaacugauugcauugaagcuuugguugggcuugaacaguuuuaaaaacaaccaaaacauuacauugcuauuacuucugcugcuuauauuaauauuuuaaaaaggaauggccucguauaucaagggucauguaaguauuuuaccuuguuaauagcucuuuuggaaacuuauccaaaguaagaauacaaaagaaagaaguuauaagcacaaagcuuccccugcccagauuuguuuuaaaauaacaaaaaguuugacgcaaccuaaaugucuaacaagaagggaaaagcauagcuucuaaaugaaaacuaauuugaucauuuaaaauguucauuacaaagauuauauagaaucauggggaaauucuuaagauauaaugagagcaggauguaaaauuauauguuaaaauguaugugugauagggaaaaguagaagggaaaauucaaaaauaaaaaauaguaauuugguuagaauagugauuccaugaaugauuuuuuuuucccuuacaucucaaccauauuguguuuguuguaugugugguuuuguaaugaaauagaccaugucaaguccuauuuaggaaacuagaccaauuuuggcugguauuggauuggcccuauagguacgauaucaggucucacaacuuuuggaaaugagauaggccagaaaaccccauuuacccucacgcaaauaguuaagauuuaaaaaucguuaaaaucuguugauuuaagagcuucucuuucugcuuauuaguuuguuauauugggauuaugagaauacauucuugauuacugcaugucacauuuaugaguguuuuauaucccagaguggcuugggcuuuuuuucuuucuuuuuuuguuuuaaaauucuuagacauucgcuucacaaugagauuauauuaaaagccauguagaaccuuuggauauaaggauaaaguaauguuuaauuuuuuuuuuuuuuuuuuuuuuuuuuuacaggaaagagcugauccucucuggcacuuuaaauccaauuaaggauuuacaucugggaaaacucgccuuaaccaaguuuccaaagaguccagaaacauggauucacaggugugguuaauuuacaacauaguacucuuacuuaggauucagacuggcuggagaaagaaacaugacaugugagaggcaagguuacuuauugguuccagagcaugaauucugaagucagguuaccuacauuuaaaucuaggagcuauauaacuugcuaccuaaguguucaugggaaauuacuuaacucaccaagccucaguuuucucauuuguaaaaugagaauaauaauuacaccugucucauauaguuaacagucaaguuuacgugaguuaaugcauguaacacucccacagugccuggcacauauuaaauacucaauaaauguuagcuauuauuaacucuuugaagcaguugugggcauugcauuuauagauacucaacuguaaugagcaauauggauuuuaaaagcauuugguuguuuuccugguaaagauguugguggugaugguugugguuauuaaaauuaacuuacagagaaagcugagggcagcugaagcgaaugcuguguaggcugagcuaaaguugcuaaaauccauacauacaaagaacauuuuuagguuaaaagcaugggacagauagccagaaugcacuuuaggacucucaaaauccuggccaccuggaaccaucuuccucuuggacccuguguaacuacucuuauuugaccaaaaugggauggugugggcuugcuagucaggaccaaugaagaagucacucugaaauucucaguuuauuaagccacucuaauuuuucuuaaaucgugggcauuuuuaggaucuuauguccguuccaggugucuuagugguaaucgugccuuuaguuaacauugcaggucagcuucuuccaaaccacauagucaguuauauuuucuucaucaccagaaauugagauaguauaccacagaaggguauaugacuguguguauggggguuuggaaagggaugguggcaggggaaaggaacuguuaaauaugcauccaucaguuuggcuugucuaauuuuuuuuaucaagcaauauuuuguuguuaaauaagaaauuccauuauuuuaaaaugacaaagugaguuuucuuacuuaauuuccuguaccuuuggguuugaaaucuuuagucuaaaaaaugcuuuuauauaaguaaauuacugguacaaaguaaacacauuaaguagcucgaaacacuauuuaguguuuuuuauguaaauacauguuaaugcaaaucuuaaacagacaaagggagaauuuguggauaaggauauuuugacaccuucuuaaugguuuaaugaauuauauuuguuaccuuccagauuuuaugcuauaauacagaauuuugcugaaugaaagcuaucagaaugcagcuucuuguuugcaaacaaaugcacauagggugaggcaugcauauauacuuaaagaugugaaucaugacuccuuauaauauuuaucagccauuaauuuaugaccucucaccacgaccacacacacacacaccaauugccuuuacauuuccuggccaaguggaguuuugggauugucauuuuagaaguaaugacauucucuguauuacagauuuuaaaguuuuuuuuuuuuccuguuuauccauuuuccacccuucauccauacugcuaaauuaguaucaucauaaacaacaaaacaaccccuccccaucuccaaaauacuagacuuauaaacagguauuauuuugcauugucucugaauggaaauuaaauuaggaacaaugaaaacugguuauuuuucucucugguuuauguucuuucuguguucucuuucccacaugcugccuuaacaggcgaugggugcuacaacagcuaauucaggaaaccuccuugccuuccuuugugaccaaaggaaacuugggaacaauucccacagaaagggcacagcgacucauacaagaagagauggaggucuguggugaagcagcagggagauacccaagcaacuauaaugcuuggucccaucgcaucuggguuuuacagcacuuggccaagcuagaugucaagguaggaauauuacugucuccugggcagacugccugucugcccuuaaaaucuucugguaguaguucauucucagaagagcuuugaaggaguagagaaacugauggucuggcaacuugagagaaucgcaacagcugcuaccucuggaggaacccuguaauuaaauaaaaagcuugcauuccccacuagugcuguuuuuggcagucuuaaggcuagugcauugguaaagcaaggcagguuuaaccaacugaggaagauugagcauaacucacuuuauccugaaacaggaagggauuauuaagccuuauagaacuggaauugcuauuucuugguaguguuugguuaugugacaauauacuaagucagcuggcugucuuuucacacucucguccucugaaaagggggagaggagggcagggauagacaaucucacccagguguuuuuaaaauuggcugagccuauaaauuaccuggggauuccuaaguuccacuccaagccuacuaaagcagaaugaggguggaucuagagaucaguauuuuccacugacucaggguuauuugaaugcagagccaguuuggaaacucucacagccuaauccuuucaguuuagaaaugaggagauggagauuuccagagaauuuuaauggcuuagacuuagcuacaguuguaccacuuauuauucaucagaaugagagccacaugucccuuuugcuccuuauauacuacggugucucaguuuuuucuuuucugauggcgucacagugccauaagaaucuagggugcucaucuaaaaagcuucucaggcuugagacaguuaaaagaggucaaguugaagauugaagugccccaggugaugcuuucagauaaguggggaaguguuauguaauuuuaacuuaccacccucuucuuccuacaucccucuucccaugcucccauuucucucuuuguuuccuggccagggcaaaugggagacuuuuuacuuccagaggauuuuaagccaauaauucuggaagagaagccuuccccauucaguuuacauggcuuugaguuucaggagggguggccgccuaauggaauagaaagaaccaaggcucagaaucacaucaaccuagguucagauuuuggccccacuaccuauauguggaaagcaagguuuuauuguuuucauuuauaaaauagggacucuacugucugccucaguggauuauugugagaguuaauugaguuaauggauguaaauuacugggcaucuaauagagagagauucacucgauuuuaguuccuuucucuguucuccagagauagaaaauuggcuaccaguuugcuugaucaacuccgugcaauuuauugaugaaaaaguauaaaacccuaucauacccaccgacuguccuguauacgcaguaaaacaaaguguuugcucucaacaaauugaaaaucuaguugagaaaguagaccaacaauuacaaagcaucagaauacaaugggagcacagaaaaaucguucuucaucuaggaugcgcucguuggaaauagcugccgggggaaggaagauacauugaguugggaggcaugauuacaaguuguuugguggguugucagggauauggagugcuugguggucaucucagauccaugacuugauagugugugggaagaggaaagagauauggggaggauuggggauaaaaaggaaggcggaguccagguugacugagagaucuuuggaaauuuuucugccaugauguggaccuuuacaaguggcauuuccauaaaaucaggaacaaggggccaaagugaaauuuuugguuacuugagaccaucuggugguaaagauaacucauuaauggugaguuauaacucauuaauggugagcucagcugccaggguccacuccuggguucagaugucaucauccuuccuugacccgcccuuggaggaagacuuaccauucuuccauucaccacuugccacugcaacaucucuugcucuuguugucagugaggaguccuaaauuugcaaaauccccuuucuguuguuauaagccauugggcccaccuagaacauuuacuacuaugcuuugucuguuacaggagguaaucacaaaaauaccaguagucuaaaucagcuuaaaaauauauaugaaaugagccagcauuuuuuaacuuaggaaauugaaaaugacuuuuuaaagugcuggcaucgaguauuaguaagaguaugaaaaugagcauuauucaaauuguuauaagcuuacugaagggcaacauggcagcacuuaucacacuuuuaaaaauaggguguuauuuuuaagaguucugcuuccaggaauucaucauaaagaaauaauggaagaugaaguaugguagaaugauuagaagcuucacucaguggucaugcagaccugcuuugcauucuggcuuuaccaccaauuugcuguguagccuugaggaaguugcuuagccucuucaaccuucaguuuucucauccggaaaaggagggugacaauaauucccaucucacugagugaugcaaauugaaagggaggauucauauaaaguggcuaucaaagugccuuaauuaagugcucaauaaacacuggcuauuaaauauagaaguuugauauauaaaaguagcauuuauaguagugaaaaacuagaaaagcuguagcccuucaauaaugagggaauuguuagauuacaauccaucacauuggaauauuuuguuaugacuaaaauguauauuuuggaagaugauuuaaaggaaaauauucacaauagguuauauuaggguaggccuaauauuauuauuuauuuauuuauuuuugagacaggguuuugcucugucgcccaggcuggagugcaguggcacaaucucagcucacugcaaccuccgcuucccagguucaagcgauucuccugccucagccucccaaguagcugggauuacaggcacccacuaccacgcccagcuaauuuuuauauuuuuaguagagacgggguuucgccauguuggucaggcuggucuugaacuccugaccucaagcaauccaccugccucugccucccaaagugcugggauuacaggcaugagccaccacacccagcagccuaauauaauuuuuaauguauuuauuagcauugaaugagacagcaaauacuuuaaaguguuugaaacagugcuuggcacaugguaaaugcugaacagauaguaauacauacacacaacaaugcuauagauuuuuuucuuguauuuuuuauaaaagcauauauuuguuuucuagucagaaaaagguuaaagaauaaagauugauuaaaaguaguauaggguggaauuaugacacuaauuuucuauuuuauguucucucugaugucugcaugcuuaaauaaacauuuaaguaaauuuuaaaauauuuuuauauuugaggguaguguggcaggaaagauucacagucaggcaguuuauuacuacuggcaaauuacaaguuucacauaaaaaaagcacauauagucauuucuccaaaaaaccuacccacaccaccaauaaggacaugaaaagauauucaccaucuuuacuauuagggaaaugcaaagcaaaaccacagggagugagauaccacuucacaccaaaauacggacaauaacaaauguugguuaggauguggagaaacugaaacucuuauuuauggcugguaagaauguaaaaugguacagccacuguggaaagcaguuuggcauuuccucaaauaauuaaacauagaaucacuauauauuaauaaaacuauaguuaauauauaucauauucuuggagaaaaacaugcauuaccauauaugacccuguaauucugcuccuagguauauacccaagagaagugaaaacacauuccauaccaaaucuuguaugagaacauuaauagccauauuauuuauaauagccaaaaaauaauaccucaccugaggaauggaaaacaaaauguggcguauccaugcaauagaacauuggccauaaaaaaggaaggaaauacugauacaugcuauaacguggaugaaccuugaaaacaugcugauugaaagcagucagauucaaggccacauauuguaugauuucauuuauauaacauguucagaauaggcaaagcagguuagugggugccagaggcuggggaggagggaaugggauguaacuucuaauaggaaugggguuuuguggggguggugaaaacauuagaaauuagauaagagcaaugguugcacaauucugugaauauauuaaaaaccacugauuuauuuuuucacuucaaaaaugauucuaaaguacauuagagagaauaaagcuuaaagaauagcugaggaauuguugggaaaaacaauaaagaacacucuaccauuagauacuuacauguuuauuaauaagacagaguaauuaaaauugugaugcuauuucaaaaauagacucaguaauggaacagaauauaaaguccagaaacaaauuccaauacauaauauguacauauuucauuaaugaugaauauggcauuucacauaauuagagaaaggauucccuguucaauuugugaugcugguaaaauuuauugacuuuuuagaaaauagaaaguuaggugguuuuuuuuuuuuaaucuuaaauaccaaauugaacuuuaaauggaauaaaaaccuauaugaagaaaagagacucacauuaugcuaagugaaauaagccaagcgcagaaggauaaauauugcauggugucacuuguagguggacucuaaacaaguugaacucauggaaauaguagaauggugauugcaggaguagggguugugguggggaacagggaguugcugguuaaaggguacaaaguuuccguuaggaugaguaaguucuggaggucuaaugguagaacaugguaauuacuguuaauaauguauacccaaagauuucuaagagcguuaucuuaaauguucuuaccacaaaaaauaaaauacuuaugugaggugauagauaaguuaauucacuugauggugguaaucauuucacaguguauacauaaaaacaauaugucguacaucguauauauauauguguguguauacguguguguguguguguguguguguguauauacacaauuuuaauuugucauuuauacuucuucaauagaccugagggagaaaagaaaaaaaagaauuuuacuugacucccaaucuuuaaaaaaaaaaaaagaauuuaaaaaaucaguugcaguaauauaucgaaaauaauauuuauaacacauaugacaaauagagacuuaauaucuuuaauauguaaagaccucuuacaaacucguaagaaaaauaaugacuaucacaaauaguaaauuagauaauucauaaaaguagagaauuaggcaaaauaggcaguucauaaaugaagaagcaaaggaaaaguaaucacacaagaaaagauauuuaggcuuaaugauaauuaaggaaauguaaauuaaaaugaaaugugauucuuauuagugaagauuaaaguauugaugaugaauuuaggaaauaagcauuaacauguacuuccaauaggaguauaaauuauacagucuuucugcaggacacuuuauauaucaagaacuuuauaaaguuuuuuucuuuguuccagcaaguauauuucuacaaauuucuccuaaauaauuagauauguacauagauuuauuuaugaguguuacuuauacaagaguagaaacaaacacaggaaugguuaaauucuguuaaucuugagggugaaauauuuuacgaguuaaaaauuauagaauaauauuuaaugccauaggaauguauuuauaauugaaguagaauaaaauugguacaaaagaauaucccagauuuuucuuaaaaauaaacucugugcaugugcauacauagaaaaaaaccugaaagauuuguuuucugccagaauguuacaaguagugaucucuggccaacaaaauaauggaugauuuuuguuugcuuuuuuauauuuucccauauuauuggaauuuucuauauugaucauuuuguaucacuuuuauaaucagaagaaaacccaaauacuauuuuuaaaaguuuaaaggaccuauggcauauguauuuuuaguagucuuucauuuuuagcacguuaucccucuuuuucauagcccugcauuugcaguuuucuuguaguuuauuuauucacuuauucauguuuucauauggaaguaggaaaagaaagauauuuaacguauaucauacgaaggucauuuaucccaucaguacuguacauuaaagccauaucuucauauaguaucuuuagaucacuuaaaaguuaacuggaucacuuaaaaguaauugcugucuuuuuuaaaaaaaucauugccucuaucuuuauaucuuuuuauucuaacaagagaauacccugaaauuccaguuaaaguuucuaauaugcaucuuuauaucuuagggaaaagaauauaguggauuuucucuuuaaaagccuaagaauuuuuuuaagaaauugauuuuguugaaaauauauauauauauuuuuuuucuuuuuugagauggagucuuguuuugucgcccaggcuggaguauaguggagcaaucucggcucacugcaaccuauaccucccagguucgaguuauucuccugccucagccucccaaguagcugggacuacaggcaugcaccaccacgcccugcaaauuuuuguauuuuuaguagagacagggucucaccauuuuggccaggcuggucuccaacuccugaccucaggugauccguccgccccagccucccaaagugcugggauuacagguaugagccaccacgcacagccagaacaucuuuuauaugugugcuauuuuugccucaaaauuaaauaauaaacugcaauuuuauacauagaaauauccaguuagaaauaaucuaaauguuuucauauuauauaaguucauuuuaaauaaguggaguacucuuuucaauccauguuaagaagccaugccaaaauaaaaaagcugcuguauuauagccagaauguucuacagguuuauuuuucaaaaauguaauaaauguaagauugauuuuuauuucagguaggaguuuaucuggugcuauuuuucuucaccuuuuaaaaucaaauaaagauacuguuuuccauuucucagauacuugccagcuauagccucuggaauaaauuuagguggcuaugaauaaacucauuggaacuuaaaggagauguuuaaaacauaucacugauacaacuugacuaucuuggcuggaaguaaucuuacuauuugccuuauuuauuaaauuguucauucauuucauaaaauauuuauguauccacuuugaugucaguagguauagggggauugaaguaucagauaggaaugaauaaauaucuuaaagcccucacucacugaguuuaaugagaaugaagagaugcacugaaauucuuuaauaaaugugauggaauacauaaguacuauggggguucagcaaaaggaaagauucccgcggaagaaaaaugguguaagaaauggaaaaaagaucaugguacaggagaaggcauuugccugggaccuuugacaaacagguaaaggugucauucagcauuaugcugucuguauuguuaacuguucacaaauguaugucuuuuuuccuuagcuggucugaaaauccucugacggaacgugguaggcacuugauauaccuuucacugauuuauguuugcgaccuguccaagacacucucaaauaaauuauuuuugcauaggugcugcuuuuuaaaaaaucauuucauuugaaauucuuuaguuugcaagauauugguaucacaaagauuuaaacaauuugcugcugaauuuucaguuauuuuaaaacccauuuauuauuacuguuaaguaaguuugagacaguuaaagucacgagcucuugaaaaaaucuuauuauuagugcaucauguuuuucuacuaaucccuuauaauuaaguagugagcaagacagacacggucucugcccucaugacauuuauauugaagaacaaauaauuucacugagccuauuguagagauaauaaguuacauauuauacacauuuauuaaauguaaaauaaaguuuauaucaaaguaaucugaguuuauauuuuugcuuuuacgucagcauuacuuguaaaugaauacccuaaugcucaucauuauuuuagaauuuuauuuuccuucucuguguguaccaaucagaaugugaguagucaaggucuagggaaaggaugacaaaugaguccuuaaauucuuuagucuuaaaaaaaaaucuaucacuuuuauaugggaaagagaaaauucgcauguauuaagcuuccacuaagugagagcacugugcuagacauuguguacaaaauauugguaagaauggucuugucaaaaaaggaacaaaucaaagagaaaucagaggcaauaauggagaaagaagaaccuuugggaacucuucuucuuacuucccuuuuuucuucuuaaaagauucuucuugaugaacuaucuucuacuaaacauugggcaucuaugcacguuucagaccacaguggauuucacuaccgccaguuuuugcuuaagucuuugauuagccaaacugugauagacaguucugugauggagcaaaauccuuugagaagugagccagcccuaguuccuccaaaagaugaagaagcagcaguuucaacagaagaaccaaggauuaaucuuccccaucuucuagaagaagaaguugaauucagcacugaucuuauugauuccuacccaggacaugaaacccuuuggugucauagguaagaaaagggaaaaucuauuuccuacacaaaacugcaugucuucaugagagcugcagaaaguguuaguuacaccugauuccugccugcuuggguaaacauggucaucugauuguggagcuuugccugagugaauacaagagguuuuguguuaccauaucaucgucaucaucaucaucaucaucauuaauaagagauuccucauguagaucucugccugcagcuuaggauggugauauucaaccuugacugugcaacagaauaaccuguguuaguuccaaaauaaaacagaaucagaaguuuuuuugacuccuuccuuggagauacuaauauuuagcauaucuaggauggauugcugccaucucucuuuuuuuuuuuuuuuuuuugagauagaguuuugcucuucuugcccaggcuggagugcaauagcgcgaucucggcucacugcaaucucggccuccaagguucaagcaauucuccugccucagccuuccaaguaggugggauuauaggcacccaccaccacaccgggcuaauuuuuguguuuuuaguagagacggaauuucaccauguuggccaggcuggucucgaacuccugaccucaggugaucugccugccuuggccucccaaagugcugggauuacaggugugagccaccaugccuggcccuuuuuuuuuuuuccccccuagaaaaagcucaacacauugaugcacagucaggauugagauuugauuagaccccaagaauaagguaugcuuuaucauuuuuccaacccugauggucugcaaauuaacuuaccugaaguauaaucucuugacacuuuuuguuuaaaguguaagagaauuucucuuugagagaggggaaagucugguagcaaagagugaaaaaggguuagcaaccuaucaacuucaguugugaguacauuugacaguauguuggacugaagucacauaugugaccccuucccagcuucauuucuuuuggaucuuccuuuauuuggaggcaucuucaucuucauaaauacagauucuacuuuaggccauagcauuguauuuguaaaugaaagacuugccugugcuaggcaggaaggagguaggcauuguuuaaaauugccuauuucuaaaguuauugagauuuucuuucuuucuccagucuagucugucuugcagguuauuugaggagaccuggucagcugcuuuuccuuacuaaauauauucagaacauaaaagauuaucuccccucuuuggcaccuucauuaguagagaacauucuuuuucucuuaaaaccaagacacuuauuucauguuuucaagagggaagauagaccuuuuaagcuacuggcauaccucagagauaucacagguucaguuccagaccacugcaauaaagugaauauagcaauaaagugagccacacaauuuuuuuuuguuucccaguacauauaaaaguuacuuuuacauuacacuauagucuaagaagugugcaacagcauuaugucuaaaaaaaaaaugugcauaucuuaauuaaaauacuagguugcuaaaaaaugcuaacgaucauccgacccuucagcaaguugcaaucuuuugcuggugaagggucuugccucaguguugguggcugcugauugaucagaguggugguugcugaagguugggguggcuguggcaauuuccuaaaauaagauugcaaugaaguuugacucuuccuuucaugaaagauuucucuguagugugugaugcuguuugacagcauuuugcccacaguagaacuuauuucgaaauuggagucauuuuaaaccuugcugcugcuuuaucaacuaaguuugugucauacucuaaauccuuuguugucauuucaacaauguucacagcaucuucaccagaaguagauucuaucucaggaaaccacuuuuuuuuguuuuuugguucauccauaaaaagcaacuccucaugcauccaaguuuuaucaugagauuguaagcaauucagucacaucuucacgccccacuuccaauucuaguugucuugcaauuuccaccacauuugccgugacuuacuacacugaagucuugaacuccucaaagucauccaugaggguuggaaucaccuucucucaaaguuuuguucauguugauauuuugacuuccucccaugaaucacaaacguucuuaauggcaucuaaaauggugaacccuuuucagaagguuuucaauuuacuuugcccagauccauuagaggaaucacuaucuguggcagcuauaaccuuaugaaauguauuucuuaacaagacuugaaaguugaaguuucugcuugauccauggacuagagaaugaaugcuguguuagcagucaugaaagcaacaugaaucuuuuuguacaucucaaucagagcucucacaugacuaggugcauagucaaugcgcaguaauauuuuggaaggaauccuuuuuuucugagcagcaggucucaacagugggaucaaaauauucaguuaaccauucuuuaaacggaugugcugucaacauacaggcagaguagacuuagcauaauucuuaagggcccuaagauuauuggaaugguaaaugagccuuggcuucaacuuaaagucaccagcuauauuagccccuaccaaaagucagacuguccuuugaaacuuugaagcuaggcauggauuucucucuagcuaugaaaguccuagauggcaucuuucaauagaaggguauuucaucuacauugcaaaucucuugucaguauagcugccuucaucagugaucuuagcuaggucuucuggauaccuugcugcagcuucuacaucagcauuugcuacuucacuuuguaguuuuguuauagagauggcuucuuuccuuaaaccucaugauccaaucucugcuaacuccaaacucuuuuucuccaacuuccucaccucucucagucuuagaauuaaagagcauuagagccuuagucuggauuagguuuuggcuuaagggaauguuguggcugaucugcuuuucuauccagagcacuaaaacguucuccauaucagcaguaagacuguguuucgcuuaucauuuguguguucacuggguuaccacuuuuaauuuccuucaaaaacuuuccuuugcauugacaacuuggcuaacuggcacaagaggccuagcuuucagccugucucaccuuuggacaugccuuccucacuuagcuuaaucauuucuagcuuuugauuuaaagugagagaccugugacucuuccuuucacuugaacacuuagaggucauuguaggauuauugcuuggccuaauuucaauauuguuguaucucagggaacagggaggccuggggugagggagagagaugggggaagagcugguugguggagcaaucagaacacacacaacauuuauugguucaguuuaucaucuuauauggguguguuugugacaccccaaaauaguuauaguaguaacaucaaagaucgcugaucacagaucacauaacagauauaauaaucuugaaaaaguuugaaauauuaguaauguuaccaaaaugugacacagacaaaaagugaccacauuuuguuggaaaaauugugcugauagacuugcuugacacaagauugccaaaccuucaguuuauaaaaaauacaguaucugcaaagcacauuagagcaaagcauaauauaaacuagguaugccuguauuacauaggccgguuuucuacugcugacucauugucauuaggcagcuuaucuagccuuuaaguuuuacccccuguaaaaguggaacauuaugugcucccugucugcuucagaauaugcaaggaaaaugaauagaauucucuuaagggcuuagaguugcuaaugugaaugaugagauguaacaaccuagaaguuauacaguucauuguacauggaugugcccccacugaauugaaauuuuuggagauuagacgcgggaaucuucauuuuuaacaaacaauuguaggugguuguaagggcaggagaauugcucuccucggagggagaacaggaacuguaucuuuuacauguuuugcucagagcccagcacauccccaaugcauguggauguuuaaaacuguaguuggugauggauuuaggguaaaguucaguugacuuuuagggaauaagacccacuacaacagauauguuauuuuuauuaaaguacuugauagaggccacagauuaagccucuaaaggaacuguucauuccccuuauuucugaaucacuugucuucuaggauaucaaugagauuugucuugguuuuguuuuauauuuauaacuuauagcagaaauaagacugucacauauuucuaguuuuauauuacgguuaccauagaguaccaucuccaagucauugucaucucaguaaaugcuuaugaaaaaccuuaggacuguauucuuucucacaaacaaaccuguaagcuggaguuauaaggcuuucuuuguccaaauauccuggaacaucaucucuacuguuuuuccuccuuccucuguauaacuugguuaugaaaugggcagugaauugaauacuguauguuuugaaauugcaaacuuuuuuuucuggaaaagcuugacuuuguaaugugauuuucuuuauucucuuccuuccccucucuaucgcaggcggcauauuuucuaccuucagcaucacuuaaaugguagguuuccucacagcaugacccaguugucaccugcagacagcccuggggggacuuugagugacuugcaccuuaucccagcaggcucccagcugucucaagcaauggaaguagauggacugaaugacucuagcaagcaaggcuauucccaggaaaccaaacgccugaagcggacgccaguuccagacucccuaggccuagaaauggagcacagguucauugaucaaguauuguccaccugucggaacguggagcaagccagguuugccagugcauacaggaaauggcugguuacuuugagucaaugaaagaggugaauuaguccuacaagguuccccuuuuagugcaauauugcuuucuuuuauuauuuacauaguugcaugaacuguuuacuauuauuggcuaaccauauguucuucgucuuuagguugaaaguccauaguaaaucuuucauuuuauuuauuuuguuaauaacuggcauuccuguggggauaaaauaaucguauaguuccuuccugcugaacagcgagucuuaaauuuucuguuuaacuucucacccuuuguauuucuauauguggggcuucucauuugguuuuccugauugguucacacacacacaccucuaccccccucaguccaauugcugcauaggcaaauucuuuuaaaaauuaaaaauuuaaggccuaggcaggaggauugccugagcccaggacuuugagaccaaccugggccacauagcaagacccgauuucuacaaaaaguaaaacaaaauagcuaggcauggugcuaugcaacuguguuccuagcuaugcaggaagcugaggcagaaggauugcuugagccccagguguuuguggcuguagugagccaugauugcaccacuguacucagccugggcaauagaguugagacccugucucuaaaacaaauugaaaauaaacauuuauguugcaguucaacugaagaauguugguaugaaugccgaauaacuugauguaauuguuuugagaaucaaauggcuagaugggcgaauguuuaaaaauguaaacuaguucucuuucucuagcauguucuacccaauuaccaaagucagaaguauuggaauuuauaugaaaaaaaugcuuccaauguaauccauuuuuuaaaugguuauuuaagaaaaaacuaacuuaagaguuuauguaauugcaguaaaggaaaauuauuuuuauugcuaguuuugauagauuauuuuuaccucaaauuugguauaugccaaaacacaucaguccuuauaaaauugauuuuuuuuucc

SEQ ID NO: 18788 - RNA, 2546 nt, Homo sapiens
ugguccauaaacacccucuugcugccuugugggccugagagcauuuuuggcugguguggaauuguuccguguuuucaucaggugccucauauuuaugcuuccgucucaguucaguguagauguuuuaguaauauuauaauucugagccaguuuucacuugguccaaagagcauuuuguguucaugugaggugugauuuggcuuugcuuuuguuuuguuucauucaugaccucaguagagacaggggaagagaaacuauuauauuuuguaauuaauauagucccuguucucugcauccgagauauuuauguugugucuauggaaauaggaacucagugagcaaaugguggguagcauguauuuauagagagaauggagggauucuaaggagggagcaaagugacuauaacaagauuagggacaagagacuucaaccagagaguucugugaucaauuccccgagaucucugcaucuucugaguuuucugcuuagaaucagggaagcucagugcuugacaggaacgagcaguggcacucucaguuucacuguguuacaaaggagcccugaggaagggaggccgcuggcugcccaggugcccuggggggaaagggacuucugcugcugcagagaguggcacccgguggggccaggggcucugggaugguccguaaagcuccccaggacuucuuugaaggaugcuuuacagaauguuucugggagaccagccucaaggucaacccaucacaaacgugaggaccaggaaggaaccauggccaggguucuccauuugcuguagaguaucuggugauacagugagacacuaaagagucaucagccaguucaucuuuccucugccaauaagaguggauagaacaggaaugaaguguuacuggugguauuucaggcaucaggagccuuggaaaaucaucguaggggcccaugccugucugucccuaggcaccugggcagugccacagaggcccgcccacgacuggccaggggacagaacuccaguagugcaucccuguacaaccugcacauaacgguuauguauguucaccuaaaggagagaauauacuuucuauuccuauugcacaaaaaccuuguaaacuuugagaggugcugaaaaagccaauucugcaagcucuccuagaggacugacauuguaacauuagagugagaagauuucucugccacauucuuuuguguuaauccaggugugucuucacacccagugaguggaaguugcuggagcucgguacagguccacccagcugaaguggguucuuuuucccacuaccacuggggcaagggagugagccuagguauggucaccucagcagccacagucuuaaaagcaagucgcuagauuuuuugaaagucccaagagaagugguggucuucccuucugucaucccaguauauauaguuauacauguaaauaucuaaauaccccauguaaugggaaggcuauguacagggcagccuucccaaacgcugugagggcacagagcugcuguggcugcuccaccagggugugcugguggcucagcuuugggguuggacucccacguucaccucccccuccugguccaggcagaggcaccagaacccauccugccuuuucuccagugugagcauuucagggagccaccaucagccuuggguucaugagaggaagaaacccccaaagaccaaugccuggagcccacuucuccagcgacaccuucccucgccagagcaggcuccuaggagugcauggcaggggugccgggucccugugcacggguuugcuuucugaacauugcccaucaacaccgccuucagggagucccagaguaaccuacuaccucccccaucgcuccucugccccccucacccugugggcaccaacaccucccgcacacagaugaaaaccaucuacagagcccuucccgggucccucgacccagugguguagccguuaccaauguuuacaaccaggggccgccccuccuuagauguguuuacucgcauucacaggccaccuguugguuugaguuucaugugucuccuucccuggccuagguugacuugagcacacaacucgaucuuucuuccccuccaucaaggcagugugugaggacugugugggaaugacauuucuuguacauacuuagcacagcaccuagaguaugaacuuguacuauuguucuguaaagagggugaaauagagcuuauuguaaagugucgggagaaguauaguauuguauuuguaacaauaucguucuuuguauacacaaaacucaaugaucuauauauaaauauaaauaaauauauaaauaaaauauaucuacacgugagccuggaauguggacaccgcacacccacugaauguacuuccuugacagucuggucacuggucccucccucccucccuccuccgucccguggccacagucauccaguuugggguugugauguauuuacugugcuaucuaucuuccuuuauuuaacugaacgcuaaugucuguauaagaguugcugcaacaauaaacaagaacuuc

SEQ ID NO: 18789 - RNA, 2546 nt, Homo sapiens
gaaguucuuguuuauuguugcagcaacucuuauacagacauuagcguucaguuaaauaaaggaagauagauagcacaguaaauacaucacaaccccaaacuggaugacuguggccacgggacggaggagggagggagggagggaccagugaccagacugucaaggaaguacauucagugggugugcgguguccacauuccaggcucacguguagauauauuuuauuuauauauuuauuuauauuuauauauagaucauugaguuuuguguauacaaagaacgauauuguuacaaauacaauacuauacuucucccgacacuuuacaauaagcucuauuucacccucuuuacagaacaauaguacaaguucauacucuaggugcugugcuaaguauguacaagaaaugucauucccacacaguccucacacacugccuugauggaggggaagaaagaucgaguugugugcucaagucaaccuaggccagggaaggagacacaugaaacucaaaccaacagguggccugugaaugcgaguaaacacaucuaaggaggggcggccccugguuguaaacauugguaacggcuacaccacugggucgagggacccgggaagggcucuguagaugguuuucaucugugugcgggagguguuggugcccacagggugaggggggcagaggagcgaugggggagguaguagguuacucugggacucccugaaggcgguguugaugggcaauguucagaaagcaaacccgugcacagggacccggcaccccugccaugcacuccuaggagccugcucuggcgagggaaggugucgcuggagaagugggcuccaggcauuggucuuuggggguuucuuccucucaugaacccaaggcugaugguggcucccugaaaugcucacacuggagaaaaggcaggauggguucuggugccucugccuggaccaggagggggaggugaacgugggaguccaaccccaaagcugagccaccagcacacccugguggagcagccacagcagcucugugcccucacagcguuugggaaggcugcccuguacauagccuucccauuacaugggguauuuagauauuuacauguauaacuauauauacugggaugacagaagggaagaccaccacuucucuugggacuuucaaaaaaucuagcgacuugcuuuuaagacuguggcugcugaggugaccauaccuaggcucacucccuugccccagugguagugggaaaaagaacccacuucagcuggguggaccuguaccgagcuccagcaacuuccacucacugggugugaagacacaccuggauuaacacaaaagaauguggcagagaaaucuucucacucuaauguuacaaugucaguccucuaggagagcuugcagaauuggcuuuuucagcaccucucaaaguuuacaagguuuuugugcaauaggaauagaaaguauauucucuccuuuaggugaacauacauaaccguuaugugcagguuguacagggaugcacuacuggaguucuguccccuggccagucgugggcgggccucuguggcacugcccaggugccuagggacagacaggcaugggccccuacgaugauuuuccaaggcuccugaugccugaaauaccaccaguaacacuucauuccuguucuauccacucuuauuggcagaggaaagaugaacuggcugaugacucuuuagugucucacuguaucaccagauacucuacagcaaauggagaacccuggccaugguuccuuccugguccucacguuugugauggguugaccuugaggcuggucucccagaaacauucuguaaagcauccuucaaagaaguccuggggagcuuuacggaccaucccagagccccuggccccaccgggugccacucucugcagcagcagaagucccuuuccccccagggcaccugggcagccagcggccucccuuccucagggcuccuuuguaacacagugaaacugagagugccacugcucguuccugucaagcacugagcuucccugauucuaagcagaaaacucagaagaugcagagaucucggggaauugaucacagaacucucugguugaagucucuugucccuaaucuuguuauagucacuuugcucccuccuuagaaucccuccauucucucuauaaauacaugcuacccaccauuugcucacugaguuccuauuuccauagacacaacauaaauaucucggaugcagagaacagggacuauauuaauuacaaaauauaauaguuucucuuccccugucucuacugaggucaugaaugaaacaaaacaaaagcaaagccaaaucacaccucacaugaacacaaaaugcucuuuggaccaagugaaaacuggcucagaauuauaauauuacuaaaacaucuacacugaacugagacggaagcauaaauaugaggcaccugaugaaaacacggaacaauuccacaccagccaaaaaugcucucaggcccacaaggcagcaagaggguguuuauggacca

SEQ ID NO: 18790 - RNA, 13469 nt, Homo sapiens
aggugauugcaagucugccuuuaugaguuuuaagcaggacauuacagauaauuaagcaaaaagaauuggcagcuucagauuaaaacagcugagcgagccaacccucucauuauuagccuguugcccugaaugguucauucugaagugaccucuuucagcauucgcuuuggagggggccuccauauguuaaguuacccagguuuguuguacuucugccuucugauuaacuguagacucucuguguuuuggucccuaauaccaauaaacgucacauugcugucucuaaaacgcgaacuauaggaaaucguauucuacacccaaaacuuccugcacggcuuccuucacuggcaaaaaaaccccacaguguuguugaguuuggugugaauggcaggcgaggagguugggguguucaguguuacugcagccaguggggccgucugaacuguggcccauguucucagggcacaacgaugcuuuuguuuuucaauuaaaaggcuuaauauaagcagguguucacucgcuucccugcacagcucagccaaccugguuccgaucuggccagcaggcccccuuucccugaggccuguggcucauccacuuucaccacucacuaccugcccuccuuugccugagcacauaaaagagauuuuuuuuaagguggcucuuaagaaguugcaaaaggacaugaaaauuuaaaauucuaaaguucucuguucugaauuugggaaaagauaacagcaauguaauuuagguucuagucuuacaucuacucaauagucguagggaacauaccuugugcuuauucagaguuuuugcuguuuuauggaguuagaaucauuggcugauggaagaauguuaucaaauauauugaguuuauuuuaaccagaagccuacuaauucagugaauugaagccuaauuauuaccaaucaaaagcaauuuuaaaagcaaugcuaauaauagaguuaacauaagugcuuagugcaugcccgcuaucauucuaagcacuuuagaaaauacauuuaaucuuccuaacaaccuuaugagguuauacuauuacgaccauuuuacagaugagaaaacagguacagagagguuaauuaaaugcuccagggcauaaagcaaguauguggcagaauaagucugggauuuuaaccccaacugccuuucuucaggaucuguaagacccuacccacugcauuauugucugaaugcuguggugucuggagggcagugcugcucaagacauuaaaacagugauucucaauuaucugcaauaguagcaggggucaguaagauaaacucagacagcuuuggaaugggaacaaauuaauagaauuuaacuuuuuuuuuuugacggaguuuugcucuuguugcccaggcuggagugcaguggugugaucucagcucacugcaaccuccgcugcccggguucaagccacucuccugccucagccuccugaguagcugggauuacaggugcccaccaccacgcccagcuaauuuuuuuuauuuuuaguagagacagaguuucgccauguuguccagccuggucucgaacuccugaccucaggugauccaccugccuuggccucccaaacugcuaagauuacaggcgugagccacgccccaacuagaauuuaacaauuuuaaaauguuuucccugauucauugguuccaaagccauuuuucucaucaaaguguaucucacuucugaacacagaaucugaacuguagccucaagaauaacuuuuucuagaaaguauguagugauuuuaaagugaaaaacaaaaaaaucccuugggcacugugcauaacacuagaaaugggaagaugacuaaagugaucauuucaaaaauuaucccugagugcagaacucaaaauugacaguaaaggaugagauccacuugacaguggugacauaucuuggauugucaaguuaggagaagaacacauuuuaaaaccuaacuggcaguucuguagacugucacagaaagagucacaacucaauaauaaucuucucaaucacuuaaaaacaucugguaaagaaagcauuagcuaggaggaugacuauuuugaaagucauuuuccucuaugggaauccaguucucccaaaugguacacuguauuuucuggcaaguucuguuuacugucugguccugugucagcugcuuuuauuaugccagagaaaggaauauguggcagcucaguccucugcaugaaagaggcaacccuucaacauaucauuaaggaaggaaaagaagaugggccgugggcucugugggggcugugaaauuaagauucucaguccucuaucuguucugcccaacuucugacaugcacguacacccagacacccagagacagaaauuggguucaauuacuaggagacuucuaaacuauucaugaggucuugcugcaguucuuuccagcagaguugaugagcuacucuuccucuuaaaucaguguuuucugcucauccaagaugcacugcugucuacuucauugcagaucaggaaucguuugguuauugagcacagggcugaaauguagacugucuggguaacauucuaauuuuccugagcuaaguuuucauauugugaccuugccauuuuuaugggugugcuuagugccuagaauguaugacauacauuugacuuacguccauguacucauucauuucuccaguugacaaguauuuauuuagcuuggcauggugcuaggccuuaagggguggaacagaggccaagacagacauagucccugccccuaauaaugcuuucauugucaugguacagacagaugagaaagaguaugcacaaucaaauaauuacuaacuuuuaaaguacuaugaagaaaauaaagauaggcaaagguacugcugccuuuuagauaagguauucaggggacccucccuaaggaggcagcacaggggcugggaucgcgagugugugaaggaggcagucaagauaagaguggacgaaagagugugcuuggcagagagaauggccuuugccaagcccugaggcaggaaggagcuugguggauucaaggaacugagguggaggccagugugaugcaagguucugagcagggaagaguggccgaguagcgugacagcagcgguucccaaugggggcagauuugucccccaggagacauuagacagugcugucagaacugaggggaguaggugcuacugguaggaggccagggacacugcccccccaccccccgacaacaaauacucaucagccccaagugucaauagugcuaaguugagaagcccugaguuagagaaauaggcagcagccuagacaaagguuguggacuagaggagaaagaagaaaacaaguuugagauucauuucagaguugauauugacuggacggggccaugguuggaugugggggugagggcaugguaggaaugauugaucccaggauucuaauuugagcaccuggguggaugcugugaccaucuguugagacagagaugaaugguaggggggaaacaagucuuccaauuuggacaugugaguuugagaaugucagagaggcaaguggguggcuggacauggacuugggacucaaggaagaggucuggggcucagcuucaauuugucaaauugcagaugcauaggcauuggugaaauagauggagaagagaggccucaggaagggggaacauccauauuuugauguugccuccuaagauccuuuuccacaguuauauuccuaaaauacacaaagcuggccaagucacugccuuauuaucuuccauuggccuucugguaccuucagaaaauauccaugcuccauagcguggcaugugaguccuucacagccauccccauugggugggucuugaccaucuccugccauuaucuuggacacgcaccuaacugcggccgcacugaaugcugcaccuuccucuuuuccauccccauuccuucccacgcaagcugaucacucugugaugucuucauuccagaaacagcucuaucauugccuuuguccacccucccaggcaguggcugucagucacccuccccagccucccucagcacccugcacuuaacccuguuaugacacaggugacuuuguuuuguaauaauuguuggcaguuauguccugccaacugcacugugaguggcuggggagcaggagccuugcccaauuauuuugacauccagagggucccacgcagcgucugguacagcauccaaaggauguaucacuuuuuucuucuuaauucuaagauuguuauagauuuuccaaagagauauguucuugagccuacaguucuggaggugcaauuagaggugaaauauggggcggggcuggggggcugaagagggauagaauuuguacuguggauguucacagaaagaacacuuugaaggugcucaguuccauucccuuggcuuuuucuguuucaaaaugguagugauuaccugaguugugggucacuguacaggcauuugaaaguuggcucuuaaugauguggcauccugaaguccccucaucuguagucuacagauggcuugugaucagcuguuccuggaagaacuucagcaaugaauuuuaaaaggcagucuuuuuccaacacugucacuuaaagguucuauucuuuccagauguuggcucaauuaaaggcagcccuuagaugacaguaacuugucaggggaggucaggauuugggaucguuuggcagcccauuucuccagaacaaacaucauagucaaugcccuuuucuuuguaacaugaaagaaacaagaucaaugauuguucagguuugcuauuucaaagagagugagagggaacaauagccuagcaguuuuaaaaucaacuguaucccucucaaaaucauagaggaguguagacuuuauagcugcacuuaggacccagaaacaggcauugaugagaacagacagaacauuggaccuuacucuccgucuuccuuccucaccagcaguggacugagaagggaguguguggccagggccaucaggcuggcugugccauugaugagcucauccuugugcaagacaauggcugagcauagaaauauuauaguauggcuugaguauuaaaucuaacacuguaugagaagguaccaggaagaugguaauuggcuguacaaauaucaaauugcuacuauugaugcuggcuccccaccuacucccaauggaauuuaagcccuaugagaauggggacuuggcaguccagguauuacuagaauucaauacuuagugaaggccccaauaauacugccaccuacuccauauugggauacuguucaaaguauggaauuggaaauuucaaacccauuccaauugcagauugggaccccauucuccuucugugguaguccuuauuauugacuauugaagguggaagguuguuucaaaaagcaguggaauucuguggcaaaaggaaaucuaaccuucauggauuaaagacaccuuuuuaaaaagccugugccuagaaagugaauuuuuuuuuuuuuuuugcuuuccgucauauuaaauaaaaacgacaaauuuucuguuguagcuuuaccaucucucagugucugauuuaguuugaggaagcuauauugggcuucaagaacccuuuuuccucaucugucucugacuacacauucaaacuguucuuccugggacaauagaguuuuucugggcagaagcaagugccacccucuugaaggacagagaguacaguagaauggggugaggguguaugguugaagacaguaggguaagggaaggugggagugggcagacaacaucuaaaacccguucauggguuuuaaagaaaaucaugaacaaacuaagcugcacaaucagcauagucccucgccccagguuauuucuuuauuuuuaacuuauuuauuaauuauucuaaucuuggagacaagucuguucucccauuccugacccccaacccaguguucuuuggaauauuugauuuggauauaacuuuaagauuacaaauuagagggguuuuaaaguuguaaauacaaaagagauuuaaagcgguaaaguuucauuugagaacaaaaucaaaggauggagucuucugagauucugcuucauaaaaaacaaaacaagacccuguuuuccaaggaaguauucaauguaauaaaaacaucaaacguuuccauuuccuuuggaauuugggguaugccaacucaagcugcauugauguuuaucucuaugcuuuuuauucauuuuuuggagaaauuuuguuuuuagcauaugggauauguacacacauacaucuacacacacacacacauauguauagcuuauuuuuaagugugcauuuuuuuuguuuuuuuuuauuaugaggguccugaauugcuucagaugaguuaauagaugggugggaagaaacuacacuuuaugauaaagcuccugauuuaccuggucaagggaaggcugucuuaccagaagccagguggccaugccgagcagaugcagcaugucucaggcaucccuuggcccucagagucccuaguggggacacacaguggcugguauacaaagcagagucuggucaaaucuggggcaccaggccgaagcccuuuccccucaggcuuccauuuccaugagagaggaauuuaaacccacagucuacuccuggaauaggaaauguuacagacauccaugcccuuccugcuuauugacccaaauucagccuuagcgaggucacuugggccggaaagcguucagcacccagauggccuggaacaguaucuuuguuuccagcuuuccagccucagaaugccugucuccccacauguucucccucaguagauaaaucugggcaccuguuuguguuaggcagggauacagcagugaacacaaggaacuuggcccaugaccucaggaaaccaaguuaagggguucugugcauuuuagcacuuuacuaaauuaccuuuaaaaaugguuaucccaucuuagacguccccccgcuaauuaggggagcccuguuuuuccgaguccucaagaguacuaagcacugcuccuuuaaaaauguuuuaacagcuagauaggugaaaaugccuuaguuuucacuuuaauuugcauuauuauuguaaguuagacuuuuucagaugauuuuuauugauuuauguguauuauuauuuaugaauacccuuugcugucugauuuguaagcacuaauauauuuagggccuugcauuuuuguugcagaugcuuuuccauucuuaaauuagacuuuuacuuuuccuuacuuuguguuuuuuuuuuuuuuuuuugacccaagcuuuuauauagucaaauuuguuaauaguucccuuaaggcuuuuaucuuugcucuuauuuuguaauuuugugcuaguaaugccuugcuuuaauuuuaauaauuuguaaugcaagacuucccaugguauucuuaauuuucaaaaauuucuuagugauguuuuuacauuuuuucccucuaauugaacuuuagaauuauaaggucacuaucucuaaaaaaauuucuauugugauuuuuguugaaauuauauuaaauuaaugaauucagaaagaagcaucuuuaaacuuguauuuuuccuuccaagaaugaaauguuuauguauuuauugucuuuuaugcuccucaguaaacuuuuauuuucuucauagauuuuauaccuauuuuuaguugaauauaugucuguguaacuuaugugggguuuuuuguuauuaauguuuugagguuuuuuuuuucuuuugcgcaugggauuuuuuuuuccauuacauuuucugacuggggauacguuagaucuugauuuaugugaguuuauuuuguaaacugacaaccuguuuuuuuuuuaacuauucuacucgguucaugacugauucuuggguauucuagguagcaaucauauaauguguaaauuaucauuuuucuccuucuaaccaauauuuuguaauuggcuugucuuauuaauuugauauucaaaaacaguaucaaagaauucuugugauaacagcacagccuugucuuacuuguguuuuaaaaaacaaaugccucuuguacuguuuccaagagugcauucuuuguacacacaaguuauuaauagauacauaaauaaaaaucccuuggucacguacauuugggaagugucacucuagugcuuccauuaguauacuguugucuuuuagcuugaaacauuauuuucugcauuaagaaaguuuuuuucugccuccaauuuuacuaaaacuuuuuuaaaaaucauaauugaagggagaggaagggaggggagcaaggguugaaaaaacuauugaauacuguacucaguaauggggugacaggauugauugcaccccaaaccucagcaucgcacauuauaccugguaacaaaccugcacuuguaccccugaaucuaaaauaaaacuugaaauaaauuuuuuaauuaauuaacuaaaaucuuuauugaauauuggcuuuuucauauaauuuaagcugaccauggaaaggcaauuauuguaaacacaguuagcuuuuugagauacuccaaguacuagcaaauaauaaaaucauguuucucuuaaaauauuauuuaauucagauuuuauaucaguuuagaugaaugggaucauuuuauuuccuuauaguuuggagaaugucuuaaaauuucuuccuaugggucuacugaucacuuccccauaccagaguaauguguggaaauuaucuuaagaguuagugcuuuuugcaaguuauuuuggggugggcaguuuguugaaaucauugagaaauuuugguuuuggcagaggggaaaaagcuuguguuucuuuugccugaaagucugugcuuuuucaucucuguuuuccuuuuauugagaauuuuaauguaauuucauguuauauuugggccuaugcuucuucauuugcaaaauuuggggugugguugacugcuaaaugccauugaagucucuugauuucuuggugguggugguuuuguuuguuuuauucugugaucaucucuugcagcagucauuuuaugaaggccaggcaggaugccuugggacggggaaagagaagaagguaaagaguggggagaagguuacaucuccuuucgagaaaaccugaguugguuucccuuuggugcaaaggcaauaauaucuugcauauuuucccacccucccuuaaacacccuguggauuaggaacucaaaugacucuauagguuuaggaagauuaauccucugugggaaaaaguagagauuuucucccccuuuucuauguucuuggcaaagugaauacaacagaaaauuaucaaaaucugucaugagaguuugaauuuaggaaaauuaacuugaauguguauaaaacaugacacugugcugccaucccaccggcccuucaagccuaggggagcccugauguaaccagagccugagauggagacgucuugcagaaagaggaggagaaaugccagggugcuguauuccuguuagguccagccauggucgucuccauuccagagaggucaugacaagaccauuuucuacccagauggccaaguguguacucuuccuuguuauaaacucaucacccauucauuuauucaacaaauuguccucuaggaccacuuucugggaccacacagaugcaagccagucuccuucauuucaacccagugccaauuagcaucaacucuuggggcuagugggauaaagagugaaaauguucgggugccucaaguaaacaggaccuaaaaguauugaaaguauuucacggcccggcacaguggcacaugccuguaaucccagcacguugggaggccaaggcgggcagaucaccugaggucaggaguuugagacuagccugaccaacauggugaaaccccgucucuacuaaaaauacaaaaauuagccgggcaugguggcgcaugccuguaaucccagcuacuugggaggcugaggcaggagaaucgcuugaacccaggaggcggagguuguagugaacugagaucgcgccauugcacuccagccugggcaacaggaaugaaacuccaucucaaaaaaaaaaaaaagaaaauauuucacacuugcuauauguauuaguuucuuauugcugcagucgcaaauuacugcaaacuuagggacuuaaaaacauuuauuauguuauaguucuguagaacagacauuuaguauucuucuggcugggcuaaaaucaaggugucaguguggcuguguuccuuauggaggcucuaggagagaagccuuuuccacaggggccacuuacauuucuuggcucauggccgcuuccuucaccuuuaaagccaacaauggcagauugagucccucuuacauuaugucucacucacccgcuccuuugccucuucuuuuuuuaacucuuaacaacccauauuauuacauuaggcccaccuggacagucuaggacaaucucccuaacucaagaucagcuguucaucaaccuugaucguauuugcaaccuuguaaaguaacauuauauuuugccuucuaagguuacauauuugcuggcucuagagguuaggauguggacaucuuugggagacauuguucugucugccaccauauaauuucacaauguccuccucugugcaucugcagcucuuuguuaugccuuugucauuacugucagucugucugguacucucaguagauaccaacugugauccugagguguagacaucacugucucaggucuguauuuccuucuccucuucucuuucccuuuucuacuucacuccuuccauaaaaucgaugugcucaauaaauguaccuucaauaccuaagucucccuguaaucaacuuacauaaauaagaaaucacuuucugggacauaaacaugaaccuggcuucaaaugcaacacguugugacugaaaagcaaauguggcucagguuacuacuguuaacaugaagcaauucauguuugaacagaauuuucaaaaucaaauuuugaacucacugcuggagacgauguggcccccuucauuuccuggauuauuaugcaucucccacagaaccauuugcuauauuauuucuuugguguuuacagaagcagaucauguuuaugaagcauguccagaagaaggaaaugauauauggaaaaucucuacgugggguauagagucaagugaucccuagguuacaguugagagcuauaaauaggccagugacuucauguguaccaugggacugguauuuuccaucuuucgucccacaguuuggauaaacuuagauggauuuuuuaauaguucuuugaaaauggaacauuagcuauccacagagauuuaacuugggacaaaaaaaaggaauaaaagucaucauuucugaugacaggauuagacagaccuuuuuucuugaaaguaauugaauauucuguguguuuuuugcaguuucuguugaauugagaauagugaccaucauuugagguggaaauagcagaaaugauuaauuuagaaagaagaaggauuguaggguggguggaaguggcauuuucugcauuguauucuuagaaacuuagacuguuagaguuggaagugcucugauaaaaccguucuuuaacauacgagaaaacagaggcccaaauaccuuaagucccuuguccaagaguaugcugagugcagaaagccacacuguggcucagguccugggcccuggcccucagcguuucucagcccacugcacucaucuccagcacuucugauggacucacuggggugacaccaucaaaccaugugccccaaagaugccuucauguugguuuccacuugggcauuucucaugcuuggauggcuaauauacucccugccugguuuacucuugagaacccggcuuucaucugcugugggacacaguagccuuugcgugagugccuacgugcacauguguccauggaggcagggaggguggacaggcagggaggguggacagugguacacacacugcaccagcagcacuuuuaaagacaaggaucaugacaaaagcaacagcaagugcacuuucuuuuccaaauuacccaagguuguuuuuuaaaaauaguaauaucacuucaaguguuuugcacuuggcuuggugaaacaaaaugugaguuaaaacuguggaguauuaaagcauuauucuugacacaccuacaauaugagacacuccauugauguggauagcauauaugcagacaacaagcauugauguuguacuuccaccuauagauagaagggggauguaccuugguaugggaguuuugcacuuagacaaagucuuaguucucaaccagagcugauuuugcucaccaccccuccagagggcauuuauuacugucugcagguauuuuugguuuuuaugucuggaggaaguggugcuacaggcaccauuuguaaagaccggggaugcugcugaacauccuacaauggacagcuccacacaucaaagaagucucgaauccaaaaugucaauagugccaaaguugagaaauccuggccuacaggaauuuaugacuuaucugauacugggcuuugaaggcuauauagacaguugauuaauuuagaaacagcuuggcuuguggaauaaacauaccugguauagucugugaacugaagugagccaagguggucccaguauugcuuccacacuugcugucucagaucucuguucucagugaccagaguuaaaaaccagcuucccucugcccuucacgucuguggguccuaugguugaggauuuuuauguauuguuuuucuuugggguccugauaaagcuuagauaaccaaacauagaauuuuuaaaggugauugugaauacaaagaacuaaggagugccuuacccugauccauucuuuacacaagcagccccagucagggaacccuaugccaggggaggaauugggccucagcauggacaagucuuggcaaagaccgcuauggcagcagugucugaaaaaggaaaagaguccaaggagggaggaaaugacuaggaggcugcuagagccuucccucagcgccauguucuacucacagaccaauguaguaaaaaugauuuguauuuccuuguuccuuuuuaaauuuuugaaaaaaaauuuccauauuuggggguuuuccccauugccaggugguuacauuccaaagaaauuauaucaugggauacagacacaaguauuuccaaucaugcuuauuguguagggcugauggcaaggugauuccccuccauggccacacaucauaaccaggcaagcccguuaaguaucagcaacuggaaguccagcaucaggaccacccaucccucugucaggcagccccgguugguggugguaaauggaggagacugaggccucuuucacucacuuaaauucggagagugagccacucuacuccuguugggaaaaccuauuuccuuacccaacgagacuguagaaaauuccccucagccauauaccaugccagguuucuuuuacaagccaaccuguuucca

SEQ ID NO: 18791 - RNA, 2496 nt, Homo sapiens
ucaugaucugugguuuucuuuuuaauuaucuuuagucuugugaucacacauaauuuuaaaauuuguguauaucuccguuacuuuaauccuuuuaaguuggcaaaagcaccauucccaaucaaauacacaguucuacaguuuuguuucugaauggcuguuuaaagacaauccuaaauuauaacuuaguuugacuuagauuguaaagaauucaagagugaaguuuaacuugcuacuauuuuaaaagcaugugaccuuauagaucuguaagaugugagagguguugaauaaucuuuaauauuacacauaaaccacacuaaaaugccuuucaauaaguaaaagaaaccauuuuaaauacagggaauuauaauuagauuggcauaguuaaggccaaaacuauagacauugcuaccuuauuuaucuucaacccuugccuuuaagaggcaaaugaacaugaacacaaaacacaggugaaucuugcuugguucuaagacagugaagcaauuuccccaguauuuaaauauauucacauaaccaguuauauaaaucuaaauauaaaaccaaucuccaguaaguuuuaagauggcacucaccaucuuugugaaaaguugaacauuacuaacgaagucuaaucauaucuuuaaaagggguaaacagugauaccauuuacugaauuggaguuacuauuaaaauucaaaaacugaacauauucauuuaaccacaagccagucuuaguuuuaaaucaggacugcccaacaaaauauucugucagucauucaugaucugaauucugguguaugagaucuauuaaaggaugguacacauaaaaaagucaugagacauuucuguuuuguaauaaauaaggcaguggccaauuauuacucauuaguagcuuuuuugagauaagcuauuaagucugcccuuucuuccuucuucuuaaugccgacaaagaucauuuuuguuccagggauguacuucuugggauucuccaaauacuccaucaguguauccucuccccagaugaugccuaaacaagaaagaaugcaucgguuauuucacacuccugauaguuugccacauguuauauuccugcauuuuguguuguuuuauuuaacaagugacucuuaccuuuguucuuauuggcggcuguguaagaguauccaggggccugaccugucuuccgcccaaagagaccauggagauuuggcccagucuugugcuugccucccuuuucaacgguguggcacugggaacacuucauaauaaaaaucuucuugccuuucucaacaucacccauauuuaauucuaaaaacgaaagcuucaacuuaguaaauuuuuccucagguaacaaauacaguguaaaugaaugaccacucuagccacuuaauuaccaauccauugcuaauuuaugucauuaaauaccagaaugaaucuuguuuugcuuuaauacucuuuauaccaaauauucuuuaauaccaaaaacauuuuuaggaguaccuccucaaaaacguauuuuuguguguauacgugaaggaacguuaaagcccaagcaaagagggaaccuaauucaaacuccaguuucagaagagacaaucauggucacgaagucacagaucugaagcucaagggcgaacacauuaagccaaaaucaccacaaccgcaacuuuuaaaaagaccuaaccauuuaaucuuacuacaauguaaagccaccucucccugaggauaacgcaaagcacacaaauguuuaaaaagcgguccuggcuguuucuaucugcccaggucacaggaguagcuugacacucgaacuugugaaugggagcucaggggcaggcugcacggucccccggggacaucccaacuccccuaccugugaucuccuggggcgaccacgaggucacccguccaggucgguuucaaggugauugaugaaacuccuucuaggaugucagaacgacugacggaagaaacaugugcccacgaaaagaacuggccccuuauuagaagagcaacagcuuuugcccucugaagaagaacgugaagcucuaagcuucggcuuuccaggagggaagucuugccuaucauuuccauagcccuucagcaaccacuacggaagaggccgccuccuccucggaucuguauccaagccgccuccagucccugaccgagaccauaccugucccuaguuagggcuccgccgcaccucaagccguuacucgcccagcucggucugaccacaguccagggucuucacuccccgcccucccacccagcgcgggcuccacucgaaugcuccccgcuuggguuucggucgcucgcaagugcgcgccucccacagcucugccucuaaccaggugcggccuccgcgacccgcucucaccucuuuuuagucgcuggcacaacgaacacucccgcuccgaagccggacguccccacucucuaaguccaaggacacgccgguccgcgcuuaaguaccgguguaagugcaaccaaacucgcucc

SEQ ID NO: 18792 - RNA, 2169 nt, Homo sapiens
uuuaguuucucgaacauaguagaguuuuuguaaaauuaauuauguuacggugaagauguaccucaagauuuucagcacaggcuucccaugguauuaaagauuugauaaaguggaaaucgggauaagaauccucauucuggacagcuacuaggcuagaaucacuaaggggaacaguaaugaaugaaaauuuauuagaccucucuguaaugcagaauuuaccaucuguugcacuaucccauuaguuuuuauuaaauugauugccuuaaccuggagagaaaggauauuuuugugucugccaaccucaacuccacuuaccuuguaauaaauguuucauuccucuuuucauuuuucuucccagcugucagccaagcucaguaaccuuccaacgcucauuuccaugaggcuagaguuccugagaauccucuguagccaugagcauuaccucaaucugaaccuuuuuuuuaugaaugcugauacugcuccaacaucuccuuguccuuccauaucuucccagguaauaaaagaauuauuuaacuaaaagaauuauucaagcuauuucauuuaacuagcucaguuuaaucauguauuuccuauaaagguuagucuuauuaauuugacaaaaaaucaaacaauucaaaccagaucaaguaugcuacccugaaguuacaccacuagcuaagaauuaacaaucuaaguaauugguuucuccccaggcucaaggcucccugaucagguuaaguaaagccaagaauccaauaagcccuaugaaauuuagaaacucauagaaaagucucaaaucuuccuuugucugacauuagccaauuguuauauuaugcaaauagaggauuccaaaguaaauaaguuuuggaaaccauguauucaccagguuucuuugcagcaggcccucuaagagguuuuaacuuguucaugucaauugcaaaugcacgagaagcagaagaggaaaugggaggaggugugcaugauaagcagugauuccccaaaugauuuaacauggaaaccccaccccaccucauacauuuuuugaaauguuacucuggaauaacuuuaagaacaugcuguuugauagucacauuccauuuauagggaacacaucaguagcucagagcaucaggcaaaauuucucauuauuagguuauauuucuguugcauauuccuugauacuaguacaaaagugaaggcuugucuuacuaauugaaaaaaaaaucuuagccauauaugccauauggcaugauccagauauuagcuacaugaccaucuuacugugaacagggaaagaucugacucacaagcagcaauucaaaauguauaaacuuuuugcuccauccugcccagcagcuuaaguccuaaaacuucccuggacuaagcuuacccuagguucuuucccaccuuccccuucugacugccccagggaguggccaaacccaggggccaggcucacaaaaccaugaaggauuucuaaagacacuuuagaugcucuuaaugaaauauaaagugugcucccaggauacaaauacaggacaggaauuacugaggaccgguaaaucuaauacuucccucccugacaucacuuguaguuccaggccagcaaaagucugacaaugugcuuaagccaaauucagaaguguagcugaggccgggcacgguggcucacauuuguaaucccagcaucuucggaggccaaagggaguggaauacuugaggcaggaguuaccagccugaccaacaugaugaaaacucauaucuacuaaaaauacaaaaaugcaucaggugugguagugugacuguaaucccagcuacuugggacgcugaggcaugagaauugcuugaacccgggagagggagguugcagugagcugagaccaugccacugcaauccagccuggguaacagagugacacucugucuuucaaaaaaaaaaaaaaaaaaaaaagaagguaccugaguaagcagggccuuaaacaaagggggcauuugguuacagaggaauugccuguucccagccccaggacugggugagguucuuauuucucuguccaacuuuuaugcuaggauuuuuaucuucagcuuuugauuucaggugggaaagggagcgucauucauuuuucaacagacccggggugcuuuauuuucaucuuucccgcugggcag

SEQ ID NO: 18793 - RNA, 1206 nt, Homo sapiens
cauggggaaggugaaggucggagucaacagauuuggucguacugggcgccuggucaccagggcugcuuuuaacucugguaaaguggauauuguugccaucaaugaccccuucauugaccugaacuacaugguuuacauguuccaauaugacuccacccauagcaaauuccauggcaccgucaaggcugagaaugggaagcuugucaucaauggaaaucccaucaccaucuuccaggagcgagaucccuccaaaaucaaguggggcgaugcuggcgcugaguacgucauggaguccacuggcgucuucaccaccauguagaaggcugggccucauuugcaggggggagccaaaagggucaucaucucugcccccucugcugaugccccaauguuugucaugggugugaaccaugagaaguaugacaacaaccucaagauugucggcagugccuucugcaccaccaacugcuuagcaccccuggccaaggucauccaugacaacuuugguaucguggaaggacucaugaccauaguccacgccaucacugccacccagaagacuguggauggccccuccgggaaacuguggcgugauggccacggggcucuccagaacaucaucccugccucuacuggcacugcgaaggcuaugggcaaggucaucccugagcugaacgggaagcucacuggcauggccuucuguguccccacugccgugucagugguggaccugaccugccgucuggaaaaaccugccaaauaugaugacaccaagaagguggugaagcaggcaucggagggcccccucaagggcauccugggcuacacugagcaccagguggucuccuccgacuucaacagcaacacccacucuuccaccuucaaugcuggggcugucauugcccucaacaaccacuuuuucaagcucauuuccugguaugacaaugaauuuggcuacagcaacaggaugguggaccucauggcccacauggccuccaaggaguaagaccccuggaccaccagccccaguaagagcacaagaggaagagagagacccucacugcuggggagucccugccacacucagucccccaccacacugaaucuccccuccucacaguuuccauguagaccccuugaagaggggaggggccuagggagccccaccuugucauauaccaucaauaaaguacccugugcucagcc

SEQ ID NO: 18794 - RNA, 39036 nt, Homo sapiens
ccagccacaaccgcgcgcacucucuuucaaacauacacacucucucacuuaaagacacauuuaguuuucggcaaaacggcaucucagcgugcgauugagaccggcaucccaaaccccacuuuugagcagcccaaacguuuggagccccuccgcuucaucacuuucugaguggauagaggaggcccgaagaagaugcuaccuaccagccucucucaggggcgcaggagagggugguagagagaugcuuguugccccuggaaacugcaaguaccccccaggugcacgccccgucaguggggaggcgguggcaacagcaacgauaguugcaucagcgcuaacugcugcugcugcugcguguucugccggaggcugccgggaggguacaguaaugacuguagggagcgcacagccgcugcggcggcagguucccuggaucaggaaauuaggacaggcacccgggauuggaggcgagggcggcgcgcgagccaaccagcggucgccccgggcccccgugagccccaggcgaacgcgcggagcagccgggccccuagagcgguccggguggcggcggcggcagccacgaccacgaccgcggucacucacgcacgcucacacucgcacgcuccccgcgcgggcacccggcugcccggcgcgugcaagaggagcgcgucgagggaaaggagggccgaagccgccgcgcucccgcccgcccgccgcgccucccguugaccacgcccccuccggcccccuccccgcugcucaccccgcucuccggccgccgccggugcgggugcuccgcuaccggcuccucuccguucugugcucucuucugcucucggcuccccacccccucucccuucccuccucuccccuugccuccccuccucugcagcgccugcauuauuuucugcccgcaggcucggcuugcacugcugcugcagcccggggagguggcuggguggguggggaggagacugugcaaguuguaggggagggggugcccucuucuuccccgcucccuucccccgccaacuccuuccccuccuucucccccuuuccccuccccgcccccaccuucuuccuccuuucggaaggacugguaacuugucgugcggagcgaacggcggcggcggcggcggcggcggcaccauccaggcgggcaccaugggcacguccgcgcucugggcgcucuggcugcugcucgcgcugugcugggcgccccgggagagcggcgccaccggaaccggugagugaggacgcgccccuccgccggcgggcgggacccagccggggcaccgggagaccccgaggcguaggucuccguuugcccacccgccuccuaggaggcgccucucgguucuccucgccuucccucccuccccuccgugguggcgccucugagcugucagcgccgaggcuaaagggagccgggcuuggggaacagcgggguucggggugccccgacgccucgccugaacuagucuucugccccucacuccgccucccccagagccgcugcuucgccucguuucucgcccucuugacgggcgccgaggugcgugggcuucugagcauugaacaaugguucugccuccucugccaggcgcaguguugggaaggaggcagagggccaagacgugugcggcagccucgggcgcacccucgaaccccggggagugcgggagcggacggggggagaaggugagcgccuccggggacgcggagcgccaggggccggccgggcuucagagucuuccggcggccgcgagcuggcgcacguucggugggcggcggccgggaggcuccgcggagccgagggcacccggacugcgacucccccggcgcggggccgccucuccggcgugcgggguaggggagcggcggggcuuuacgcaggacucugcucugggcgcuucuccucucccuuuuccccgccucgggcggcguuuggaaaccgcucgggucucccguguagcugaacgcggagggggaguggaggggagacuuaaucagguuaguuugcugacccuccuucccggugacguuuccucgagaggaauugaguccuaggcuagugacuguaauuagccuucauucuacacaauagcucaaaggagcagcgcgagagcgagcguguggcccugucuuguugggaagggcggcggugacuacugucggguccccagacucugccgcgggggccugggggccccgccuggucgucagccacguucccacuuggggccucguaacuuuccuggacaggcgacaggaagccuuucugagaggacucagucggaauccuagcgcguccccgaagugaucuucagaugugacgccgaggggcuugcuugccagcugcagggaauugggacugaaagccgcccaggcccuuaacacccguuccagagucccuggcucccgucgccggguggcuucaggggcccugccggccugcagucacgugcuccugaagugagagcgaacuuuaaagcauguggucaaggagccugucgggcagcgccugggguuuuuacgucuccgaaugccccugcccuuugguugccacuguccggagcgugugaacugggacuggccuuuccgcccucugcgauugguuagcggugcgaucacguuuagguuggucacaugguuccgcggacucuuaagugggcagcaugggcaguguuauuuucaauggaaaguaggagacuccacaggcucuuacgggcuguucucucaaaugccuuccccugccuggacucuuugaagaggacgaauguguagugaacauggaaucugauguguaacaagccugagagccuagaaaagcucugcuuacaagaguuuccaaacgcuagcauuaaucauuaauagaugaguaauacuaacuuauuaaacgauuucucaguauagugccaugacuugcauuaugccuuuuguaacauuucaaaacgcuaagguauaccagaaggagggacaauuauccaggaaggugagagaaaaguuucguuuuugcugcaugucccuuccacuagagguuaacuuuaccuuauagaaugcuaggaaugcaccuaaacuacugacaugaguuagucaaagccagauguucaccuuguauugggcaggugaggauccuuuucacuuugucacaugugaaauauuugacaugccaugaacaauggaaaaacaaauucuucaaaggagaggaagcagauucuuccagaacuggaggaaauuugggcugaggcaguuauugacccuaaaccaaucccaaccggcaucugucuuaaguucaaagucucagggcaugugggcugacuuucuacccuggagcuucuacacauaccccuucuguccacuggcacauggugcuguuccacaauacuccuggacaagacaggugaacacugagacucuggcaaggaacuuaaggcuaacaagaaguugguauaccugauugcacaauuccuggggguucugggacauuuuccuucagccuaaguagucaagauuaagaucugugguaugauauauucuuuaaggccagagucuaaaagaaccaagguuuuuugagagcuauucauauauggcuagcaacuagccuaagaauagaaagaaaauucccucauugugagaaguggguuggugguacuggugguaguaauagaccuggagguaggaaacugguuggcauggaaaguaaacuuggcucauccagauagcaccaaugaagguaugacgaugauaguaccccuuaucaaagacugaucacucaugugagcagggacugcguaaaggaaggucaccagccaagcccuccuuggcaguaacagcuucaugaaauccaguguagcuuuguucccuggaucacccucuugcccacuuuauguggcauuuaccuauagugccuguccugugucauuuugauuguuugcuuuuauggccugaguccccagauacuuaaagcauguauaaaggucaaguagagcugccaaauauuaagacuuuaguacaauagacugcuauuuaacacuaaacauugcuagcaaaggugacagucuccaugcucaaaagaagugaagaccugauccaagugucucuaccugucauaaaauugaauaaccguaaacuugacuugaguaguuucauuacaguuuuggaagaggaaaaaaguuguuacaagccccuucugcuccaggagagguaucaaauugauaagacuuaacaagaacuccuagaguagaacaugaccauaagaucaagggaacacauaguacccagccguguggcuucggguuuugaucccaaaccuugaagacuuggcacacagcauagaaauacagcuaauucauuuuaaauaucuagcccauuuucuguuucucacagaauguaaauuuguucuuuucagugcagggaaaaguguuuaagacaaggcaguugccuacgugacuuaaaguaaugauugcauucacuuuggauacugacuuucauuuggaaaaccaccuucacauacuagccuauaagaaauuaaauguauuaaagggcuugaugaggucuauaaugauguucguuguaaauguaccugccuuagggagcuccuugugguggcuaauacaacugcccucuacaugguuaguugauaaauucaaaauugcuuaguuuggucccuacuaauuuaaucucaaaagaauacuuggacaacagagugauagacuacuuucaaggcaaacaguccaaaaauacugucugcugagguuaugggcgagauauacuuguuaagcggaaguaaguaguccagggacaauuuuuucugccaccuaaagaguuuugggcuagaaaaucugaggacugauaguuuuucugaagaguuggggcagagucuaaccuagcuauaggcgaaucuggcuuuuaaguaaaaaucaucucaauuuuacugucugcauuuuucaaacuaaaucagugucucuuugcuaaguucgucuauuggcuugcaacaaaaacucuaaacacuguuaauaccacuuaguuaaguacacuaacugcacugcaggaaccaaaugagauggcaggugauaacacagguuaaguguccuuuaucugaaauacuugaaaccagaaggguuccacagaguuuagauuuuuucagauuuugggacauucacacauacauaauaagguaucuuggggaugggacccaagucuaaacaugaaauucguuuauauuucacauacaccuuauacacauagccugaagguaauuuuauagacuauuuuuaaugauuuuauacaagaaacaaaguuuugacugcaacuugucacgugaugucagguguggaauuuccacacuuacggcaucaugucagcacucaaaguuuuggauuuuggagcaucucagauugcggauuagggaugcucaaccuggaccauaaauuuagcauacuuuuccccuugagugaagucuccuaggaaagcuugggcccaacaguuauuuugagucucuaagcaagagaaugccuguuagguccugugagaguaaguguggagauucuguuagaaauguuucaaugcuugcuuagagauccuuugccuacuuuguaguuuagagaugcuggaaacuauaagaugaagccucuggcuagagcagcugauuuugccaacuugggggccaucuggggagccuuuauguauguagacgaggugguggggauggggggacuugcaauuugccaaccaagggacauaacaaagccucggcgauagacagcauuugugaguuacaucacaaguuuguuagaacuuaauaguucucccacaugcugugaguaaacaggguuucuauuuuauagacugccucuaaucuuucauuuucuuaagaaagacuuccccacaucugagguauuaacugaucuguauguucacuaaguagguugcagauugauguuggucaucuuugugcaucuucuggaaaccacuuaauguacaucuacugaguaccuaccauauggcaccaggcauggggacagagugaccauagcacugguuccuuccuuuguggcacuuagucuaguaggggaaucaaagcaggaaacagccaaagaccgcuuggaauagaagcucugaagaggagugagcagauccaguguuuaagacuuaaucauaaaagaggcagauagcagcuggagauuucuggaauuuccauaugcuaucuggguucuagcuuaugaaguuucccuaaaauuaccaagaacuuagacuuuaauuucaaaaagccagaaauaauucuaugucugcagauaauccuacaaaagugauaugacuaaagcaacaauggauuacugccaguauuaccaaagagcauuaaaacaugucagaaguaaaaucugcgucugauauaucacacucaacuuuaccaguuagccgcugcuaaccuucucagguguuggaaccucucuuuucacauggaaaugaagccaacacacccaaagggacacacucauucugacagacaagugugugaaaaugcacuguuuuuaaaugauaaauugcaacaaagaggccgggcgcgguggcucaaaccuauaaucccagugcuuuuggaggccgaggcaggcagaucacgaggucaggaguucgagaccagccuggccaacauagugaaagcccaucucuacuaaaaauacaaaaaaauuagcugggugugguggugcgagccuguaaucccagcuacucaggaggcugaggcaggagaaucgcuugaacccggguggcagagauuucagugagccgagauaacgccacugcacuccagccugggcuacagugcgagaauccaucucaaaaaaaaaaaaaaaaaauugcuacaaagaugaggugaagguacccucauaggccuagggaacagggaccuuuauaaccuagagucuuucaaaguauucuagcuaguaaaacaaccagucacacuugguuucaaguucugaaaaagcugggggaaauguuuuugacaaaaguuuuuaguucagaccagcuuuauuaguaaacuaauaaaucaacucaugcacccaagacuaccaacuagugccuagagaauauaggaugucaggcaccagguccugaguuacaaaugugaacugcagcccaugccuuaggggaucucugugucuaaaggugaaaaaugguagcugaacucaucuccuugggugauggcucugugacagggacuauuaugagaaagcagccagaccauaccuaguuuuuccaaaaaaggcauugaggccucauucaagaauacaaucugagcccacuccuggugaauggguggacaagggcaacaugaacaaacugagacaaagcagccaugaggaagggcaaagccauggggaagugaguggguccccuuugagcuguuagcucagcccguauagcagaugguggguagugaccaauagggaaaagucugaggaaauuaguagggaacuuaauccuagagauagugguaagccaagaaaugaccccauucuuggcuauucuagguugcuugaaucacuagguugcuugauauggguagagaauguggcagccuggaggcaaaggaacaagacauuuaaauugacaucaggugagaggagggcuugggcauagccagggauugauggccaaaugucagggaagaauuugggcucauuucuggaguacugauuuagaguaaguaauggggccaaucaaagauagacuacacagggagggaaggauggauuuuagaagaaccucugccuaguaagacacccaaauaaauuuuuucugcaaaauaguuuugagggcuuuacucacauguuacuaucauguguauuguaaaagaggcauuuaucuccugugucccuccugugaugaacauuaggccuuaugaggguguuauugguauaugcuacaacccugaaaaugaaagagccacuuacauuauggguagaagcuguagcuucuuaaccuuagugcagugguucucaaaguguggaccgaaauuggcaacauuaauucaauguuaauugaguucaugugucaacauugacucauuagaaaugcaaacuuaggcccuguucuagaccugcugaaucagaauccaggcuggggcccagcauucuguguuuuaacaagccuuccuggggauucugaugcacacgggagcuugagaacgacugacuuaguuuaccacucacagaagcuaacgauuuucaagguauauccgauggagggccuuuccucugacuugaacccuagacaagaaaaccaagagcuauaauccuuuuagaagacuugcugaggaauucuagaaacauuuuuaaaaacuuagaaugaggaaggaaagcaggccuccaucucaacaacaaggcuaaaucuaaguugaugcuuaguaacacaguaucuagagccagugccuggguucaacuccuagcucugcccagggcaaucugggacaagugacuguacuuuccuucucuaccagguuuccugaucuguaaaagaggaauaauagggccaacugugcaggauuaagaauuuuaaaagcuaagagaugugaagucuuagagcaguguuugaccaacaacaaaaacgauuugauuauguccaugauucuuaagaucaauuugauguaaauggaaauugaauguaacugacaauugaacuguaaaauucacuuauuuccaugacucagaagaauuagccuacauauucaccacuuuuuaguggcccccgaacuaguguuuuuguugcuguuuguuuguuuguuuucgagauggaguuucacucuuguugcccaggcuggagugcaauggcacuaucucggcucacugcaacuucuaccucccagguucaaacaauucuccugcaucagccucccaaggagcugggauuacagguguguguaaugccuggcuaauuuuuguauuuuuagcagacacuggguuucaccauguugaccaggcuggucuugaaccccugaccucaggugaucugcccgccucagccucccaaagugcugggauuacaggcaugagccaccgugccuggcccaaacugguucuuacaauguuucagaggcugacuuuaaggccagagcacaaucuuugugcuugacagcucagaacauuucccuuaacaccuguugugguacuuugccucuuacaaacccuucuccccuuaggaaaacuuuuuugcugacucagaaauuugcuuguccugaaaggaguuuuagcuuacaaauagaaacacugucauuaaaguggcaagcaguagaagugaacuagacuaaaaauaaaugcccuugguggccccagaagugccaaaacaaauggacggaaggaauuccagcaaguaacacccauaugcucaagcaaugaguaagggcaugagagauguaaaugcuuggcccugguggccccagcaguguggcagcaugagccucugugcaggcugaaguacgcucugagccugguacccagagacacuuucucuauauucugggcaugcaucuuggagugcuccugccagggugcugcucggagccccauagggagauuuguaguccguuuggaaggcuugguauuuacucgaaggccuaugcaguuuuuuacugaagcuuauguauuaguccuccaugucaaccgcuacagggaaaauuagacaauggcggcugacuucuauaugcauuaaaaacccugaguuucccucuaggacauuggucuagacaaggaauuuaugaaagagaccucaaaagcuuaggccacaaaaacaaaauagacaaaugggacuuaauuaaacuaaaaagcuucugcacagcaaaagaaauaaucaacaaagugaagaacaaccugccgaaugggagaaaauauuugcaaacuauuaucugacaggagacuaauauccagaauauacaaacucaaacaauggggaaaaaauaaucccauuaaaaaguggagaaaggacaugaauagacauuucucaaaagaggacauaaaaauaaccaacagauacaugaaaaaaucguuaccauuacuaaucauuagagaaaugcaaaccaaaaccaaaaugacauauaaucuuauaccagucagaauggcuauuaauaaaaagacaaaauacaacagauguugcugaggauauggagaaaagggaagucuuauacacugcuggugagaauguaaacuaauacagccaccaaggaaaacaauaugcagauuucccaaaaaacuaaaacuggaauuaacauuugauccagcaaucccucuacuggguaucuacccaaaggaaaaaucaguauauccaagggauaccugcacuggcauguuuauugcagcacuauucacaguaacaaagauacagaaucaaccuaaaugcccaucaauaaugaaaggguaaagaaaauaugguacauauacacaauggaauacuauucagccaugaaaaugaaugaaaucaugccauuugcagcagcauggggauggaauuggaggucauuaugcuaagggaaauaagccaggcacagcaggacaaauaucuuauguucucaaucguauguggaagcuuaaauauuucauuccauggagguagaugguagaaagaugacagagacucagaaguagggggaaagggagagcagaugaaaggaaguggguuaaagaauacaaaccuacaguaagguagaagaaauaacgucaaugacuguaguuaacaaaaacgugcucgcgugauggacacccuaaauccucggauuucaucaguauagauucauuacauacauguaacaaaauuuuacauguaccucauaaauuuauacaaacaccaccaagaagaacccuguuuuucuuggagccagugaacugccaaugugucuguguagcaaaguuaacuacuuagagaagcaaggcucccaggaaaauagguccuugaaguuagugugcauauucuauagucugauuccaucuauauaagugacaguaaaagugagaauuuuuugacgcuccaggaauucauucauuacaaauuuaaauaggcacauaagugaguagguacaagcgacuuccaacccccucacccaaaggagcagagauauucuaaggauuagagcuggaagaaaaccuagacaauuucuuaauagaacccuuuucaaauucuuacaccaaaauccaauauucaaaagaaagucuugguagaggcagagguggaacacccagggccucugcuacuguggccuuucccuccacuucaaccaccccucuagccugaggcauucuugugaaaccucauggcuuuaaggaacccacuaacaauugcauuuugccccaucuucucaccugucugagcagaaaugccuagcacuucuacuuccaagguauuuuuugaggugucauuggcuuuaguuuagccugaagaauuaaaagaaucucgaguguagaugauuucaagcucaacuuguucccuuuaugaaaguauaauacugaauuugagacguaacuuucauggauggaaauagacugcagguccacaauccuauaaucccaaagcuuuggaaaccaaaagccucuuaacucauuuggugcuuucaguucuccuagagcucugcacagcagcagucccagcugagcaccagagguggauagguagaaccuuuuaaaaacuugaacagaaaacuuaacaguguuccagucagguggcuaagggcugggcauucgauuuagugucugagcucucccucucugugggaagcagagaauuaaacagaacuagggagcacuuucugcccaguagcagucccucaaaacaaagugcuuaggaaacuaggaaacgaagaggcauagccauaaagcuuaaggucuuuauuugccugucuuuaaagaguccuuuauaaagccagcuugucuucccacccccaccccaaugucauucuuuuaaacaggcagggacauuuuaguagcacacuguacuccuaaugccuguugcuacuccuuauuggagagagagagagagagagagugugugugugugugugugugugugugugugugugugguugagagagagggaguaaaacacagcuuuaugaugaucaggcagaagcuugaguaaaguggaaauaucucggauaagaaaagcuagaaauuaaacuccuuuuuggcuucggauauuuucuuaguagaaaaugcugaugccuguccugagucuccucaauauagacucuuagagcagagcugcuaggauuuuaauagaauuuauuacuguugauagcuuguauauuacaacuaaauucagagacccucuuuaaggcaauaguagaguaaauaucagccuugggauacuguaugcccauacuuaaucccaggccacucugagugccuaggaaaucuguagcuucaaacucauucuuaaggagguugucuuccagguaccuuaacccugaggugggaaacuaucaauugacauugaccuuuaaguugcuauucaaaucugauuacaagguuuccauuuugauuauguagauaucaaugucaauguuguugucucauuuugacuuaauaaccuuugguaacuaaaaccuuaaaaaaaaaaucagaggcuuucagucuuuacuguaucuuaacuccaaccugacuauucuuuccaaguauauuuauaccuauguucucagacuacaaaucauucuuuuccugauuacucaagguagagucuuaccacuuucacaguccccaaagguaguaaggucauauagaacugcaagacacguacccucagcauugagaauauugcaaacauauuaagaauccaguggcaaugaggggagaggggagaggcaccagguaccucagauuugguuuagcaguauaaaacaacacaggugaugcuuccugacaacaaucucuacccuccucuaguuccccuucuaaaucccuaguauauuacaaccaauaaaacgugaagaaugaaaaaguauuaugaaaugaagguaggaaaccauucugcuuuguagcuggguccuagcuuaauuagacucaugggagcagagugauagaugcaguuuuaaaagcaacauauuuaauauccaaggaaguaaccacacccauauggucaucuugauuugggccaaauuuuaaucucccugggaagagccacaaagcacgaaaugcucccagacagcagggaguagcugacacuagggagaccaacuaggguauugugcacguaacacaagaguuccagucugugcuugucucuguaauaucaguucuuaugccagcaugccacagcugcaaaugcugaaagguggcaggaaaucggaaggccuucugcugggacacccucccuaaguaaucugcgugaacuauaugauuccacuguuuuucucaaauauuugcaguauauuugcuuuaagggccacaucugugccuuuuaucgugaagcaaucacauccgccagaaggacggaacugcuaaugauaggaagcaccugaacauuagcuggccugugccgggcaaaacaccaacugucccacuuagaagucuuaguucacaccauugugugaauuaaauauccauacauuaagcauagaaaaccagauucagagaaaucgaaacuacaucuucagcuccaccucacuuuccuuuccucuccucuuuaaaugacaaaugaucuuccuuucccucuuaacuauacuuucuuguugcuuuuaucuuggagcuguuuuuuaaagcuguguuuuuccaauuagaccucaguuucuaagaggaggaaucauguauuaaaucucuauuucuacccuauucuugcugcuccuucuaaaucuucuucacugugcuuguaauagaaacaucauuaauggauaauaguauggauguggacaagaaaugccauuaaaggauuaggacuuggcugauuauagccacacacguaguuucaacaaaugagagaaaugaguccacaggcagagaugaugccccuuguggucucugggcaaucuggauuccuucuauuuucgucuggcuccauuugcccgagaucacuauuccagccaccaugcccaauuuucagguaccaggaaugaagagauggaaagaaaauggauccucuauccucuuaaggacauuucccaaaguuguauauaccauuuuaguuuacauuccauuagucagaauguagccccuuggcugcaccucacugagaaagaggcuugaaaaucuaguauuuagucuuagcaugcacccagcuaagaacgcaauuacugucagucacuggcugaagagccauccuacucuggcccuuaggaugucauagccugccgagucugcaguauccuucugagaagguccccauccauggguauuagguaucuugaaucuauaaccaauccuugcuuuaccgaauguucccuucuuauucuagggagaaaagccaaaugugaacccucccaauuccagugcacaaauggucgcuguauuacgcuguuguggaaaugugauggggaugaagacuguguugacggcagugaugaaaagaacugugguaaguaaagaguuugaugacuuaugcauuuuguuaaaauaugauguuaucuuagucugcaaauguauugagauucugaaaauaaaauccacuucuaacaauugcuuugaaagaaucuauacuucucuguguaaaggaauaaaauugaauguuugacgugggguuaucaacuugagaauggaaugauaaggugauguuccauuuaaaugacaggaccuaguuuaucuuagaucagacaaacguggaauaggaaucugggagaagggagaagaggaccagaaauagagacaaacagaagauugcuuagaaggggcuuuuuuccccuuuuaauuuucaaauggcucugauccuagaaaagaaggcaagccauggacaugagaaaaucccauaaaguuucaggggguuaauuaacccuugacauagaaacuacaagccagcacagaucaaagaucagauaaggauucuuuuuuaauucucugccuacaauaguugcuaauucuaaagcauuagcagggcggaagacauucucuccccaagagaauggggauacagugucacagccaucaaucagcaucuauuaaaagaucacugugagaaaugccuauguaugcaaucuauacaaccucaugucaagccaaaauagcugagaacugcauggcaagauuacauuuacauaccaugaauacaugcugaaauuugcucuacgaucccuuuguucaggguuguaaacauucugaaacaauauucuaugugaauauuggugcuaacauugucauuuaucuuuuaaaagauguuauauaaagauguucacuauacaagguagaaauacagaagaaaaguagagucuaaauguagguuucaucaacugccaucuuguuaugccuuuaccuacuucuucaugcaucauuauuaaaaugcuauaaaguaugcaucauggcagaccuugugcuacaccugaucucucagagcaguaucacagguguuuucaugccaauguguaaagcagaucaguagcuccuuuagaagcauaagaaaguccauucuaccaucucagggaagaaacuuacauccagucucaggaccaagaauaguucuccugugcaacacuuuaucaucauuugcauuuuaacacuaagauuuuaaucuauuccacaagacacugagucucaugcuauuucuggguuaccuagguaauuuaguucucuuacuaaauaucuccuuagagaguccucacucuugucaacuauuuuccuguuguaaguugcaauuuuuuuuccucucuucuaaacgauauauuuggcaaaacccauugcuuguucuuaaaaaguaauuauucucuuuguguugcacaagucuuuuuuuaccaugugacucaguaggaacuaaccugggucaacuugggauuuuucuaaaauagucuuguauaaguacucucuacuagccacaugguaggagaguuuggcaaagaaaaagagguagauguauaucuaaucaagaucauuugaggcaggaaaaauuauauccuuagccaaaauuugucucuacuuccugugugugacaguagagaaagaaaguagaaauauuacaaucagggaaggucugagugcuuacuuuguuucucuauggaagaggaaagcuauagaauuacuuaaaacuuccaaagcugccuccuauuuuuagucuaaccucuuaauauggaacuugguuacaauauuuagcuuaguucuuuauuuccaguaugucaaugggcauagucaacuuaaccuuagauucuauuagccaugugcuucuguuggucccauuaacucauucuuuuauaauguuaggcugagcuaauuaaucagcaaccuaaguacucuaaauauguaacugcuaauucucuuccucuguagcacaucuaaauuccuauuugucucucaaggcccaguucacauauccuuucuuuacccucccagucuaugcuccaaaugaagagagagaaccauacggcaauuugucugucucuguuuaucuuuugcucaaacacugugguauacagccaaucuuucacauccuccuuacguuuucuaagacuuaaaaucauggagggccgggugcgguggcucacgccuauaaucccagcacuuugggcggccuaggcaggcgaaucacgaggucaggagaucgagaccacccuggcuaacacagugaaaccccgucuccacuaaaaauacaaaaaaauuuagccggacaugguggcaggugccuguagucccagcuacucgggaggcugaggcaggagaauggcgugaacccgggaggcggagcuugcagugagccaagaccacgccacugcacuccagccugggugacagagcgagacuccaucucaaaaaaauaaauaaaaauaaauaaaaaaucaaucaaucaaucaaucauggggucucuuuacagccauuccgcuacucccucuuuuguagcuuccaaagaauaucacagguugaauuauagcaacuaacccugcagacccucugacuucuuccuccaugcucaggagaacacagaccuugaauagcacuuaauucauuaacauuaguguuugaguuuuucagugauuuuagaaacaggcaugaaucuaaagcuagcauggccagucuuguuuccuuggcuguguaauucaaggagauaauccuuuauagaucaucauaauuugucaacccaucuugaguucuagaaauuaacuguaaucacugucucucuccuuuacaauaucuuacucucaaccagagugguccaagggcacacucuaagcucugagaguucuaccugcuuuaaaccagugauuugagaaacagucccuuucaaauguucaucaaauugugaauuuuucacuuauuuaccuucacagaauauauguuauagaggaauguuuuaaaauagaaauuggguagaagguauaagcauauaggcaagaaagaauauaaucuaagaaagauaagcuuaggguauccuguguggcuacuuuauaucaagauucauccugcuccgugauuccuucauggguaggauaaucaagcugcccgauuugcuuaggacaguccugguuuaugcuuaucuuccagauauaauuaaaaguguccccuuucugcugagacugucccaguuuggacaaaaaauugcaugguaacccuaaguauaggggaaagaccugccccaggaagaauuagcaacagaaucaauuccucuccuuaggcuauuuuaacauuagcaggcaguuauggauauuagcacugacagcuucaaugacuuuuagcugguugauguuagccuaccccuuggcuagaaaggcuaaaaucuucucucccuugaauucuaaguacaacaucucuuguuacacugauugaguuuucuccccuuucuaccugaugaguuucuuugccccuguagaccaguaugggugacaauauucaguacugggguuuggccuucauucuccacacuaaacacauguguuguuaggggaugccccuugaacaguauauuagucagcucagacugcugucacaaaaauaccauaaguggguggcugaaacaacagaaauuuauuucucauaguuguggaggcugagaagagaccugccaguagaucugauaucaggugagggcugucuuucugguuugcagaugaccaucuucucacuguguccuuacauaguagauaacaaagagagagagaguaagcgcucugguuucuuuuuaugagggugcuaaucccauucaugggggcuccacccucaugacuuaauuaccucccagaggcccuaccuccuaauaacaucauguuagggguuaggauuuccacacgugaauucuggguggagacaaacauucaguccccagcaagcaguucuacuaugauccagucagaagauggaauguuuagcuguuaaaugaaguacuugaaugacuuggaagaaaugcauguagaaaaugaaaguguuacuuaaucucaacauuauaaaacaggcaggaaguuaaauguaagguaucuccgaguuguaagauaaugggcaaccucugucugaccuugacuucaguuuccuccaagucucucaaaugagcaucuuccuccucugaaaaaaaauaauaauuuuucugaaguuuccccuggauauuggcaguugagugcccauugacucagcuuuuuuuuagagcaaaacaugccaaaaugcaguaugagcccucaugugaagcuagggcuguggguaaaugacuucaacuuuaacccuucaaauaaacguuuguaguaaagaagacgugugcugaaucugacuucgugugcaacaauggccaguguguucccagccgauggaagugugauggagauccugacugcgaagaugguucagaugaaagcccagaacagugccgugaguguaacuugcuuuggccuugaacuuugccaaguuguucggugucuaacauuucuaaguauugcuuaaucuccuacuugguauucauuuuucuuugccugccuuaaaguuuaggucaauugacuccaagggcagucaaaucauuaccaguuuaucagccuccuuuaaagaauguucucccugguccaacaagacugacauucucuuggguagcuucacuauugaauacuuaaaacugaagucagcagauucaaucaagaacuccuugacuaggugcauagauuucaaaugucuguuuauaauaacugagcagaugguacucugguccuggaagcuaagucaagaagugaggguucccuaugggccaagcaaaagcuuuuagaagcacagcuuaucauacuauuaaaaagcuauuacugaagagguaagguagcuaguaauugggugauauagugacuccugacacacauguaaccucaaguuacuaaaauggagaucuuacagcauauucuuaaauaagagaaacuucauagguaugcaaguauauaccuguguccuuaggaaaaagucuaugagaccauaaagaaugaugguuugggaucauauaaauugagaucacacgaaugucaaggcaaagaaagucuuagaguuugagucaguagaggccugcacugguagaaacacuaaaaaaggacuaacaugaacacaguuuaggucuaaagugugauuaugaaagaaaaucaaauagaaaggaagauaaggcuguuacuuucaauuuucuagauaagaagugaggggaguaauauuggucaaggcaagugaguucaaggccugugagcuaaagacagguuguguaaagauucagccucaacuuuuaguggagaaugaccuggucaagucaagcauuagggcaugcuucuacuuugcaagaugucaaucuaaaggacauugugaaggaggcccauaaaggaaucuaggcaauagaagauuuuguagguguuugaccaucugacuuuucauguauuugagauuagaugacaauaucuaggugugcccacuugacauccaacagauaaauaguggucuaggagcaggccagccaauaaacuucaccacgccaaguaaaacaaaagccagaacugagcacgccaugggaccuugaaggagugacguggucaaagcugucacguacacugccagguagcauagguuggcacagcuucuaaggaguggagcugaugaaagagcuccccgggcuucagccaguuaguagaauuucaccagugugccaggcuacugagucacagguauuagcgcuuccaggcagcacaggagcagcagcuuugcauugaucaguucugaggcucuuuugagacuguauaucaucaacagauaugagaacaugccgcauacaugaaaucagcuguggcgcccauucuacucaguguaucccaguguccuggagaugugauggugaaaaugauugugacaguggagaagaugaagaaaacugugguaagaagaucaguguugagugacguaacccaaagacccuuuuccuaaaggaagggugggcaggggaaacuaaucuaagccugaagacgcacugacauugacucacuuuucagugacuucacuaucugcucaauuacuuguccuucauaacugcccuaaaacccuaaaagacauucauguggcaauugaccaucgcuugguguuucuuuuaggcaaauagaaauaagaagguaagucauucaaggcacuuauauauagaaguagcucagggaagcagcaauugugugggcuuuuguuuugacaguaauucaugugucuuuugcacuuuggcacaauaaaauuagaaggugaguaggguuggcaaacacauucauaggucuaaauuugauuggguuauuggaauaaauuauuugaguauuauacaagcauuucuuugcccaugaacuagauucuggcauaacuuucccagaaaaaaaaaaaaaaaagacacagaagcaugaauuaacaucuugccucagauacccaaagaaaagucuacccaacuggugauaccuuugucuccuguugcaguuccugucucugaaagcuaacucugcuuccuauucuuucauguuucuggucuuggaaaaucuuuaauaaaaugcugcauguugaaggugagggccugggaaaaucacuagguugaacaaacagugcuuugaauguucuuucaagcuacugcccuuuuuauagggccucuaaaaccuacagcucccaagucugacaagcaugggccuccugauaugguaguagucaagggagcucagggcacuuacaguugaaacaccagucuuguguguagaagucgccuccugaggucaauaccacugcaccuaguccaaugaguuuuaguguucaauccuagaauuggguuuucuguauugguaagcccuggugcugccaaguguuucccuuauaaaucuagacuuugcuucccaagagagucguggucucuauucuaauugccaccaaauugugaccuugaaacauuuggcaggaauuuaagucaaaguaccaauuggcuaguaggacuagcuuaucauugucagcauaccugauuguuaaauggugauuauagcccuggcagugacuuuuucaaaauggaaaguguuuaagacuuguuauuccugauccuuauuuaaaggaccaaaaagaggaaccauauauggugguaugugguucaccucuuuuggugacaaagucuuaaugcuuguugugaguauuacguugcaugauauucucaacuagugauaagaucugacaagcaguauguugauucaaggacaacucaaucucugccuuccaaauugaaaucccuuguuacaguuuguuauuuaugauggccacuuuuagaaucaauugugguucucaucucaaauuaauuuccagucuucaacuauuuucuugguucuuuauuucuguucuucuuauuuauugugugccuucauuuuuuguacaaugagacuguacaaaaguucuugauuuaacuccauuguagccuuuaaguugggcuaguaaguuaggauuaaugaauaaagaucaauguauuagauuuugggacaagaaucuugaacggaccaaucuugaugcauuuucaguggggcauccucucucuuaauaggcaauauaacauguagucccgacgaguucaccugcuccaguggccgcugcaucuccaggaacuuuguaugcaauggccaggaugacugcagcgauggcagugaugagcuggacugugccccgccaaccuguggcgcccaugaguuccagugcagcaccuccuccugcauccccaucagcuggguaugcgacgaugaugcagacugcuccgaccaaucugaugagucccuggagcaguguggccgucagccagucauacacaccaaguguccagccagcgaaauccagugcggcucuggcgagugcauccauaagaaguggcgaugugauggggacccugacugcaaggauggcagugaugaggucaacugucguaaguagcuuucuagcauggcauguucaguucucuucccuguaucaacugggacaauuugcuggcuucauuccaugguguuuccucccuuuguagccucucgaacuugccgaccugaccaauuugaaugugaggauggcagcugcauccauggcagcaggcaguguaaugguauccgagacugugucgaugguuccgaugaagucaacugcaaaaaugguaaggguuucuucuuguugguuaagcaauggauugcucugaccagacccacucauggaaucucucuucuuuguuucucuuuguagucaaucagugcuugggcccuggaaaauucaagugcagaaguggagaaugcauagauaucagcaaaguauguaaccaggagcaggacugcagggacuggagugaugagccccugaaagagugucguaaguguacuuguuguucaaguacagauccuggaaguuugacacaauccaguauagcuaacacuguguggaccccccgugauggcuaguuaaacuuuugaauguacugaaguucaauuguagacuucagagugaaacuuuaugacuuaaaagcccagguaggacaaacuaguuuauaguuuuuguuuuuguuguuuuuuuuuuuuuuuuuuuuuugagauggaguuccacucuuguugcccaggcuggagugcaaugaugcaaucucggcucacugcaaccucugccucccggguucaagcaguucuucugccucagccuccugaguagcugggacuauaggcgcccaccaccacgcccggcuaauuuuuuuuuuuuuuuuuguauuuuuaguagagacaggguuucaccauguuggccaggcuggucucgaacuccugaccucgugauccacccgccucggccuuccaaagugcugggauuacaggcaugagccaccgcgcccggcccaaacuaguuuauaguuuaaccuccuuaaagauaacugaucaucaauagagaaacuugacuaaaugcuugaccagcugguaacuugccgaggaguuagauaauccacccugaaauauauaccuauaaaauaaaugauuaggucuuagacaaaucguggguuugaccaggccaacuagauaaguuaucacaaauagccuggguuuuaaaugugaaagauauuaauugaaaauaaguugucaagugacuacuacauuuuuauuccagauauaaacgaaugcuugguaaauaaugguggauguucucauaucugcaaagaccuaguuauaggcuacgagugugacugugcagcuggguuugaacugauagauaggaaaaccuguggaggugagucuaagaagaaaaccuggacccugcaggugaugggaaaggauaguauguaccuaguaagguauaggagcagcaagacuaauucugauuucccucccagauauugaugaaugccaaaauccaggaaucugcagucaaauuuguaucaacuuaaaaggcgguuacaagugugaauguagucguggcuaucaaauggaucuugcuacuggcgugugcaaggcaguagguaaaugaacuuggacugguauggcuguuguaccuuuaugaguaagugccucuaaaagguacagccagugacuacaauagucaaacuaaacaugaaauuguacuugagaacaaugcugcuaaccucauaauacagcaguauaggucaaauagcagaucucuccccuagauauguaccuugaucauuccuuuugcauaugauaccaugaauaccuaccagguuugcaugcucuguuuccaaaacuugaguccaacucaaacaagugacuuauucaucacucacccuguucuugaaggcuguaaccccacgacugccuuccuaaacuguaggaagcacuugcaggucccaggggcaggaacuccagaacagauacuacugagguauuccacaauaccuuuauuuucuaagugcuccucugcugggaggaggugguuuagaaagaccuugccuucuuaaagcaaaacuaaguaacccagacuuccaucuugcaggcaaagagccaagucugaucuucacuaaucgaagagacaucaggaagauuggcuuagagaggaaagaauauauccaacuaguugaacagcuaagaaacacuguggcucucgaugcugacauugcugcccagaaacuauucugggccgaucuaagccaaaaggcuaucuucagguaacuuucaguuccuuuuguggugucuugacauaagucauugucacuugggaagugaucugugggauaguuuggaggaguuucuuuugugucuagccccaucuagcaucgaauuaccuggggacauuaaaucuaaugcuaauucuuuauuaaacuguuaucacuuccuaauuagaaacuaacaauugucuaugaaguaaaagaugacaucuuucauauuuuuuauauuuucucccuuuucucuacaguuaauugagaacuguucauuguugcuacaaauagaaaugguaguacagccuuuucuuaaugggaacuauagaaacucagaugauggauacugaaacaaauagcuucacuuagaaauuuguuguucuuguauauagaauacauaccagcaacuagauaaucuacagcauuauuaauuuaggaucaguaagcagcaugguuaaauaauuugaguggugagcugugguguuaacuggauuucuuucugaacaaagucauugaccauuuuguaagcaaaaaguccauucuccaagcucuaauugugucaaacucuuaaauuucuugugaccuauucuguuucagugccucaauugaugacaagguugguagacauguuaaaaugaucgacaaugucuauaauccugcagccauugcuguugauuggguguacaagaccaucuacuggacugaugcggcuucuaagacuauuucaguagcuacccuagauggaaccaagaggaaguuccuguuuaacucugacuugcgagagccugccuccauagcuguggacccacugucuggguuuguagucuguuuuccaucacagacuuuggaaugguaucuguguaggucaggagcuuucucauaccugaauuaguacucaaaucucaagguuuaugagccuucugcaacaaagaauuagaauucuaauuuaagauaucaguuuugccccaggugagugacccugggauguccuuaucuauaugacagguccuccugucugacucucguaugacugauugcuggcugacauuaaugaauuaacauuccugauuugauguguguaccaaaagcuguaucugaacccuuuuguccacccaguuucuacgcaagugauuuuuuaauuuuugacugaaagcuuugcugggcuagcucuggaugaucaaaccuaaacgacagccugaauugugaggauuuggguaaccacauugcaucuaagugugcaaguugucugaaaguccagcagaaauaaacagaccuuucuagaaacauuucacuaaggggguucuguaaauugccacuaaguaacauagaagagcagcucaggaaguugacuaaggcuguaguugucaucacaacuggcccccgugcagccucauuagaacucagucagccagccaaccccugcuaugaaauuugaaggauguucgucuugcacuccucuguaagaacugaccuuuuaaaaaggaaacauaaccuugugacuuugggccgaaauuuaaaugucagacaaacauagauuauuauaguuaauaaugagcuuguagauucuuaauauucaauuuuauuuaccuagaacauaauuuagacccuuaaguguuacuauuugucacuagagaaugccuugaguuuucugcucaaauuuuaaauuuuuguuuccagcuacuacaacuuuauuccuucuaaaccacugaggcuuauuucucauuuaauuuuucacagcuuuguuuacuggucagacuggggugaaccagcuaaaauagaaaaagcaggaaugaauggauucgauagacguccacuggugacagcggauauccaguggccuaacggaauuacacuugguauguauguucuuccuucucgaccacccacucaacuaucuucauaguguuuccauuuaucuccauggugaauucuggacuagcagaugacucuacugcuuccgccuaaauucuagcaggaauuuucaaugggaguaacugaacaacacaaguaaaaugguggauuaacaaauuacacauuccauaauuacuggccuguuguccagcugggccuaauaugugacacaaauucagugaacguugggucuugggugcacucauacuaaauauucugggcaugagugccuuagcauuuccugaauugcaggcuuuuaacaguuuucuucuggcuuuuuggaggagaacaacaaaaugguagccucuuuuaauauuuucuguaaugugaguaauauuucuuaagucauuugcuuugagaaucucagguacccuguuaguccccaaaaaugaacguggauacaggcucugcaugcugcuucgcaagguuuauggugaccccguuaagaaacccugcuggggaaagaaccgugaaaguagauuauuaauucauuagauauuuuuaauggaagccagaguaguaguggcuugucauguaaugacaauucuuuuccuaccuagaccuuauaaaaagucgccucuauuggcuugauucuaaguugcacauguuauccagcguggacuugaauggccaagaucguaggauaguacuaaagucucuggaguuccuagcucauccucuugcacuaacaauauuugagguaagaugugucucacaucaaaguguguaccuuugagcuacuauaucacuuugagaagaaauaacagacauagcgggaggagggaagagcagcugaacauggcuugagaaacugcuuucacuuaaaaccugguacaaaucagacacuaagucccagaagcacuccacaccuaaacuugauucuuuuacaguuuuauauccagugucccaguucagcauucaguaaacuuaguccauuaaaugagaaguaaaugaugaugaccuuagaaauggacuuguguuaauccuggauguacaugcuaauugugggcuucuguuuuaggaucgugucuacuggauagauggggaaaaugaagcagucuauggugccaauaaauucacuggaucagagcuagccacucuagucaacaaccugaaugaugcccaagacaucauugucuaucaugaacuuguacagccaucagguaccguggagaagcacaguccuuaauaacuacuuuaagggaagcagcaugacacagaaccugcuggaugucaguagcucuuggcaacucaguuuucuuuaaaagggaacuuuugcccuccuguacccuaccuuaaacauuucacauguuauuuuuuuauuucugcugccucagagaaauggcuucucaacuucagcuccuggcuuuccucccaagccucagugucagagcuuuuauuucuguuucauucauguccccuuggccuucagccccucuugccaagacuauugcaguagccuccaaaguagcuuuugugcuacaagcuuucucuacuguuaguuugcuaggauuuuugcaaugaaguaccacagacuaucuuaaacaacagaaauuuauugucucaaaacucuggaggccagaaguuugaaaucaaggugccaggaggguuggugccucuugagggcugugagggaagggucuguuccaggccucuucuuggucuguugauggugcucuucccccuuugucucuucacaucaucgucccucuguauaugcucguguccagcuuucuugcuuucuuucuuuuucuguuuuuuggagacugacucuugcucugucacccaggcuggagugcaguggcacaaucucggcucacugcaaccuccgccuccuguguucaagcaauucuccugccucagccucccgaguagcugggacuacaggagugagccaccacguccagcuaaacuuuguaucuuuaguagagaugggguuucaccauguuggccagacuggucucgaacuccugacccaaaguaaucugccugccucggccuccuaaagugccggaauuacaggcgugagcuguaauaacagucauauuggauuagagcccaccuuaaugaccucauuuuaacuugauuaccucuguaaauauccuauccucaauaucuccaaauaagaucacauucugagguacuaggacuucauuauaugaauuuuagggaggaacaccauucaacucauaacaccuacuuucccccugugacacaccugauauaggauuguguagauucucaaacacaucggguuauauuaucuccugcugaaaacacuuggcugguucuaucuaaauaaagccuucaaaccuuccuaaggcugaguuuccuuccacuuuguuggagcaagucaagagaaaaccaggagaacaugccuagucuccuuucucugagccuucacgcuaaaccucgggcaaauagugagagccaguccuggucccucaccucccuuccccaccuccucuuuuggcaucugucucuuaaaggcauaacuuuuacagucuaucucgaagaggucccuuaucugguguccuuagagcaugcugccuguaccuguauacuuauucuuccuugauacuguucucacuugaaggauuagcagaguagacaaguuuaagcucuugggggcaaggacucaggucuucaacauguagaacaaggcuuuauauauacuaggcaccggaauacccauuuuaaugguauuuuuuuuccugacuagguaaaaauuggugugaagaagacauggagaauggaggaugugaauaccuaugccugccagcaccacagauuaaugaucacucuccaaaauauaccuguuccugucccaguggguacaauguagaggaaaauggccgagacugucaaaguaaggcauuuuguguuucaaccacaaguagaaccuacaacaagcaauauaauaagacacaagcuuggauuuuuaagaauucugucuuagcuaauucuuugaauagauuugagaagauaucugcuauuguaugccggguuaucaugucauuucuuuagaacugacuuuaacccauuucaacauuaaaugaguuuauaggagacuaaagugucaacauaccuuacacuaauuuguaccuagucccuuaacagcacugagcuagccaacuugcagguaauuaaaugaggccuuaacauuuuuccucaaaaggaggaggacagaaauuaugcuuaaggaaggccaugguuacagaaaccucauugccucagugggugacgcuacccuaaaauaacacuuaggcugaauuugcauuuagucuucuguucuuaacuuuugauuaaguggcaaauuaaagucauuugugugaucaaggagcuuguauggugaggcugaugagguuuuuauuagcguaauucauggucaggcagggauuagcucaguuuaccaagaaauuaguugcaagacagucugguaugccugguauaccagagcaucuugagaacauuucucguaguuuccaggaacaugggauguuguuuagagggauaaaaugugguuguccaucauuuugaauugucaaauuccaaacaccgacuguccuucccaaaguuucauguaucucuuuuuugcaugaagauugcuauuucaauguugacacaucagcuguacaacuuaguucagcagugguuugucuauuuuaccugguuuuaaaauaaccuuuuacauggcuugucuggacaaaacagcuagccaugcuggaacccuggcauuaaccagguucuugguuuuuauaauucagguacugcaacuacugugacuuacagugagacaaaagauacgaacacaacagaaauuucagcaacuaguggacuaguuccuggagguauugaguucaguacugcaaacuguuaaucucaacuaacagccacacucuuuguaucuacagcuuaaauaauuaaugcagccuuuaacuacuauuucugccccaauugguaaccuauauuuaaacaccaaagacuuaaaacuugcauaucuuuuccugacugaucuuaaagguuucuaguagagaacugucagugaaauggcuacuacagcaugugacucaaauacuucuaagccagaguuguuccugguguucaauuguuguagauacugaacaucaauauuggaugcaaagguuuuggcuccuuaccugauggguaaauuucuaagucugaauacagauccuucuaaacugauuccuuuuauuccucuguagggaucaaugugaccacagcaguaucagaggucaguguucccccaaaagggacuucugccgcaugggccauucuuccucucuguaaguagauuuccuacaagucuggguucaagaacuucuuagauaccagaugaagauuuuuuguucaucuggagcuaccccuuucaugggccuuuaugcugucuagcauuuaugacacugaauuacguucgcuuucucccccacauaauacacuaaauuaaggcccauaucuuucucuucaguuguaccuuuggcacaguaacuggcaaugauaaguguucaacgguuaaugcuuucuacuuccgcacuguuaaccuggcuuauccccuuuuauaauaagucucuuuaacuaguguacuguucuguucccccuuugaaauguguguaaugcuucauacagaggagaugcacaaaugcuuaaaugcuaagaguuacaggacuuguugaggauaaauuaaaagcaguuaagaauuuucaaaccuauggaaaaggaccucuaaacgagacacgcaaauucuaaggacuuugcuauaaaaaccuuuguccuaaaugaagagacccaagcuuagcuaacacgccaggaccaccugaauagcucuccagaaccuucugcaauuuuaauuuggugagccuaaggugggaccgaggacccugcccuugccuggauggauguggcuaguccagcuccagugcacagagcuaccucugggcugaacuuguuucaagcuccuggcccauguguauuccaacuucuaguuauccuagcuccauaaaacauggcauuuuuacuaaugucaauuauuauggauuccugaacguuauuaccuuucuuguauguuccaauacuagacuuagcucacuuagcuacccucugauuuuuuucagugcucuuagugauggcagcaguagguggcuacuugauguggcggaauuggcaacacaagaacaugaaaagcaugaacuuugacaauccuguguacuugaaaaccacugaagaggaccucuccauagacauugguagacacagugcuucuguuggacacacguacccagcaguaagucagcuuugugucuuuauacaccauggcuugaagugagacuuuucagaaaggagaccugggugagagagagagagccauuaggaugauggaguuaccaaacacuucaucugcuaccuggcuauuagacagacaguauagccuguuagaacauaagucacucaguugaucagcaucuaacccucaccaacugacaagugggucaacuuaaagucaccacuauauuaagauauuuuugguuauagaaaugacauguaaauacuagcaugaaccaaguagcucauuacugaacuauuaaauccauugccuacuggauauuugaaaguaaauuagcauaucauauauaggggaguuggcuuaaagucaguguauugaguaagauucacuuagccaaaauuauuauaugcuuugcuuuaaaaagguaucccaccgcccuuaguauagcuagcuuuucuuccagcaauagucacucacuuguucuucagaugaaacccaaguggaguauuuggccuucacguaggaaacaggcugaacaaaacaaguauugaucacuccccucucaaacuccggugaaacauggaacaguggucaauucuugacacacacauggcuuuucacauuuuuccccaagacuuaugaucauuaaguagaaaagacagaauuagucacacuaucuuaucucacuaccaagcagguauaguugaauucaaguuaaaugcaugaaugauacaacucaguauucuuuuguaucugacugacuuuucuucuaagcacucugaguguuugaaugaccaacucaaaagcaagguccauuuuaaagacuagaguugccaucagugagugaucaccaagcucauucuauacuucuucuuuuccacagauaucaguuguaagcacagaugaugaucuagcuugacuucugugacaaauguugaccuuugaggucuaaacaaauaauacccccgucggaaugguaaccgagccagcagcugaagucucuuuuucuuccucucggcuggaagaacaucaagauaccuuugcguggaucaagcuuguguacuugaccguuuuuauauuacuuuuguaaauauucuuguccacauucuacuucagcuuuggaugugguuaccgaguaucuguaacccuugaauuucuagacaguauugccaccucuggccaaauaugcacuuucccuagaaagccauauuccagcagugaaacuugugcuauaguguauaccaccuguacauacauuguauaggccaucuguaaauaucccagagaacaaucacuauucuuaagcacuuugaaaauauuucuauguaaauuauuguaaacuuuuucaaugguugggacaauggcaauaggacaaaacggguuacuaagaugaaauugccaaaaaaauuuauaaacuaauuuuguacguaugaaugauaucuuugaccucaauggagguuugcaaagacugaguguucaaacuacuguacauuuuuuuucaagugcuaaaaaauuaaaccaagcagcuuaaccaugguuugugccuguuccucuaggaugaacuccuauccugaguaguaccaaguguucuaacuaaaugugugagcuguaguucuugauguuguauaacuaagccuguaauugggcugguuucucuuacacccuagcacaguuaaaaaaugaaguacuguuuaacauuugcucccgaaauauuucuuacuguguaaaagaagcuagcuuagucuguaccuagaauuccucuugguuagaggagugaguuucuuuuuuuuccauuaacuuguuuccugaucgagaaacacgugcuaagauuucuaugaauucugcuucuuuauaguuaagucucuguuuuccauguucugucauuuauauaggucaaggacaagugccuucuaaggcauggauaagggcuuucuucuuaugaaagucuagacugucuuacugugaagauggccagggaggauagcaagcaauggcauucuugaacagucuaaggcagguuucucagugugguccugagaacagaagcaucugcaucaccugggaauguauuagaaaugcaaguucccagccccaucccagaccuacugaaucagaaacucugggggcgagggcugaaaccugcuuucauaagcccuucaggcgauacugauguaaacuaaagcuuaaaaaccaccguuuuacugugacuucaugaagaauauaauugcaauaucaccuaaauuuuuauccuggcugggauggggcagauucuuacuauggacaauuucuggaacuuacaguaugaagagcagaugaggaguuugagacaaagaaaaaauuguacagggaguuuagugaauuuuccaucagguuggccauuacuuucuuucucuaaagucucaggaugucuggaagcaaggaaagacaaaagacuugaagcaccgggugcaugcugugugucacaagugagguggagaguuggcuguggaagguacagcaauuccucuggaauuaaaugaccgaccaacacaguaccaagaggaugaagagaagauguuuugcguugcuacgugaaucaguggaugacucauauuucacuugcauaugaaauauaaggcaguuaacaucuuguuuguggcuuaagcaaggacauuaauccuacuagaugaaggggaaguugguucuguugucuuaagggaugcccccuugugauuuuggucaacugaaugaaaaagaaaagauagccuuggacuuuuuuuucaugggagguuuggaggucaagcauguagaaggaaaaggcuguagucaugaauauagaacugucugcucuccaccuuuuccucacucuacauuuagucaucacacugaacaggauguggccugcugacagugaguagcugaagugccuguuugguaaguagguuagcauucaucaugaacucugaaagccauuucagaguuuggcugcugcucugacccugcugugguacaaaaaacauggauuuuuuuuuuuuuaacuggaguaauaccaaauucccuuuagaagcuugaaguuugauacuauugcuuuccccauuauaaggauuauacaguauuaauuaauuauaaggcccaaaguuuguuuuggcaaauaaaguauuauucucuaucaucaucuuuugaauuccugucccuaguauguucuuucauguucuggguaaaauuuccaacccucaaagagucuaaaacgucucauuuuuuuuuaccacguccuccccaguaagaagccaagguacaacucauuguaccuacgagguacaaacucauuuguagaaacaaaguaacuagauauuccuauugaaauaagaauagauauauuggugggccaggcaugguggcucacgccuauaaucccagcacuuuggaaggccaaggcaggaggaucacuugaggccaggaguucgagaccagccugagcaacauggugagacccugucucuacaaaaaaaaaauuuauaaaaauaaaagaaaaaaauaguuauaugacuaaacuacuagucaauacagcuugcaauaauagugcaugaaugauaacaggccucggcuuuaucacccaaaaaauaacuugaauucuaugugaaauguguuaggauaaguuugcucugucucuagaguucaauguagaagauaauuaagagguaaaauaugaagcuuaucauacacuaaaggagaauauuuggaguuagaugagccugucacacaaagugaaaguggacccuccagaaauuuuaggaauugccacaaagauugaugauagaugaauaaacagauuuguggccucugguaaagaaauccagccaaguuccucuguccaaauuuuuaagugcccuuugcaagcuaaucuauuuggcaaaaaaauagucccaguuguucaacuagcucccuuaaaacauucuaguagguguuuuaaagccuagguaucgcugccucuuuaguucuugaugaauacaaggcaaaaaaaaaaaaaaaaaaaaaaaaaaaauugaggcuuucacuuuggcauuugcuucuguuccuuguaucuguggaagucaaguagcccuucucaaaaaugagaagccaagcuuuaaauagcaaacuacaggguauuaaaagacuaacucuucaguuaagaacacuguagaaaugguagaccaacuuaaagucuaccuuuuaacaaucuuuaccccaaaccuaaagauucuaggggucacuuaucucuauuacguaaucuaacuggaauaauuuccuagaauucuuacuagugaaaucuuacccaaguaaaacaauuuauuauuuugaauccaaaugaaagcuauacuguuugcuuucaaugguggcaaaaacuugcaaaaagcagauauacuuuugcuaauuuaaguugaaguacuaugaauacaaccugcuaaucuugauccccaaaucugagcccuucaguuucauaauuguuuuauccugaacguaguugugacauagacauuucucaaaagggucugauacaucaaacuccuaacaaguaggagcagcaacuagcuaaagaguagaaagaagcuucccuuauugugggugaugaggcggugccuaaaaaccacauauauauaauccccuggguauuacauauucugcaagcccuguuaguggggagaugguaguggcaauagcagcgauaguugcgucagugcuaacugcugcugcugcccguucuguuggcggcugcuggccaagugugcacacuuagcccugguugaggugcauugucugcugucgucuguuaagcaucuaaccggagugggagggcacaucaagcgauuucacucucuuaaagaaaagguuuuuagguauuuuugguauuauauagucucuaaggccagaaggggcuuauaaugacuucucuucuagaauuguaauacuaaaaaacuacucgaguaaauauccuaacaaguaugauuuuucuugggaaaacuaaaaauuguacauccaugcuucagccauaucaugggccuaaacuaugagaguucagaaauauauaaaaguacaaaaaucuucaaagguacuuauuuccaaauauggagggaaugaaucugaagagggaacaauggcguuuuucgaacuuauuucucucuaauccagccuggaggauuuuuagccgaaacaguugcaugugaaggauuaucagccaucuuugcauaucccuuucacaucuaccuucacacaggaaagcugaaugcauuuuaccagugaggcucuagauaugaaacuuagggauccauagauaaauaagcuacuaacaaacugauaacagugguguuccaucucucuaucaugucuccugaguccguuucacguuuuugagccuggcuaaugagaaaaagaacaaaguaggaccaugacccaguguucuccuguaaaucucacuguaaaaaucucaaugcaaaaacacugagacaggagugagaccagcugcggguggggaguuugugcuccgcagguuaccucauggcauaucaaaaauggcuuuuuucuucacugcgcucaaggaaaaagucagaugggugacaaggugguucuguuuagaagcagcaggcaauguaguuaacagcauagacuuccgugucuugugugugguaccuugggcaaguuacuaacucccucuguaaaguagagacgauggggacugucucacugugacaagguaagauuuaagugagaugcacacaaaaagcucagcacagugucuggcaucuaauaugugcagggcagaugucacuacugaauaucacaucaaugcuagggcuguauuuacugucacacacaggcaccgguaagugacuuuaccggugaaagucacagguaccuuuaucuaugaugaauguaauguguuagauggugaccgaaguguucuccacuacaccugucugaagagaucuaagucugauauuuaaggagugauagcaucuugcauacuuaagaaggcuuaaaagacugcaugguuuaaacccuagaaacauaaauggaauguuucugccucaguucuuuugacuaccuccuaggacauggaaacaaauauuugggagccugcauagucuuuagauggcugccaaagcacuuaaaaucuccuuuaaauucuuaccauaugcuuacuuuuguacuaaguaagugcucccaagucuuuuacuugcucuucacagcaacccuaauagguaucuccauuuuacauagguaaaaacugaggcuacaaacaaucuaugguuccaaauccuaugugcuuacugccgucuucucuuagaaggggaugcaguacuguacaaagauugagcuggaugucgcauugcauguuugcugaguccuccucauugcugauguuaggauccuucaacaguuucucagaugccagcuauggcuggcauccaguauggugguguaauggaaguguacuacuagcacuacuacaucaggucagcacagauuaacucaguuacguguuauaccuucaagacgcuagacauuccagaauuauuuuccuuggccauccaagugaaguagaaguagauuguuggauugcaaagaaaaugauaaagauucccuaaaggaauuuauaagcaggcaacuucauuccuauguauaagauauugggagaaaacaaacuguaccacaacaaaucuuaaguuucaaggcucuccuauagggagaaacauggccaaaaagacaggaagaacuguggcuuguaacucaaugaugcuauaacuccagcacuggaucuuaaguauucuggaauauaccagauugguagaacuaccagacuuggguauuucucaguuaacacacaugcaaggaggaagagaguuuuuuugaacaaaaugacuggcuuugacaaaacuaucuugcucuuuuuaaaugucacuugauacuagaaugcgauuuaaaagcauguaaugccucaggaguccggcauauacaaccaaauuaucaugcucaggaucuucagaauucuaaaggcacauguuagaaugcagaguccugaugaccugucaauaaacuuuuuuuuacuaaugaacuguacauuuaaauaaaaguuuauuuuugggauaauugug

SEQ ID NO: 18795 - RNA, 307652 nt, Homo sapiens
ccucucucucucucuuuugugaguuauagcaaccguugccuugugaaucaagcgccauagucaccguaguccuggcgacuguuacccaucaacaacaacuacuccucuccuccuccuccuccucuuccuccuccuccuccccaccaccaccaucuccaucacccaccaacaacaccacaauaauccacagccaaggugaauauucuucggucucuacaugugugugggagcguguggcugcgugugaacgcguguguccgugcguguguguguucgugugugcgagccgaguguggcugugcuggggucucacuccugacacgggggcugccgcugcggcgccgccgccgaggggcucuguuccccgggcuuguuuacaauggacccugcgcgccgcggcugggucgggggugugggcgccgcgccgcccgccggccccggcccugcgccggccgcacuucagggauggagcgggagcuuggggggcugcgagccgagcgggagagggagccacaguuuuccgaugcggaugcuggaucuuucccuuaggucuggucugaggaggagggucaggugaagagauaagaauuuguucuuucuuuaauuuucuucuuuuccaacgcugcuguuuccugcuucuuucaaagccgaaauagacaacagugugcaagggggggacccaagaggugguguuuuguuguuguuguuguucacuuguggggccuuguuauggguuuuguuauuuuuaauccucauacguuggugaacuuuucccaccgcccauucccuucauuuuugccccucuuugccuggugcugaaugggcugcucuucuuucaccaucaucagcuucaugguuuucuuuuuucuuuuuaaaacuguauuuucuuugugcggcaaacagucuuaacauccauucagcacucuucccucccccucuuucuccccccccccacacaccccuugcacacauauugaaaccuggggccuguucguugggcccucuuugcuguacugggaaagauguuuuucuuuuuuaaagucugucuccucucucuucuuuggugugugugugugugugugugugugugugugugugugugugugugugugugcuugugauuuaaaccggaugcagggcaucugugauacuuggguuaguaguuauugacagugcuuuauccuucauguggaggugggagggggaguagugagguuccguuucacuuugaugauccuccuuccccgcaguagaguguuaacaauuuucauugugauuaugagacuuugugaugaacagggaagggacacaaggaagcuuugugagaacucaguucacaguguuauuugugacaguuaugguacuuuaagaguuuuuuuuuuuuuaaucuccucauuuuccuuugagaguugaaauucaagucaaguucauaaagaauguaugaagguucucaacuugaaacguguguauauuucacuuucuuucugguuaagaucuaggcauguguguacuuaacauauucuuuuuauuuacuuuuugauuuucuuuggacagugacuugaaccugcucaggagagagaacuuuuuccuuuuuaaguauuucuuuuaaaaauuauuuuucucuguagauuugaauacuuauuaguccuuauauaguagguucuugguuaacguuaacccaguuuuacagauccccuaaauuuguucauuuuuuucagcuuaacuuuuaguuaauagauuuaucaguagaguuuugauaaugaaugugugcuaaaacaaauauaauguacuauuguaguugcacauauugaaguuuuaaauuuacaguuuuaaaaugcuuauucaaauagucuucuuucuaacagcaaacauauauugauuuaacugacacagcagcuugugaauaaugugacaguacuaauuauucuugagauugucaacgagcaggguggguaauuauaaugcuauuaaggcuaauauuuuguaaaauaagaguugggauuuuaaaaaaacuuuuucaauucauuuccuugugauugcuauuuuaaaugaagacgauauuuuguucugaaagaagucuuucucagagcacucagauuuguuuauaauuauuccuccucuccccaaacuggguuccaugcaaaucucuaauacuaacuuguauuuuuuuuucuguucagaugagugucaaaugccugaacacuuuuggauggugaagcuccuggguccuauaaacucucucugaaguuaauaggaguuuugcugucuugggacaguuucagaccuuaugccauuuacauaauagguuuucaguuaaguaaauuauauacuauaauguuaugguuuaauauuuuauuuacagugucugagaacuuuuuuugaggcauuucacucauguauagcucagguuuucugugauuuagauuuucauucacaaguugauuugagagcagaacuuaaauugaauuucauuacuuuuccauuuuuugaagcauauaugugggauaaaauugcuauuagagcugcuguggaauugauuaaauaaucagaaacacugagaaaugguaaauuuaaaaauuaaacacaaggauagauacuuagcauuuacuuuauucuuucuuaauauuuuuccuagaagggacuauguuauguauugauacucucuuguguuuucaguuuuuauacuaauagaaauuuguaaaagugaucaugcuuugaaacuaaaacuauuaaauagaagucacuuguaacuuguuuugaauagucaaaugucugugauucaauguaugucauaaugccuaacucagucguuuugguguguuuugccuaugaauuguauuaaaugguguaggcaucauacauauacacauauauggcaaacuaaugaauuucuagaaguuuugcaucguuucacaauguuuucauuaaagguuguagugaugguuaguuuuuuuuguauuauuccuccaguacucaaauagucuuguacucugcuuugguacucaaauaaaagguuauaguuuauaagcuuacugugcuuuaaccuggaacaguuuauuuuacccuaaacaauuuauuaugguuaauuuuuuuaccauuaacaauagcaauuaaaaaaugaaugaaucuuaaaggcaaguuggauuuuaugcgucguuuaaaugauaauguauguuacuuuuugguaacauuuuucauuucuugagaaaguugauauuguguugguauucuccagcugaagaaauuagcaggcagaauauaaugauuuuugguuuucagauuuuaaagucuguguguguguguguguuuguguuuaaaugggugggcauagcagcagauguguggcaaaaguuacacacacacacacacacacacacacacacacgcacacacacuuuuccagaacaguaauaggaauauuacuuuguucuuaguauccauagugagaauguguuacaagaaaugagaauagggaagaaguaaacuuuaacauuuuugagaggcuccugguuauuuuguuuuaaugcugaaccuuuggcuaaaaauccucuauuugagcucaguuaccuuaaaaacaguuuucauaacugaguaauuugccuuuaacucuuugguauauauucccaguggccaugacaaaguauguuuuaaauuccucucuauucacagauacauaguguucccauauuuuggaaauccaagauuaaguggauuugacuaaaucuggcuuguuagggacagauggcugcuuuaaacaggugucacuuucauuuuuuacugcauuguguugggacuuccagugguugacaaaagggcugucuaaagcagguggcauccuuugcuuuuguuguuaguaaaaucuacuuuuagaguuuucuaggaaaaguuuuuuuuuuuuaaaguaaaaguuuugaacuacucaagauucguaauuuaacauaacuuuuauuucugaauauucuauuuuuaagugguagaaccugcagauucuuucacaaaacacuuaucaauucuuauaaauaaugguaaauucccuuugaauccagaaaaaguacacaggaacauuuuacacacccaagucaaaccccaaggccaauuugaauaaagugaaauuugguuaacaugacaaguuaacuuuugucauccuuuacugaaauaauuuuuugacagcauuuuuuauauguuggaaauagguguuguuuuuguugguuaaguauuuucaaacuaagacauuuccugacuucauuuacugcuauaaaguuuauagugaucuuuuaaaaugauaauauuuuuaaguauuaauguucaaaaauauguacugcaguaaauaaaaaaacuaucaaccuauugauuucuaagguucacuuuuacucuacaauucuguccuuuucugugggaauuuuauauuucuuauaacagaugcaccagagggugcugugcuguuugcaacaugagauuauuaucacuaagaaugugaacucacuagaacuuuuauuuaaagaaaaaaauuuuuaauuauauaugcauugaagcauauaauaggcuuauuuuuauggaguuuaacauacuaucuuaauuggcaguuuuacaucagaaccuaacuucguguacuaauacauauuaccgcaacauauaacaauauaaagauugauaucuuuggcacugucuggcauuaguccuauaggcauauauguugauuaucuuauguagauauuuuaaucuuuauuucaaaacuuagguuacccugagaaucauacuauuuggcgauauguggcuuuauacuucuuaaauuucauaugauuagcacauaucaauaauuguccauucuuauaacacuuuuacauggcauagugauaugcuuuuuauuguauaaucuuuaaaaaaaccacuggaaaaauaaauggcaauagugguuaucaggcuaauucauaauaaaauaguauugacauuaucuagauaauucuggcugguuguauugguucacauuuauaaucccaacacuuugggacugaggcagaaggaucaccugaggcuaugaguucaagagcagccugggcaacauagcaagauuucauuucuguaaaaaaaaguaaaagaaaauuagccagccuugccggugcgugccuguaguucaagcuacucaggagacugaggugagagaauuuuuuagcccaggaguuucagguuacagugggcuaugaucaugccacugcacuuuagccugggugacagagcaagacccugucucaaaacaccaaaaacagaaacgaaugcaauccguacuucaugcuguuggaauaggcuaguuugauuguuuaauuuggcuuauuaucugaaaacuuuuagguucccagcccuacugugugccauauacuuuuaaacugggagugaucuuauauugcuuuuuguauuuuauuuguucagugagagauuuuuaggagaauacugaauccaaucuugggcuacuucuuguaucaucgacucuuuucacagcaauauauacucuaaaagacauacugaaacagugauaccuuccuuaaguaagcuuagaaagauacaguuacagcauauaaacuuuuuaaucuugauaauggauuuaucuguacuaguccauauuuuacuauaauuaguuaauugugauauuuuuauaaaguaagcuuacaaggcauaguaguucauguguguuagacugccucaaagaauccaaaacauuuauuaaaguaacacuauguuuaaauacuggucuugcuaaaauagguuaggcauuuuucuuuaaaaauauaguccuacaguuuaccaguuaguuuuugccacuaagauuuuuccuuuuuugaaacaggguuuugcucugucacucaggcuggagugcaguggcauagucauagcucacugcagccucaaucuccugggcucacgugguccuccugccacagccuccugaguagcuaggacuacaggcuguugccaucauuuuaaaauuuaaaacauuucaauuuuuuuuuuuuuuguagagacagggucuugcuacauugcccaggcuagauuuuugaaaguauacuuuauagcaaguuguauugcuucaaaaucuuuauauuuguaguuuuuauuucguaucaaaugcagaguguucuuagugaaaacaaaucaguuaaaaauggaaacguguuuagaguaucaauaaauagguauaaauagguuuuguucuuuaaauagauggauagaauaaguauacuggugaauaacaggcuuuggagucagauuucagauaaucucauuaguugugugacuuuggacaaguuauuaccuucacuuaaccucaguuuucucauuugaaaaauaggaucaaucuucccugccuuaugggguuuugugaggauuaaaggagauaauuuauguaacguacuuugcucaguauuugacacaauauguguucaauacgcguuggcuuuauuuuuagggaaggcugagaaaauaccuauucuaaucuuuuugcuaccuaagaauccuuugaccaucccuuuuuuaaugagcccaaaaaguuuugaaagacuuugcuuaccaauuuauacucauuaaauaauaauuauucuuuuuccuccacuuuaaaaaauaaggcacagacaagcugccaaucacaggcuuggauuaucauuugauaaccagucuuaucacacugaauuaauagaaugcuagcccaaaguuauguuuuaguuuuacucugcagccuuauaaugggcuccuuuuacuagguuugcauaacucuccuggucaaaggauuuuagauuaagaacuaaugauguaauaugucauuaucuguuauacucccauuguccaguucauugucccacuuauauuuuuauuuucacguuauacaugaauuauuugaaaacagucugagcccuauuuauaaacuuuauacugaauguagucaguaaaguuuaauaauaauaaauagucuagucaguuguguaaagaugaguuuaucaaagaauuauucuacauuuuuauaaugcguugcuuagaauuguuacuuuacuaaggguagaaaaaugugugagguuacuacuuguguaccuacagcaauaaauaauuuugggaugauuugucaaucccaaucuugaguuguaaaguaaccuuggaacauuauuuaguguaauauauaauaugaaaucauagaggaaauauaucaccuguggcuuccuuucauuagauauuaaagauguuuaaguaacauuuucaaguuggcugcuuaauuauuaaaguugcuauucaguaauuuccuuuauuucuauauuuuuccugaacauuuucaucagaaugaaauacuuuucucauuuuagagugaucuauaaacaguccuaaucuuucucaaacuggaaauuugacuuauauauuucaguugagaauuuaccugauacuauaugucuuuucuuuuuugccaaagcauuguauauuguacagauguuugucugugucacucauuucaccauucuccccacucccguuaaguguuuaguuauaugacccccuuugcguuauuuuuguagauaauuagccccaacauaucaauuagacugacucucagcuuagccaccuccucugcuuccuuucgccagugaauuugacacagauuuaaaaggaacuuuugggaaaaguuuaggaaaugugauuuggauggucagguuaugcagucauacauuacuuaaugauauggauauguucugagaauuacguaguuaggugauuucaucauugugugaacaucauagaguguacccaacacacaccuagaugguauagccugcuacacgccuaugcuauauaguauagcauauuguucucgucuauaaaccugcguagcauguuauuggacugaauacuguaggcacuuguaacucagagauaaguauuuguguaucugaacauaucuaaacguagaaaagguaaugcauugugucaagauguuuaguugguuaugaugucacugggcuauaggaauuuuugagcuccauuuuguuaugggaugugguuuguuguugacagaaauguuauguggugcgugacuguaugguuauucuuaccauuuccgauagucuauuauuaucuuacaauuucuacucaucugacuguccucuuggacaaauuuauaaccuuguuccacuaacuauguaauuugagugugguuuugauucagaaggcucccuucuuaguccuggcuauguacuggccucuggcuaaguaccuuaggguuaaaucuguaguccauaaacacuguguuugcacaaucacagaugccugcuguuguugacuuuuaauuccuggauucuccuuucucacuuuuauuagaagcaguaauacccagcuaguacugcuugccuuugcuuuagagugcuuggucaagauuucugaagguucuugguaauuccuguuuaggcaaaaaugagguauuggguaauaggaguugagcuuaggaaaacuaauagagugagacagcuguccucaaaauaauaguguguuaguugguaagaggagacagauacagugaaagaugauaaaaggagaaaggacagcgagugaccaggccaagauauaaaggacuucaaaaaugcuagccaaaggagguuaaagagaaaauaaagguucucacucuauuucuaacuguaaaaccuuagccuggucacuuauacccuauaggucucaguuucuccaucuguaacaugaaacaauagggcuaugggauuucuaaagcccuuuccaaucuaugauucuguagcaagauugacacugggaaagggaaggaaacaugccaauaacauggagccaggaauuggcauuucccuuacucauguucucaaaggcuagcaaguuguuugcuuauuguuucuucugguaagaacaagaaagaaagaaaacccacagccuggugcuagcauaauggccauaccuauagcaaagucucagaagguuccaccauuucaauggcuucuguagagagugguggccaagugcccucauuuucucacccacauaggaauuagcugagucucacagcuugagcuccugccggagccagcuucucuaugugugugugccagacaagugucugacauuuggggcuccuccugucuguugcucaccaaugagauauuuaaaacaggacauaauuucccgaguauguggauaggcaauuuaacagagagagagagagagagagagugcgaaagcgagcuagugcaugugugcucucugaucagaauaaaaauuaauuuagguuucuguugaucucauuuuuaagacauuucuuccccaauuauugaagcuauucaacugguuuuuaagaagagcuaaaaaucccgucaaggucuagacaagcuccgagagccuuuggacuacuuuggggucccuggucuggaaagcauugcuauccuccacacuagucucauauuuuuccaucgguaauaguuacugcuuuucuuuuucuuaauauuguuuauacuuggauaagcauucuuuuaauucagcuuugguagcagaaaaauagucuuuuguuuaagaaguauacauuuucuuaaauuuuaaaaaauuuuuaguuuaggcugggugcgguggcucaugccuguaaucccagcacuuugggaggcugaggcggguggaucacgaggucaggagaucuagaccauccuggcuaacacgaugaaaccccgucucuacuaaaaauacaaaaaauuagcugggcgugguggcgggcgccuguaguccuagcuacucgggaggcugaggugagagaauggugugaauacaggagguggagcuugcagugagccgagaucacgccagugcgcuccagucugggcaacagagcaagacuccaucucaaaaaaaaaaauuuuuuuuuuuacuuuaauacuacuuugguuaguagacuucucaagauuuuagaacauagcaggcuaaaagaggaagcauuuuugcauuuauucaggauaagucauauauucugcuguaacucaacucuuuuaccagccuaauaggggaguauauuaaagcuuagauuguaauuauugauuuaaaaaauuuauuuuugaaugcuuuguuuuuuacugauuaacuuagacauuuucaaguuucuggacuacauucagauuugcaugccuaauagcauuuguguauuucaguauaacuuucaucuuuaaaauauaucucauccccuucagucucagucagcauaguuuacuuuaauguucaaaaccauuuuagagauucuuugcuugucaguuaaguuuccuccauguuuuaguuguggaggaaugggggagguugcuguagaagggcaggaaaagcagauacauuuaggaaucauauccuguuucuauuguuagacaucagugcauuacauauuuuccccaguuaauuuuccuggaccauuaaguuuaggcgggugugggggcuugaggugggacuuacggggcguagggaggugggagacagaagacucaggugauccaguauuucuuccagauuucuuuccuuaccuacuguaauauugugcagaauacaucuauuuuugugaagacgggcauucuguuuaauuuuguuagugauuccuuuuuuccaaagaaucaauauaucuguauauaucuauccauuaguauauuaguagauggaaaauaauaucuuucuuuuuuaaggaaccugaauuuugauuuagucaugcacaaauuuuagaaaggaauuaaaaagacuggugagaaaaucuaguucauaagcaagguaacaguagugaugccuuaaaucuaccucuuuauguuuugcuuuggauaaaugguuuuguggauauauguuuuugcauuagaauuuagguuuuccccugauacuauuuaugcuauuuuaaauaaccaaagaguaaaaucugucacaucaggcauuugcugauuggcaucugauuauaucuaaugacagucucagagaugaauuuugaugacgugucaguuuaagggucauuaauaaaaaacaugaaaagcuauuauaugaguaaucugaaaaucaccuuuacaacuuuaaaagcacaauauguauuuuacgugccauggugaaaacccaacuugaaaaaucaguacauaacacggaaacccauaaauuuagauucuuuguuucauaaaaugauuauauugcaugugucuuaggagcauuuuaaaauacuuuguuuagcucacacuuguaaucccagcacauugggaggcugagaugggagaaucccuugagcccaggaguucaagacuagugugggcaacauagugagacccuguuucuacaaaaaauuaaaaaauuagccgggugcaguggugccugccuguaguaccacccccucaggacugagguggguguauugcuucagcccucgagguggaggcuggaggcuguagacaacccggagccugggcaacagagggaaacccugucucaaaaaaacaaagcaaaacaaaacaaaacaaaacaaaacacaacuugguuaaaaaaauuacuuuucaauuagaguguaguagauauauuaagaaaaauggaguuuaacuuaauguguuuuguguauguguauguagauauuuagaaagucauuuuaauuuacauuuugcuugguguuguagaacaaucaauacuguuuuugugcacugauuuuugcauuauccaucucuuggaggaucauuaggaacauuuaguauuuccaccuuagugcuauuuucuugaggcaaagaaagauuaggggaacugucugaugaaguucuuugaaugaccuucguguaguuuugugagcaauuuuuaauagugucucacauuguaugaugauuuuuagaggcuacuuucaguuaauaaaggccaugaaugcugaaauugaauuaaauuguaguuaaagacaaaaauuguaauucauuccaauuauaggagguuaaaauauugugcuguuggaucaacauuugaucuccuuauuuuuagaagucugccaaguuuugaauuguaaaaccuuuuaaauaauauugaaugaguagagcuguauaguaguuguggguuuauauuucagcaaagauuugagugccauaugucuuggaaguaaggugggauucuuuuaucuuggaacuuggaaagagauuuauuuuaauauuuugauuggguuagguuugcuugagcauuuuuggggguugauagaaaugcaaaugacuauggacuggagauacagaucagaguaauuugugagaggagguaauuguagcgauccugaugcaacacucacuuccaguccuacugcccgugauaaacuuugaaguaaagacuuccuucuuuaaugauguaagccucucuauuaaaauguguuuuguuaauuuucauugcugccuggaauuucccaaauguacauuaucugggagcuuuggaaguuccaguuuaccuucuggauuauaaaccuuagaaagaaugccaauagauggcaccccaugcccagaacaacaccuuaaucugaaggaaugggguaaaaaaugaagugcaggaucauauaauuugaaaaacuagaguaugaacagugacuaguacaauguagagaaaaagaaauaucauuucagggacuaaauaugaaucccaguucaccauauucugcauauucugcauaucuaguaauaauaucacugcuaugacugaugacauuucuaauauuugauucaaaaacauucuagcagagaccuaagauaauuggauaaauuagucucuaagcuuuugguuuuuuauuuugucuuuuagcuuuaauuuugaaugaggaauuaaaggauuuauaucaauguauauuuagugcaguacuauuuugguuaauguaggaaucccgaaaugacuuagauuuccauugaguuuuaaggagcauaaagaaaugagagaaauggguuauuagauacaaaauugcauauucucagcuauguggacauauuuuuuaagguuuccaauuguagaggguuacaaaaaggacauaacgauauuugggaaucaagaaggauaaaaaaguguuggaagagauacugaaaaguggaguugaaugaaauuaguagagaauuuggaaauaaagauaaaaauaagauggaaaaauuacauuaugaauggugaaauaauuuauugaaugaacaauuucuuuuuaaaaucuuuacugugauuuuuaccuaaugggaggacccaaggaaaaagauuguacuuagccucuuuuugagcaccacauuuguuuuuuuguuuguuggaaauuuuuauaacaaggugcugggaucuuugacuaguauuguaugagguuugacuauuucuagacauuguauauagaaaagauuaaauugagguguugccucagaguuuucuuguaauuauuuuauuauuacaagguaauauauuaauauauaaaaaacacaaaauuagcauauccaguugggauaucugauuaguuuaucugauaucuaaagcagccuacaguuguaaagucaguauauaguaaaaaacuguguaccauaaauguauauauuccuaaaacauuuuauauuuuggaacauuuaaaacuuacacuggaguaguauaauaaacucccauaugcccauuauauggauuuaacaaaguaguaccuucuauugcucuaaagcuauauaauuugaaauauuugcauauugaaauaaccuugaaucauucuuuacuuuguguugcuuugaaaauauuuaaaucuuaugcuaacaacagauucaauguauacuugaaaaaaugcuuauguuuaaaacaaaauauuuaaaaaugaucuuguuuuuucucucagcacagcauuucucuuauuauuuauuauuuuuguuuuuauggguacauguuaaggguauauauuuaagggauauuucgauacaugcauacaaagcauaguagucacguaagaguaaauggggugucugucaccuuaagcauuuaccauuuccuuguguuacacacauucuaauuauacuuuuaguuauuuuaaaguguacaauaaauuacuguugacuguaguuacccuacaagcacagcauuucuaaaucaggaaguuuguucuugguuuccggucauaucuuuuguuuaguaauugaauucaagucuccuuuacuugaauccugacccauuguuaagaaagggagaaaguccagggacaguagcccauauuugaagaaaccuguguugaagacuaacucucccaagggugaaaugggguuaucuuuugucugccauucuuuuaacuuuguuuguggguauauuugaguaaacaguugagucauuuuguaaguugaugagggaagagaaccaacuaucuucugcuucuucuggaauauuuccuucaaaguuugcuacucauuuuguuucuaauagaacauaaaggaagagacaucuaagagcuaauguacugauaguuuaugauaucacucaaagcaguuuaauauuuugugguuuaguaucuucagggaaugaggagguuccuucucuuaguuuuuuuauuugacugaggccagacugguaugaaagaaguuuauuuuacaauucuaaaaucuauagccaaaaaaaaaucguuauucauguaauaauggucuuacuacaugaaacuauucuauaaugagcagacuaguauuauaacaaauagugauuaauggcauuuuaauaaacaacacaaaauuuauaccuaaaucuuuuuaaaagcugauguuuccuuguuugaaccuaauuaaaugauuaagauaugaagagguaaauacagugcauuaaauaagcuugcauuuuuuguuuguauaauaacuuuaauugccaaacuucauuaugauccaaaggguucaguggaauuguguaugacuuaauauauuuuguggcggucuuuaaaaauauuucuguacagagucacuagacaaacugaguaguaaagugauacaaaauaaccaaagugauacacuaauuaaaugaucuuauuuuagaacuaaacuguuucuuuucucaaaggguuauauauaauucuaacugacauuaggaaacaucuucauuauguaauucugccuauuagauuuuuauacuuuucaaaaguaaauagaagauacaguguaugaagaaaacaccaguauaaaguuuaaugagccaaacaauaugugaauaaaacguaaauguaacccugcaaaacagaagauuauagaauguacauguuauuuucagaaauauuuauagauuuccuuaugaauuuaaugcaagaugaguuucaacauuuacaguaguaacuuuuucugugcuuuuagauaccuuguacuuaaaaucaaaguauaauuuuauuuggcuuuuuauuauuuuacauucuguuuaguaucaaugaaagcacaggcaguuuuauucuaguguuucaaaguuguuuaguuuuaaauuugaccaguacuacauuugcguuauaggauauaauuuaaaaaucagccauuuucagugugggaauaauaauauugauccacuuauucuauguuugaguaacuccucaauaacuuaaugcuguaauuuggaagaacacugucucuucacauuuaaaggagaguuuuguuuguuuguuuguugcuuuuuuuggggggggcaagaaaugaucuguaucuuauaaccuggcccuguuugcauagcagcuaaacuuuugggucuggaacuucaaauccccugugaugaguaucuuucuuucucaguggccaacuucagccuuucuuccuaucucuacuaauuuuacugccauauuccacuuuccguuuacuaugucuggcccugcacagcagaccaaaagagacagccaugggacuacagcagauuagagaggugaaaaggucucucacuagagucacacauguuuccaaauggcccaaauauacaggauuucaguagaaacauaauuagaauguuuuauuuuagagucagauucuuuuaguuggaauggacuugggaaguuaucaaguugaaccccuccuuccuccuccccacuucuuauagguaagaaaacugaggguaagugacuuguacaaugacauagaacaucagaauuaggacugucgaacuccagccuccacacuccuccgcaaauguucuuagggcuaauacaaaacuuuuuuuaaaggcaaagaacucaaauguacugccuuuaguguuuuaaguaacuguuuaucuauaauuuugaacuccauauuuuuuucuagaaaaagcaaguuuuauaaaucugcauucaaaguuugcauaaauaccuuaauguucuaauuauuuccaaauguaauuuuugguauauggauuauuuuuagaaugacguagaaauaaaauuuaaaaauguuuuccaaaccaucaguaggcuuuauuuuaaggagaaaugccauacuuacuagguuuuuuaaaaagaaaaauauuguauauuuaauuccuauuauuuguauuuccucuuauugggaauuaaugauguaugucauaaucaauguauuaguguaaauaauuuucaguccugguaugcacgucuuuacuuuuuugaugaggguaaaggugcuuuuaauuguuuuaagaauuuuuguaaacauucauuuaauuaugaauuuuaaaaauggaaaucuuuguucuuguaggucacucuuuuguggaacaaaaguaaaauacuggcagcugauauaggugguacaagcugagacuugcccagcugggcuuuaaaaguguagcagcgcucuuaaguagcagugaaugaacagaaugaauauaugaacggacugcccuuuauuccauagcaaccagacgcaauacuggcaacuaugcuauuaucugauuuuuuauuuucuuaaucugaguuuuuggaagguuauguuguuuacuuuuuaauaguaugggacuguggcaggaauuguaauuaccaagauuuugucuaauuauuucucucucucuccucucugugucucucuuucugugugugugugugugugugucuguguuuuacaauuagaaguaaaucagugagcucagacuugaauuaguuucgguauugugcuaaagaugagcaguuugagcccuaacccuguuaauuauuugaaacagucaauuuaagagaaaccaagaauauggcaauugaacuucccaauguaaccugaugcucucugcagccucauuugugguaacaaauaugaaaggauacauuuauauaaaacaggaguauguuuccugugggggaaaaccgcuugucauuugcuuuuaacaagguguaaauccccacagauaaaccuucuuguaaaacuguucccuuuggauuuagccucaccuucaacaaaaagggagauguaauaaacgaaaguaugaugaaauauuaguuagcucuugcauuuuuugccuagaaguuccucuuuuuuauucuuuaucauuuuuuaaaauuuaaugccgcuguuucagaugaauugagagagucagaauauaaugcauuacauucauuuuacuuucuguuaauguuuuuagggggagagaucuaaauaauauacuuuuagauugaacuauauuucugauauaucaacauauauacugacucauaaauuagaauggaaaauacaaauauugaaaguguaauucaaaugaauagaaagugcuaaauacuugcaagccuuaaauugggauuugaauauagagauugaguuaccagaguaacuaaauacuagacugcuguauuuguuggaugugcagagaaggaaacucaaauauggaacguggucuuaaugucuuaugaaucauuuuuacuuaacuuuuaaaauucagauuaauagaguccucuaaaaagaagguuuuuuugaauuuuuagaaauagcucagaguuuuacguuucccucugucagaaucuuuucaggauuccucauugccucuucgucagagucguuuaagaaauauuuauuaguuaucacagugucccacagaacaaccacagucuuugcuguuaggaagcuuauagucucauguccauuuucaaacuuguauuucaccacuuuucucuguacuuccccuuuuuugaccagucuacauuucguaucugugggaucugcauuugugaauucaaccagcugaggaugggaaacacuugaaaaaagaaaacaauauauaacaacacaacaauaaaaaaaguaaauacaguauaacaacuuuauauagcacuuacauuguauuaggaauuauaauuaaucuagagaugauuuaaaguauacacgggaggauguguacaggcuauacacaaauacuaugcuauuuuauauaagagaguugggcacccuuuuuuaagauggagguccuggaaccaauuccccaugguuacggagggacaacuguauuauguauugguuaagagcaugaacuucaaaaugaacagcccugggugugaauucgagcucugccacugacuagcaguuuaauguuaggcagauuacuuaaauucugugaaauaggauuaauaaaaucaaccugaaaagauuguuucaaagacaguauaugacauagucaaaauagcacugugccugacaugugaguguuuaauaaauggcaauugcuauuauuauccuauauggucugaauucugccuugucauuucuuuucucuaaaacuuaguucucauccuuuauucuauuagaauguguuuucuacccuacuucaauuaaucucuucuaaaauuugaguggucccuaacuugauggguucauuucuaguaauuucuuauuaucucugcuaauuggaaauugugauuuagauuuuuguuuguucaguuguaaaugcuuaaucuuuuuaaauuguuuauaagcuuacugagggcagaagacuccauaaucaagguuuuugaacucagcaugagacccagugucuuuuucuaguagaaacaaugaauaguuguuuaagcuucagauugucaauuuggaaucucuaaucaaauuuuagaaaacacauuucacuauuuaaaaauuuugucuaguucugauuuuacaaugaccuuucaagcaaugcagucuuacuuuuauuauuuccauuggauuuauuuacuucuuuuuuuuccaaaaugaauuuaauggcaugaauucaugaauuucuggauauuucuucaaauagaguaucauguagcuggcaguggauugggcugaccuuaauccaggucuuuuucuucuuaccuuuucaaaugacauucugucaccucauucuauauuuauauauauacauuucucuauaugugaaauucuagacucauauaucuauauauagauauaauuccagacuuguuuggauuuucuuaguauccaacaaggcuaauaucuuacuuucagaaguuggggaaugccuuuaaggauucuauaccuuauuucuauuuucuaguugugacagggugcaagaauuccuuaauauaggagagacaugcggggcauuaugggaaccuugcuuugggggacuacuuugaauaucccaaacuuuggguuuuuccuucuacugccuaacuuuacugugccugcugggaugucaaaaguagaggaucaggacuucaguuccaggguuacaccaaggcaaccaguaguaucagaauggaauuacuacaguagugagauccauguuugcauuugugauauuuuaauuaggguugcacuaugcgaagguaugauuaucugccuuuaugucugcuacagagacuuuacccugaaaaaccuuuuuuuuuaaaaaaaaaaaaacaguuguccuucauaaaucuauccagcccucauuuuaauuaguguauauucauuguauaccaucucucgagaugaugaguugcugaauuuagugccguuugugaagucaucuuaaccucuuuccagacuuaaggagugcucuucaauuucuguaaguuuuaauauacaugcucauuucacuuuuuaaaaauuauuucauucauuucuugagcaaauauuggcacauaaaguaggggccaagaagugaacugcugugaaggauacaagaaugaauaaaacugaucauucuucaagggccucugcccuugaaggaacucacauucaaacaauugggggugagggagagagaagauaaaugaguauguauuauaauagaugguugucaaugcuauggaaaaaacaaaugugagaagcagggggguagagaguguaaaugauauguaaaugauggggguggagaagguuguaauuuuaaauaggaugauuaagaacaccuugcagauaagguaacauuugaacaaagaccugaaggaaguuuugaauaugucuucaaauguggcuuuguauauuuauaauauaauauugauacuuugguagcugcuggccuuccuguuaaagaguccuaauuuuuacaucuguccucacacagcacuuucugccuuucucuuuacccccuuuuaucauuuuuauaugccuuucccugaauauuuuauuuuauauuuuauauaaauauaaaauauuuuauuuuauauuuuauauaaauauaaaauauuuuauuuuauauuuuauauaaauauaaaguauuuuauuuuauauuauauaaauauaaaauauuuuauauuuauauaaauauaaaauauuuuauuuauauaaaauauaaauauacauuaauauauauuuauauauauauaaauauaaaaauguauauauucauauauauauaaauauauauucauauauauauaaauauauauucauauauaaauauauauucauauauauauaaauauauauucauauauauauuuauaugaauauaaaauauauuucauauauucauauaauauauaaauauaaauauauaaaaauaaaauauaaaauaaaucuaaauauauaaaauauuuuauuuuuauauuuuauuauauauuuuauauauaauauaaaauauauuauauuauuuaaaauauuuuauuauacauuuuauauaauauauauaacauauauauuauauaauauauauuauauauaauauauauuauauuauauauauuauauauaauauauguuauauuauauauauauauaauauauguuauauuauauauaauauauauaauauauauuauaucauauauaauauauauauuuuauacauauuuuauauauaauauauauuuuauauauaauauaauauauauuuuauauacaauauauacauauagcauauauuuuauauacaauauauaccauauagcauauaauauauauuuuauauacaauauauaccauauagcauauaauauauauuuuauaugcaauauauaccauauggcauauacuauauauuuuauaugcaauauauaccauauggcauauacuauauauuuuauaugcaauauauaccauauggcauauacuauauauuuuauaugcaauauauaccauauggcauauaauauauauuuuauaugcaauauauaccauauggcauauaauauauauuuuauauacaauauauaccauauggcauauaauauauauuuuauauacaauauauacuaugugguauauaauauauauuuuauauacaauauaugcuaugugguauauaauauauauuuuauauacaauauaugcuauguggcauauaauauauauuuuauauauaauauaugcuaugugguauauaauauauauuuuauauguuauauacaauauaguauauauuauauauaaaauauauauauaauauauaguauauaauauaguauauaauauauauaauauauauaauauauaauauguauaauauauaauauauauaauauauaauauguauaauauauaauauauauaaagagagagggagagagagagagagagaaagauguauugaucaaaacuaaggaaucgagccgauugagccauuuucaaaauuaaauucuugaaguccacccuaccugcuuccaaguuggaggcucuuuggaaacacuuaaaaaauugaacagcgugugcacaugaaguguuaaaaguaaaaauuacaauaauaggcaaauagaaauuagaguuagccagacugcuaauuugguugguuauacccuuaguuuacuuauggcuaauuuaaauuugacagaaucuuugcauaugauggcuucugugauaaaaaugcucuucaguguuuuauaugaaacaaugucauuguuuauauagcauagcuaucaucuagucaucuuugauaguaauuuaugaauuguauuuauuuguaaaacuuuguacauguaaaaagacauaaaaggcaaaugagagauuauuuaaauaaaaguuacuaauggaggcaaauugucuugaauucuauuauuuugacaaauagauugucauacugauauuuuuagaaugggguuuucuguguacuagugucacaaccauauuuuccauuucaguuuggugucagauacucaguuuggugucaaauauucagcauuaugugccugucauccauuaugaaauguacaguuucacaguauucgaggcuauucuacuguauuggacuacuuaaaaaaugguacaaaauaaaauauaauaaauauaacauaaauguguauacauuuaaguuauuuaaggaaauagacauuuuuauggaaccuuaagcaaagcaaaaaaccaucuuucucucuuugaacuuauacaauuauauauacaauauuuauuuuuaaucuagguuucuauccugaaaggccgguucaaugauuauacuugcaaauaugcccaggcauuuaugucugaagugagucagcugugcacacauuuucucaagcugugggccagagucuguugaagacgaguaccugguuauuucugacauuaaaaaaguaaaaaauuaagcaaaauuuaguaucuccacuuguuuguaccaccguuguguuuaugaaaagauaugugagguauaagagacuuuggugaccaaugagucuucucucauguuuuuccucguaacucuuuugauuaggaaacaucuaagcauauuacagcauagagcaguuugaugaaaugaugaagugaauuuccauguauccaucacucuccuuuaaaguuaacaacuuaugguuaaucugguuccagcuauaaucauuuauuccccaccuaucuuauuauucccauugcuuuuuaccuuuggaaagagaaccgacauagaugacucagggcuaacauucacauugccaguccauugcucugccuuguauguuguguuaucuacccuguggauggaagggugaggaaaaaaaaaucgugaaaauaaugaaaguuucuaaacaaguguuaaauuuaauauuuugaauugugaagugucauaugucugauguuagauuuagaguuggaauugaauacuguauaauuuuucaaauuuaguguugacugcacaaagacugaaaguucugugagaugguauuauuuaccucuuuauuaagauggcuuuuauguuuuugaaagauuuucuguguauuuuucuuucacuaaaaauugugaaauauauaagugaguuuuuggcauucauaauaugauguggcugaaauuauccuuuggauuuauagaauguacuucaagguaccuuuucauuauccucaauuauugauuucaaaaaucagcucauuucaguaucucaaguuuuuagauauauaaaggugaaugguaguaguuaaaaagugaaagugauuuuuuuuuuuuucuuuugagacagagucuugcugugucucccaggcuggagugcagugcgugaugugggcucacugcaagcuccgccucccggguucacaccauucuccugccucagcuucucgaguagcugggacuacaggcgcccgccacuacgcccggcuaauuuuuuguauuuuuuuuuuuuuaguggagacgggguuucacuguguuagcaagaauggucucgaucuccugaccucgugauccgcccgccucggccucccagagugcugggauuacaggcgugagccaccgcgccuggccgaaagugauuuuugauagaaguuagaaaacguguuuaacugagguuacucuuauagucaguucuaaucaguaucacauuccuguaauaaauuuuaauauuaaaaauuucuuugggcagggcacgguggcucacaucuguaauuccagcacuuugggaggcugagauggguggaucacuugaagccaggaguucgagaccagccuggcuaacguggugaagcccugucucuacuaaaaauacaaaauuagcuggguauggugauacaugccuuguaaucccagcuacucuggaggcugaggcacgagaaucgcuugaaccucggagauagagguugcagugagcugacauugcaccacugcacuccagccugggugaaagagugagacucuaucucaaaaaaaaaaaaaaaaaaaagaaggaaaaaaauauguaucuuuuuguauaucaacauccuuauugaucuuggcuaaacaaauuguugaaauaauuugaagaaacaaaauaaggaaauagucugucaggagaaauaauauuuuuauggcccucggaguaauuuuauuuuucuuuuuauacuugguaauacauguguacagaaaaguauucuaaccuguaagucaaguucuuguuuaccaacucuauuuauauaucaaagaauuuacaauucuugauaaaaauuaugaaauuaagaaaaaucuguucuauuuggcaacauuuacugaggaucuuugauuuuuaaaaauuuucuuuuaggaagguggguaaauggagaugaagcaaauguaauaggguguuacuaguccaagaaaacuggaauuugccaaaaagaggcuaauugcaugguggaauauguuauuuuauauagcuacauaguauauaguuucuuuuacgaaugccacacuuaauuauauugaagcuuuguagccuugaggagacaaggacccaaugaauaccagaaggcacauuccaaugacacugccaauauagauauccauaccuguugguuuuauuuuugccauuuaguuaauaguauugacaggguccuaaguauucauguaaccaguuuagaacuuugauucuuuaagaucagauccuuaacagaauuauugaauauacucaacuaauaauugacuaaguauuaaauaacuguuuuggaaguuaacacauuugccuaacacgugccuugugacuaguauacuccucaguagaaucugacuuuaauaacuuuauugacuaguguguguguauguguagugcguguguuugaaugauuuguucuuauuugggaaauaucaauuuuaauuacuuuuaaaagguuuucauacauuaggcccuauggaaucaaguuaaauuuuucuugucauacaggagaacuagaaaguauucaaauuaauucuuuguaaaauuaaguggagccuuuaaguuacuaaucuugguuuuuacauugugucugcugacaucacugaaucuuuuaagaacuuuuuuuucugaguugcauuuguuuuaagaaggaugaagcaaggaauauauaauuauugaauauaaacuuucauauuuguuuucucuuuuuuccuuuucuuuucauccggaaaaugaauccacauuucuuuuaacaaauccucuuucaguucucuuucuaacacguucuuguccgucauuuucuucuaccucuuuucucccauuugcucugcugugcugugcuuugcuuugcuaugcgcuguuucaguucuaaaccaccuuagugaacccauucucuucuugcuucauccucaguucuuuggucagauguugccuuuacaccucucaguguacuucagcucuccuuuauuguugauuucuuggccuuucuuuuuuggauaguuguuccacauuccucuguuuguugcucugggguacuuuuagagaaauaguuaauuucuuuuacucugcuuccuguaguguguaaugagaagaaaugaaagcaaccauugaaggacagauaacuggcucuuuaaaaaggaauaagguagugcaguugacagguuauuuaaaggguucccagcucagaauaguuaaguugaagggcuaaaugguuccaagaauguagagaaaaugucucacuuaaaaaaaauuaacuuuccaaaguugcagguaauauuaauauagcaaaaauauccguggaaaguccuggauagauuuucauaguuaagaugauuauuauuuuuguguguguggucuuugguauuuuaugauagaacaccuuuaucuuggucuccaaauaucuuaugaaaaaggcuuauuuaaaaauaaguaauacaaauuaguacaguuucuaaaggaaucagaagcugucccuuaaugucuacccacuuuucaaaauccauuucccacaauuugacuuaacaguauuucauuuauaaacucugcugugcuuuucuucucauuuacauucaaauaaugcuaucuaauuuuaguaaauuuaugugaauaauuuauuaaguguuaaucuuuaaaguuauagaaugugcauaugauaggcugguauagauuuuauaauuaauauaaaauuauuacuguccaaaagugaugaaaaaaaucuguuuuuauaaugaaauguugaacuucuugauuuuuaaaauaauuuuuuugggggaaugguuuuuauuuuuaccaacuucaugauuucugggauuccuaguuuuaacuuauuuuucuauuauugaaguuuauaaaaguugaagguacuuagugcugcuuuuuucccuaaaacuugcucaguucauuuauauccauuaugaccuuuuaggagacuguaugaaaauaaaaacuugggauugguaggugguauaauugaaauguagaugauaaucuguucauuguuuguuuuaccaaauuaguuagggauucugaggauacauuuugaauauuuguguauguuuagcauuuugucccuuuguuagaaaucucucagugugacuuguuuuuaauaggaugugucuugaauuguaggccaaucacuccugaaaaguauuaagcccuuuaaacacacugguuggacccauagagggaagccuacagguuuauuaguacuccuuauccugaaagcacagcauacccuuuuagguugcacagcaacagacuccuagcaaccguaauagauugaauuucuaagagugaccaggccggauguaauaauaaagcaagagguacaaacaguugucaugguuuucuuuucacgguaagcuaguuugauuugggaaagcuuagcuuuucaaaaaugggcaaccuucuuauaaaacuacugcuguuugugcacaggacuugugguauuaaaauagcaauaauaguaccaaauuuaaacagcuacugcuuaaaaauaauauacccaaaauaacaacaacaaaaaaaggauaucacguaaagaaguuuucagggaaguauuuuuaaacaguuuaucaacaacuuaaaaguguacuguagcaaaauaaugcuuuuuagaaauaaaacugauauuuguguuuucucacucuugcuguggcccucuguuucacuuugcagcagcuccuuguaguuuuaugugauucaagggauguucauauaaaacugaugauuaugauaaacuuaaaauuuaucuaagaaaacaggcuauuugaacuguacaugaacaacauuuuuugaaauuaagaacuaauaaguaguggagcacagaauuuauuaaagaagaguaaaguguuaaaauauauaauccuuuacagcgacaguaaaaguaucggugauauuccuaagaguguaacauugugcuguaaguuaacauuucuccuuuguguccuuuaguaugugauugcuaauguagacgugaaaaggagauuaauucagauacauucacaaccugaaacaagaugcuuccaucaaaagaaucagauccucauauagcugcuagaguuggaacuacagucuuugacagcaauaagcuguaaauauacacacaugcuaauacccuugauuuguucaucuuuugugucagcauuuggaaaagauuguuaaaguggcaguuauaguaaagacgggcaauuacaguaaagagcagaaauuagguauuugugaccuauuauauuucauuaaaagacuuccuuauuaaaauggcacugcuuacucugauuacuugacagcugcccuaaacagauuagaaaauacacagcuucagcuaaagguaaaaucagccucuuuaagcaagcuuauggcauagaacaaguaaaugguauaguguaagcaauuuuuuuguaacacuuuugcuugagguagagauguuugucagugauuaagugguguauucuuucacauuccuguaauaauaguuuguccacaguggcauuucccauugagauauuuuuauacacccaucugauaucauacuaguuccuacuaguaugaggcauccuaguucgagagaucagcaugacuucaccaaaaaaucuuuuuccugcuaagugaugaguuacagcuccaguucaauguaaauacugccuuuaccaggcaaaaacucuaauuuuuggaaguuucaccacgagguuaucaguuuuuuucuuuauccuuuaauaauccacuggagccacugugaauuuaauauuuaaauuugggcaucacuuucagaacauuuaauuguuugcuuauuuagagaagaauuccuuguggcacuuguuaccuucaagauauuucuauuuacuuuguuauauaguauagugacuguagcacuuuauagaauaguacugccuaucaauuguucagauuguaguuuagcaguuaaguagccugaauugguacauauuguaacauuucaagacuuugucacuauauuucacaucacgagguauggcauaaacacuguagaucagccugugaguaucaaaucacagcucacucuugaagacacaaacacagguucaguaugaagcagauuugugggaagauuaccuccugcaacuaaucuugaauguagauuuuugucaggacugucacaacauuaauagaaggcuuguuguaguacuugcauggaucugugaaauuuccacaaagaugcaaacugugcuguaugagacaguuguaugccaguuccacauacacaaguaucuuuaacuuacauauuuaguguaauuuuuuuaaucugaugcaucuugcaugaaguguguuagcuugcaaaauuguuagggaaaaauguggguucuuuugaauaagggaaaccagaguucaaauccugguuuugucauuugauagcuaauuauccuuaaauaaguuccuuaacugccuugaucccagauuuuuaauguaaaaaugggaauauuaccugaaagauaaagugaaagggaaaaugagauaagcguauagagagagcuuaacgugauaguacagaauuaguaguugaacuguggaagcuaguauucuuauuuucaucuuucuggcuuagucuuugugguauaggauaugaggagaguuuugcaggagaggguagcagcugaaaauaguaacauggcaguagacaaucagaaacaaaauuguuuucaaagaggaauguuauguacuguauguuaagucauuuucaguauugguaagugauuaagaauucuuuaaacuuuuauaaaaugaccucucauucagauuucaaucuuggggcaggaucauuaaagauuacaggagcaguaauagaaaaaaauaugcacuaagagaugaaauacuuacuacuuugcacaaggaguaaaauuucauuaacagaacaaguuuaguuauuuuaguaaauauauacaacgaggcucguauuaaauagccugucuuuaaaauuuucuuccguguaaaaaucuguaugagcagaagugacuaaacugcccaggcuuguguaagcaccuuacaauguugauauaagagaacugaaaaugaauauagcuucugcuuagaagcaguaaaguaacaguggagucacauaaaaguuugauuaccuuuggcacuuuuuggcccaccccuuaaagcuauuuaaugugcucaucauugauuuacaaaauaugguuuauguuugaauauauucuguuguugcuuaagugaccauaaaggcauuuaauuuaauuagaagguaauauguuuaaaagaauagaagugguuugaaauauaauaaugguuugaaguagcuagugugauuaaacugguuuaggcaguggcuauccuauuucaauucuuugaggagaguaaauccagccuaagauuaaugaaaggaagaggcacagaacaugcuuaacauugccuugauauuuuaagagugggaagaaaaccaggcuaaagugauacuuuuagagccaggggaaacaguacuuacacagauauaguuacgcagauacagucuuucaacuaaaaccacuagcugauucuauuguucugcacauuuuaaguuaaucauuuuuuucuugaguacaauuuaugugugcauauuauuaagccauuuaaugacauuuuaaagaauuaaauacugccaaaaauaaauccagaaauguuaaauuucagaguuaaaauauauucuauugauagcugccauuuuuuuacaucaaugaauauguaauucugauguauuuuguguggugcaaugucugacuuauggaugguacaguacaguugaccacuuguagaaauguagaacauaauuuuaccuuuuaugcuuaauugcauauuaugucuagcucagugacgauucauacauuagcuucauaaauuuucuugcuacauagaauuuuuuuuuccuaaaaauggagaaguucuugcuuuaugguuaucuuuuuuuccuugauauucugagcacuuugaaugguugaauaggggaaaguauaauauauauauauacauauacauuaauauacauacauauguaaauacauacacauaugaaauaguguggacuuucuuuucagggcaauuuaaaguuagaauucuucauauugauagaauuacuaggugagaaaaacuaauuaaacuaccaaacuuguccagacucucacuauugguaaggccuuuuaacaccaaaaucuuuuaugcaaacuguacacuauauauaaaugcuucucaaagugugaauggaagaccccuggaggcccuuuuucaauucccugugugaggcugcauuuucuucauaacuucagacaaaacagcagauugagugcagaacuagaugugagaaucugucuucuauuaagcaagacauuaauggauuuuauaaaaauguacaccaguuccauaguuaucaaauuuuauuuuggaaaauuuagauuauuuuauaauuuaaaaacauuaacauagaaugauuacuauuauuuuaaauuaaugaauguuuauuauauuucucuguuuuauuuucuaaucagauggguauagauagauacaacuaugauuuacugaagccuuaccagcuggagagagccacuguugcucaucucuucuuaauucugcauucagaaugucacauuucuagcuugaaaaguagccauuccagaaguauacacaccauggaaauuaguagaaaucacaaaucugacuuuuuuugguggggagggaaagaguggaauguugguuuuaaacauuuaucaguacaugacuggauauaacacaucccaacaaaaguucuuugggauucucaaaaaauuuaagaucugaagggguuccaggucaacaacucugcuuaucacaaaagaacugcugcuuguuacuauacuaugcaaauuuaacaccagagucuaugcaaauauaugauugaggcagaauuuucagccagguacucugucucuagagccacuuuaccagucuuuuuuucuauagugucuucuaacaagauuaauuccacaaagugauuugaaguuaaaagauacgugauaucuucuguggcucucaucauacuaaguacauagauuaauuacuuguugacugcuuugagacuaucaguauuauggggguauagaaaaauggaaagaaaaaggguuaugggcuugagugguuagggaaaccuucagagaugagguaaagcaggacauggaucuuaaaagguuguuuuggagguuuauuggcugugaggaagagguuaagcauacaauggcauagaggcaaguaugauuuugguauaaagaguuggaagagcuuguugggaaauugugaagcagauggacuggaaaggaaauggcuuaggauuuggaccuuaacuaaguuuauaggauaaccagccaguguguguguguauguauguauauauauauauauauauauauauauuuuuuuuuuuuuuuuuuugagaugagucucgcuuugucgcccaggcuggagugcaguggcgccaucuuggcucacugcaagcucugccuccuggguucacaccauucuccugccacagccuccugaguagcugggaauacaggcgcgugccaccacgcccggaaaauuuuuuguauuuuuaguagagaugggguuucaccauguuagccagaauggucucgaucuccugaccucgugaucugccugccucggccucccaaagugcugggauuacaggugugagccaccgcgccuggcccaguguauauuuuuuaaaaauggaucacguguuuagaugaaaguggcccuuuagggagauuaaucuggcacaucuguguaggauagauagcagaguggaucagaagucaggggaaccucucucaaucaucugaaaggaagcauaugguacagaacuugggcuuuuaauugagaaagacuuugguugaaauccuuuuucugcuagucuuuuacuuucaguucauggauaagauguagauaacaacuagccagugggguuguaaauauuacugagggugugaaagagccuacaacagguuagaugccuggcaccaugcuaggacccucaguaaauuauuaucaauacaacauuuaugacuacuacuacuauaauaauaauauuguuauuauuugaugaguuauaaugaagauucaggcugggcaaccauccuuguaaauaggauguggggaaucaggcccaccccgacaccaauaagagcaagaauacaaaugaaagcucacucacuauauuucuccauacuuaaauguugcauaucaguaaagaagugguuaaaucaaacauccucugaccuccuaacuugaccagaaacagcuuuauaaugagauaaaugaccacuuagaauucucagauuuuuuuagcaguucuguucuagagcauaguggcaaagggagagcugacccuuugucaccucaucuguguccugcagucuaccuccauuuuucauauccugggcucuuugccauagcaugcccacaagaucauccugcaggcaauguugccccaccccuugcaagcuaucuguugacuacccuguaggcguagaguugaguaugccugaaucuccaucugucaugaggaguauagucaagaacuuugcaugggaauuugggguccugggaaugugcugaaguagagucugaaggacucggggagcauggcccugggcugugcagacuucuugccucccaaggagguaccuggccagagggccaaagcaagcucucuaaagugaguggcccaagggcaaugggcccucucgccugagucucacgguugugcuggaagggacaucugacaugagugucaaaugagcagggcuuauuuacucuuaguuaugggguaugagaaaaugugagugaaaaaagaugaaagaucacuggguuucaggagaauuauggagccacugagaaaguaggacaguauuugggaguugguagaaugggaccugaauguagaauagccauguuuugcucaccguuauauccuccagcaccuaauuaccuucuagcacauugccaagcaucuaguacugauucaauaaauuuugaagggcagaguagauauuuugaauaguugugccagagaugaaaauaaagucauuguagaauauagaaagaaacaaggaaaauaaggucuugugggugaggccaauguagcacuuuggauuguagguagauagcaucgauuagcauggucaucuguaaacuauuaguauggggagacuguauuauauauuuaauuuuuguaugugugauaccaaacaacuagucuuucuuaaaugaauaauugaauaauauacaagaaggaacuuuuaagaaaugaauuggauuuuaaaguuaagaugagugacagaaauuuguaucaucaguaaacugguauaccugaggaaguuguaaucauaaaaaacaaagagauccuaagcaacugugguuuuugcucacaaugagauaugaaacagugaaagauauguucaaagaauagguuuuauuuguaaccuauuuggaaagaagaacacagaugacuguagacuggccuaaaauuuucacuugauauuugcaagguguauauagggaaagguaguaggagaaaaggauuagaaguaauggaguagggugaauuauaaacauuuauaacugcagauauguuugacucauguugcucaaaauuguuaagaaguauuguguagucguuuaguuaauaacauauaaggccucaugucagaaaauauacugagaguaaaguaagaaaauguaauaauaugguuaaaauugccaaauucuuuucgagaauccaaguguguugauuauuguagauuauuacauuuuugauguaucugguuuguuaucaccuaaauacacagcaaacaccugugauuguuuuagugauccuuguccugucuucuucaaguaaucucaaauauguguauuuagacuguugccuauucauauauacucagcugugccuguuugcuuuguuacuuuucuaugucuaauggagcaauauaaaaauuuauggcaacugucacuuaaugucaccuuuaccuuuaaagaaaaaagguaaagccaaaucaugccggguaacuacgaugcucuuuauaguuaacuaaauuaucagauauacguuguaauaaguugaucucugauaucaugggccaaauuuagggaacauacauaaacacauacauguaaguauguuuguauaucauugcuacuccacauuuacuuuauuagccaauaaagaucauuaguuuaaaaauaacuuguguauucuccuuccuugaacaaaagaucuuucuuuuaaaaauuucuauaaaacuaaauuauuuuuaaggaaugagcaaaugcaugucagcugcuaaaucauucucacuuuugcuucucuacaagaaauuagcagggugauuuucagaauuguuugcucucucaucuucacaguuuaaaagcacauauucuuuuaaagaaugcuuuuucugagauuuccccuaauuuauauuucuuauuauuacaauacuaugauuauucuuugaauuauaguucuuugaaaacuaaaaauucucucauguaaaaucaaaaacaguaucuuuuuuggcuaaaucagaaacaucuaaaaauaucagugcauucaugugaagaaauacuucuaaaauaauucaguuauguaauuaauauaauuaauacuuaucuauaaacuuaauaauuuuaaauagucacauggcuucuacauaucaaaaaauucauuuuuaaugugaacuaauuguucuugcuuuuaauauuuuaggccacuuggucauucuggcauuuuaugguagagaauacguugaguuuggcucuggaaggaauaugagguaauuugaacacauguucuuuauaaauaaugaacuguguguacauaauacagaguauuuucagaugucauauauggagucucaugucugaauuuuuucaauaguaauuuucuuuuuucauauuuugauguuuuuccuuucuugaugguuggcaauaguuaauauggugaagaacuuuauuuucuaucacuacuauauauguuuucaagaaaacaguauuauuuacauaguuauguguuuucaguuuauauuuuuaaaugcuucaguuaaccuagcuuucgguggugcuguaaaaaccagaagagaauuccuuccuuuccaccuaccaacuucccaucccaaccaauccugccccagguaggauuaaggucaugcugcauuuaaaagucauaacugccacacagaguuuuauagaggaacaauaaagaaagagcacuggaacuccaauaauguaaaauuuucaggcacuacucagagugcuuugagagcacaaauaugagacucauagguuagucuuuuccuguccuuugauacccauaugugacccugugugauguauggguuugucauucuaaaauggcagucaaauaaguguauaugccacauauauuuucauagugguuucauagacuaaacauuaagccuauaucaaaggaaguuucaauuaaagguagaaaaauaauaguugacuuuaugaaauuaagccaaugauacaguagcaggcuuaucaguagauauuaaguauuugguagaguaauugguuaauauacugcugaugucauaauuccccuacucuacuacucaauaauaguuuuguuauguaggaagaugcagcagcuuguuugugugaacuucugcuuccacuacaaacaguacuuuaaagacaggccuuccacugccauucagaaaggugaaaaaagcaggagucagggugggguggauaggugggaagggugucagagggauaggcauagugucugugaguacuuguaagcugucaucauuggucuuugagguuauguuugcauccaaauuacuuccuuaccuuuccaaagaguugaaaugcaauugccagcccauugaggaugaucaaacauugcuauuuuaauguuucuuaauuuuuaauaaaugaagcuuauauuauuaaaauugguauuauuuaaaaauaaucaugugauuuacuuuuuuuuaagcauguauaaucugguaaauuuuugaaaaguauuaauaauuuaucuuuaaauacuacacuuuaauuucuaaguucuaaaaauuguguucauguuguuucaaucaaagaugugaugaugaaauagaauccaucagucuucacagggaacaagguacuccuuauuucaauuugauauauggucuuuguuuuagcagccauggaggauacucuaguuucuuugggaagauaaacacucaaucugcuaguuaagagacaaagcucaagagaaauaagcugaagcuguaaccuccauuucaaacuugugguucugcguaaguccucuguaaaguacaucaaaaauuccccuaugcauuuucuacaauuuuauggauauaagguugaaagagaaauugaguaguuuugugucuaaggccuugacaacauuauuuauaguuaguaauugcauuuauguauagaaguuacaauuucagaguuacaauaaucuuuaucauagguaguauauuuaaagggacuuaguacuaacucuuuuaaguaguuuuccuaggaaauaauuacaguuuuauuauauuucucaaaccauuugaguugucugugucaaacaaaccaguuggacguucuuuucccuuaucacugaguuuucaugauugaagauaucugacuauggacauugauauuauaccuaauaauugugaaucuuuuuauggauuugcagaaaagcguuuccauaguauacuuuuauuaaaaguacuuacaaacuuauuuaucaaaaauaguuuagaggaaauuaaucaauagauguguuggugaaguccuucucuugguaaaguaauaggaaaugagcuuaucuuaaauuaucugagagaagcaguagagaacaauucuauauguguuucuccuucccucuuuuucucuuucaauuugauuuuuggaccucuuuucauuuugauaacauuaaacuccuuuguaguaugugaaguaaggaaguaucuugggaacgggagugguaggaaaagaagcacguuuauuuuaaaauauugccuagccuauagaacaguaauuauaauacgccucauauuuucaauaggucaugcuacacaaaggucaugcuuuacaaagcucuuuuguguguagcaucuuauuuagcuuuucccaacaguaaguuauauggggaaggaauuguuuccaaauuuaggaugaggaaacuugagauagaaaggucaagaaacacuuuuccagaucuuuugacucuuacucuagaauuuguaucuacucuauuaauaauuuuuaaaucauauuuuuaauaacuugaauuuucaggggacaccuuuggagggauaauuggaagcagagcagguccauuuuugucuuuucuuaaauuaggacucugaguaguacuuuacugggagacaggguuucgaagcugcucucuauauugcuuuucuagguggaaggacuguaaauuagaguaguaaucuauaccucucuuuuuguuauugcaguugcuagaagugaugaucaaaguuauaugcugcuuuuucuaauggcaucguggauauagaaauaagaauuacacucuuggcaguuuacuuuacuuuuauugcuuuccaacuaauaguuucugacuuaauacuguacacaggauauacaaguuacuaaccuuuuaccagggccaauaacaauuggucuuuaaagaguaguauaguuuuaaaaauguaaaugugaaaaauuauaaaaaucaaaauagaaacuguccauauuaaacauagcaugucuugggcuuaaaaugacauuaguaaauauccucauucuuuguacagcuuaaaauauugcuugaauuucauaaccccaagccugguauuuaauuaaguacauugguuguuaaaaguaauuuccauaagcuauugucuguuuauagaacuuugaaaauucuaggccgggcaugguggcuugugccuguaaucucagcacuuugggaugucaagguagaaggaucccuugagcccaggaauuggagaccagccugggcaacacagggagaggcugucucuauuaaaaaaaaagagaaaauucuagguuaugauagcauuuaugaguaaugguaauaguuucuagaaauggcucccuuuucauauuguagaauucuagagucuuugauaauaaugaguuccaaaauauguuuucacuuuacccaaaugugcauuuaaaucuuauuguaacagucuaugaaauuacuuaugugcacauagaaaauaaaucguaucuggggcccaucaaaaacaugauaacguuuaauaaggguuagaaguuaaucacacaaauucgaaguaacuguuuagacucaaaucauagcauucuacaaauugaauauguauuagcaauuuuguacuuuuagauaugagcaugaauccggaguuuaauauucaaaagcuggugauuauuauuuuucuuuaacuuggucuuugagcauuuaguugagaguacuaaacuaaacacucugaacuaauaaaguuucauuauuuuguccauagcuuauucuggacauaaagcaguuggagagacacugaaaagggcagaaaaaauggguauugacagcagugagaaaagauuggagccauggaaacuauuuuguauaggaaaggaggggaaagaacuuaaaauuaguuuucaaauuuauuuguauuucuguuuacucuuuguuccaaacucccagcuaaaaucgauaaaagcagcauaauauguuaaagagagccguaacuuguugccuugaaagcuuuuagaaagggugauuuuuauuugucauaaaaaagacagucccuaaaaguucacugggcucuggaguaggguagagagggauauuugguaggucauaccccacaaaaaucuuuuaagaccagaauaguuaguaauucaucuaaauaauaucuguauuauucuuuuuuuuuuuuuuuuuuuuuuuuugguuugagacaguuucacuuuuguugcccaggcuggagugcaaugggaugaucucggcucacugcaaccuccgccuccuggguucaagcgauuccccugccucagccuccugaguagcugggauuacaggcaaugcgccaccaugccuggcuaauuuuguauuuuuaguggagacaggguuucuccacguuggucaggcuggucucgaacucccgacuucaggugauccgcccaccucggccucccaaaguguugggauuacaggugugagccacugcacucagccaauaucuauuauucuuaaagucuuuaccagguuuaaaguucuuggauuauaauucugaugcuaauugcuuggaaauguauugcuauguauuuaugaauauucucuuauaacuaaagaugaugcauguaauuuuugcagauuuuaaauuguuuuucagagauaaacuaagauaaaaauuacaaguucauuucaaauuugggauuauagacagaacuaaaauucuuuuauucugagagagauuacaaauuccguauuauguacacuuuaaaaauaauugauaacaaauacagagggaagcaaaaaauuagucaacaauguuagaaugaagcaguauccuuuggcaaaguggucuagcguaagcagcucauggcuuuuugagugagucaaaccugaguuugacuauugguucacucacuuacuaauucaauauucuuauguaacaugaggacauuaauuguuaccuugaagacuugugaaaauuaaguaaaggacuuaugcaaaguguguaauccagugccuggcacagaauagugcuucagaaguaauaguuucauucauuucuuauauaaauguaaaaguuucuucaguagauuggguuaggaaaaaccaauagaacagggaggugguauaggggcagauuuaacuccagucauuuccaaggggaaaugguuuucaguauguuuuuuauuuuuauuuuuuguauuuacuauuaauuuaauuaauuuuguuuugagauaggcucuugcucuguuucccagacuggagugcggugauaccgucauaguucacugaagccuugaacucccuggcuccagcagucuucccgcuucagccuccugccugagccucccaaguagcuaggacuagaggugugucaucaugcccagcuuuuuuuuuuccuuuucuuucuguagagauggggugggggggggugucucccuauguugcucaggcuggucuugaacuccuguccucaagugagccuuccuuuuuggccucccaaaggguuaggauuacagguugagccacugcacccagccuuuguuuacuauuuaacugcccaaauuuuacuauauucugugguaggcaacaaaaacuuaauugcuuuauuaccuuagggagaaaccaguuuugguccuaccuugauuaaaaaucuucaaaaacuugauccgcuuuuaguaagaaagcuacacagaguuguaaguagaaaaccacaugugaaguagaaaauacuaaauguuuucagauacuaacuucuggagaaacucccaucuaucaaaaggaaguaaauguguacuuaagaguuaaauguggcagauacauuauuuucuugcaauuuaugguuaaucagcucucauuuuguuuuauuuugauuagcguaguuaucuuaggucccucugaccacuccucaucccuacccaccccuuucucuguaagucuacugacuccuuuagcuaccuugcauugucuuguauuucauacacuagcuagcuaacauucauaacaauaacuaguauuuauuaagugcuaguugugugccaggcacugagguaagcaccuuauaugaacucauuuaauuuuuaugugcugucuccgagggcaguagguucuauauauccaugaucuuuuauauucauuucugaaauucaaaggguuugaaaaugguuuccuauauuuauagcaaacuaauuuggcugaaaaaccugaacuaagugagaugaagcuauguaaaggucuuuauauauccuacaucugcaacauuguuuuuauuuuuugcuacagaaacauuaguguguaugauuaugaguugcugcccuauauucaccugggauguuauauauauauuugguauucacaaaauucaaaaaauuuugaguuguguaauauaucuggcccauagauuuagaguaggggguggugaacuuguuucguuacuccauuuuuguagaugagaagguuuauacuagaagacaugagguaaauucccaaguuuauaaauacuauguuaagauaucaaguaauuuacucagguaaugcauguauaaaaucagacucaaacccagcaguuuaccccagaaaccguauucuuaaacuaguguugccacggcaagauuggcacugguauguaugucuucaacugauacaguugcugaucuuuacuaauagaggaaagcauauaccuggauaucuauaaucuggauuucaaugugaauuauugugcuuuuauaaguaucuuagguaucaaugugucugauuauagaguuccccuaaguauaacagagcccggccacuauggccugucuuagguagagguagaaucugguuucucuguugucacuucuuuucccuccuuuguauuaucugugucucauucagugccauaaauugcauauauugguuuuauucaacaaauauuuauuuaauaccuguuaugcaguagucuggaaauacaacauugagcaagaaaaugguaccugucucaacagggacacuauuguuauuauagauuggacauaucuuggugggguaccccauguugcagcauauuuggcaucucugggccaaaauggcauuagaaucacuccccucccugcaucauugugacaacuaaaaugacccuaaacauuucccaaagucuucuguuugggggucggguagugguguaucugggugauacucaggcucagcccugagaguaguagcugcccacuugccugcccauccacuauccaaguggaauaauugauuuuaaguauuuauuuuugcugaauccuggcauaaugcaaaauaaacagcugagagaucuaugaagcaaauagcuaaacugcuuauacucuugguacaauggcuaaacucaaaagcaagauugguuguggauagucuacccauagcuaauugagaauucccauuauacuguguaaauaauaagcauaaguuaauaagcucccaaguggacauaccaagugaugcuggauuuuuuuuuucaguuacagaaucaaggucucuaggcccuuacauaugcaaguuauucaaagacauauaauauagcacacuuagcauaucuuguaacacuuauacauaucuguuucauuuucauuuuuaagugacauuuuacaguaaauucccaguucuaauauaugugaauagaaacaacuaugaggguuuuaugauuuugaauccaucguuugaaaaaggaauaaaauguaaaucuucauucaguauccauaucagcugcuuuuugggcaauauuuuauauuaaacguaauuaacauucaaaguucacagaaccuguucaugcuuaugacaguugacauuauuuuaagugaaaacaauuuuauuaaauugcaauuauaaaaguuuauauaugcuuaaugggaagcauucagaaaauacagaaacguacaaagaaaguaaaaauauguauguucuugugcucacagaugacuacauaucugcuugagcauuauugucaugucuucucgggauuucuccgugagugcauaugugcucacucuggcacucuugggugugcuucugcuuguguguguaugugcucuuuucuccuacaaaucaaaguuuauuaugaaaauugggucauaccauuuuuuuuuuacuuucacacucauauuuugaacaucuuuuaaugguaaugaauaaaauuuuguaucuuuauuagcauuguauguauguaucauguauuuaaacaauucucuacguagacauuugggugguauccuauacaguauuuuggcauguaugugcaucuuuguguagcuguccaauuauuuucuuuauaugaauuccuagguguggaauugcugaguaaaugcuggguacauuuagaauauuuuuaucaauuaucagaguguucucuagaaagguuguaccauuucauaugcccagcaauaaugcuuuaauguuuuguuucuuuguuuacucugacacuggauauaaucagucuuuuuauuuauuuuuuuuauuuuggcaaucgaauaguugaauaaaucuauuugaauuugcauuucuucaauaacuaaugacaaaaauacaaagaauucauuagcuguucauauuucuuuuguugaguuuccauuuauaucuuccaucuguuuuucugcugggcaguuucuuuuccucuucuuaaauuucaagaucucuucauauuauaggauauggaaauuugugauccauaaugcaccuuuuuuuuaguuuaaaaauaugauucuuuuuguuuuagugauuuuuguauguaauuuuuuuuugcuuuuuauuccaguugauguccccacauuauaacaugaucauuauaauucaaaauaauucauuagauagguuaaauauuagauuuuuuuuuuuaaaaaauguacuuuucagaugggaaacuauuuucuugauguggaagguuaaauuguucauguuaguuagauguguuugcuaugauuacaguuuuaauagcuguauauaaaaauaaggauugugagagagaaauccuuugauauauuugaacaacguugcauuaaagccagauagccuuggcuuuauuuguucuuuaauuuauccaacaaauauuuaucaagugccuauuaggcauuagaugcuaagaauggauuuuucauuugcuggcuguguaacuaugggcagguuacuuaaaguagccaagugucaguuucuuuauuuguaaaugagggauaauaccuaccguauugaguuauuguaaggguuauagauuauccaaaguaaccaacagcaccugacauauaauuggacaauaauaaauuguaguuaguguuauuauucuucauaguaacaaaacauaauguaauuuuagcuugcuauuauauauaauauugcugugguagucauuuagcauauaggguaauugaugaugguuauaauuuuauuaauagggaggagaauggagccuagcuagguugauuauacuuaccauccugucagcuaaauaauauuuccuuauauuuguauagcaguuuacagcuuucaaagcucuuauuuauucuacagcguuccucuaagacaggcagggcauguauaauuuuuccuguuuuacaauacagcagcugaagcuuagagagauuaauugacuugucuaaggucauauggcuuuuaagugauuaacagguuccacuuauaauuaagauuccuggugaacguagauugacucucauugugggaaagaacagagaauagaaucugacuauaauugcucagucuucaagcuuuagccauuuuauaguuucuugugguuguguccauuccagucaucugaacauuggccugaauguuuuaguugucuauuacauugauggcauucaugcucgugugaagucacuuuccuuucaguuuggguugggccuguagcuuguuuuaacaaagagaaugcaaagggauuaaagcucuuccaggucugggugcaaaaaggcccgacaacuuaugcuuuuguguuuucgagagagaggaucaucauguaagaaucugaccguucuccuagagagacccaguggaaaagaggccacauggagagggagaauuucugagauuacauggagagagaugcuuagccaugcuaguauccuagcugaucucauuucucaccugcuggcugaaagcaguaguaugaaugaccaccagcaagaugacuguaagaacugccuaguugagcccugcucagauugcagaauuaugaccaaauaaaauggugguuguugugccaguaaguuuuggggugguuuguuacacaacaaaagaaaagcaaaagaaacaugcgacaauauucuugaaaauaaaagccuugcuaaaagauguuuacuuuucucggccuaccuugacaguuuuggucuuuccuuggcuugccaauaccagcuaacaaaagagaaauaguaaugaacaacucuuuucucuuccagaagcccgcgauuuuggccuauacuugggugaaucugagguaaacucaaucucuguucugagucucuucagagaaaucucaagagauaggguugccuccuaagucaaguaucugauucuucuuuucugucgauuucccacuuccaguuuucugugguuuuaaaaaaauuucuuacuaucagaguauaguugguuuuggccucagucagccaaguaagacaagauggacuaggcuuuccuccucacuuuuacuuguuucuguuguccccaaaagauuugagaggccguuuaggacugagaguggcucugagaccaguaaucaccuuuguuuuugaugauucacauauuaguuaacaggaaagaugugauaaauuguuuaugcaguuuauuuuuuccugucucacagaucuguuucacucucauuuaaguacugaaauacagauuuuuuucauaaguuucuauuagagauaagaaucagugaucuaaaaauuuuaaguauauuuuuaaaaaaucaaacuaagugaggguuuguuuuuuuugguuaagaucuuuuuguccugaaaauuauaaauucagaauauuacagaacuugaucaacuuccagaaugguggagugagggccucagugaauuugugcugccuauacaacaacaaaaauauggguaaaauaaugaaaaucagccauuuuagaauucuggcaauuaagcaggaguaugaauugaaaaucaucuguccaagagaaaacuagugaaucuugggaagaccaguggggucugcgauauuuuaacuugggguuauucucaucucucucuccagcuuagugguguagcuaaaagcuggcaguauugcagacaauggagagagcugaccacuucuggagccccauugaaggcacuauccccagagcacaguuaauauuuugucccaacuugcagcucccugggaaaacucuuuucagagagaguggcuggauauuugauuugacucugaacucagcucaguugggggaagaaaaagcuuacccccagggcauuacugaaacaauagcaaacuguuggcaaaaugucaauugccuaaggcugugauuucaguugaggcaaaggaagaaucuggccaggaauuuaaaaggaaagucuggagaacuagccaacuauagggaacuuuggaaagcucuggcauauuccuggguauuuaaaaggcuguacaaugugcaagucuguacacaugcccggaaaugaccugggaaaggagaaugucaccucugacugaucuugaggcacuguguaagcaggaagugaaaaucagugcuauuuguaagcuuccugaaguuugaagguaugacuucucaugaagauuucuuuggcaaaagguagaagacauauaggcaaagcauuuaaggaaaucuuuuaaaugaucauugguugacuacuacauuuuacugguccagguaugacuucuuggaagccaggcuuacaaauaaaaacaagauccuaaaaaaaaaaaaaaaaaaaguucuagcagagaacucgguggccacacacuacggggaauacaggaucuguaaaauucguucaugaaaguacuaaagaaucagcaucaagaaaaacaacacacugaugauuaaaaaauuuaggggaauaauguggagcaaucugauaugagauuuguuaaaauauauuaccuaaaauguucaguuuuaacaaaaauugagaaaugcaaagaaacaggaaauaaaacacacagagacaaauaauaaaaaacgaacaaaaaaagucccugugggagccuagauuuuagacuuuguagucuuuaaguuagcuauuacaaauacauucaaagaacuaaaugaaaccaugucuaaagaauuaaagggaagcaucagaaugguguuucaccagagaaagaguaucaauaaagauagaaauuauuaaaaaacaaggaaguucuggagcuuaaaaguauaauaacugaaaugaaaaauucacuagaggagcucaacaacagauauaaauuggcaaaugaaggaaucuuuuaacucgaaguuaggucaauagagauuguucaaugugaggaucagaaagaaaaaugaacagagucucaaaagacuuaugugacuccauuaaauguugugccaacauggacauuauaggauucccagaagaugagaaugaggcagaaagaauauuuaaaaaaaaauggcagaaaacuuuccaaacuugcugaaaaauauuacucugugcuacacauccaagaagcucacuguaauccaaguugaauaagcccaaagugauccauaccuagacccaucauaguugaauuuaaagaaaaaucuugaaaguagcaggagaaaaaugacuuguuacaaggaauccucaauaggcuuaauagcugacuuacgagaaacccuggaggcuagaagacauuuucaacauugaaaguaaaagacugucaaccaguaauucucuauuuagcuaaacuuuucuucaaaacugaaagugaaauuaagacguuuccaaauagauaaaaacugaaaggauucucacgaacucuaagaaauguuaaagggagucuuucagguugaaaugaaaggacacuuaaugguaaauuuuaauccgugugaagaaauaaagaggaaugguuaaagguaacuacaggcauuaugaaagacauguacaaauagauugaauaauagauugaaguuuuuguuagggauaggcucuaaauccaugucuuuuguauaguauaaauugugauucuguauuggaauuauacuuugcugucuggagaaguguuuauaaaaguaaugaaaauuuugguuucagguaaaacaaaaauuagaacaaaaauuauacugaaaauaauuauuacauaaauuuugaaugauaacuaugagcuagugacauauauguauuacaucauuuucucauuacaauaucucacuaggguguguuaucuagauuuuauagauggggaaaauugaauuaagaaagaaagugacuugcccaaggucauuuaaguaguaagugguggagcuaggauuugagcuguggucuguuuaacacuaaagcccaagcuuuuaaauacugcuuuacaccuuaauauccggugcuuuaauauucuuggccuucuuucaaaaacuucccucuuccugucaauuccaauaaaugcguuuuuguuuguaacauuuuuuucuccaguuauuuaaaacacaacugaauaaagcaauucuuauaaaguuguauugaugggcuuaugauacauaaaagauggauuccuucauaguuuuacagauaugguucucuucuggaauuuauaauacaacaugaaugcaucacuaccuuauaaggcagagauaaggugcuguuugucugugccucuaguuucuaaaauugacuugguuuaauggcaucaucuuaauggugauugcugucacugagcuacuucaucucuuccccuguuuucaagcaguccauaaauacuaaacuuugcaucaaugcugauaaacuagcuaccuuccagugcccuauauuugaugauccucucuuggcacuuaauaaguucagcuuauagaugauguuuaugauuauauucugugggcagcaagccauccagaugccgaggcaagagaccaggggcacgaguuguuccaguguaauaaagaacauaaaacaacaagaguuauacuagaucuacauagacaugauuauauaugaauaucauaugaauuauauguauauauuauauauauuauauaugaguaucauuaaucauuuguagcaauuacucuuuaugccaauauuauaauaauacucgcucuauaaucauaaccuaggaaaaacuaggccauacagagauaggagcugaggggacauagugagaagugaccagaagacaagagugugagccgucugucaugccuggacagggccaccagagagcuccuuggucuagcgguaacgccagcgucugggaagaugccuguugccaagcagacuguggucuagugguagcgucagugcgaagggaaaacaccuacuacuuagcagacugggaaggggagucucccuuuccccaggggaguuuagagaagacacucuacuccaccucuuguggagggccugacaucagucaagccugcccacaguuaucuggaggccugacugucucccugugaugcugugcuucaguggucacccuccuaguccacuuucauguuccauccuguacaccuggcucugccuuuuaggcagcaguagcaaaauuagugaaaguacuaaaagucucugauaugcagaaacaauauuguaauauuaugcagaaauaauagcguaugcuauugcauacgcuguauaugcgauaugcagaaauaguagcauaagcuguccucucucucucccucucucucugucugccuuggcugccaggcagggaagggcccccugucuaguggacaugugacucaugugaccuugucaaucauuggagaugacucacacuccuuacccuuccccuuuugccuuguuuccaauaaauaacagcacagccuggcauucggggccacuaccggucucugcgucuuggugguugcggucccccgggcccagcugucuuuucuuuuaucucuuugucuugugucuuuauuucuacaaucucucgucucugcacacggggagaaaaacccacugacccuguggggcuggacccuacaguguucaagaugaagauauaaugcuuauaagcauccauuuauaacuguuuauaguuggcaaccuaccuuccuuccuuccuuccuuuuucuuuuucuuucuuuuuuuuuuuuuggagacagggucuugcucuguugcccaggcuguuagugcaguggcacaauuauagcucacugcagccuagaucaccugggcucaagcaaucuuccugccucagccucccgaguagcuaggacuauaggcaugugucaccacacccagcuaauuuuuuacuuuuuguggagaugggaucuuccuguguugcccaggcuggucuucaacucuugguugccucaagugauucuccuuccuuggccucccaaagugcggagauuacaggcaugagccaccauaccuggcugcuaguuuggucauuuucuguuucacagacauuuagauugauuaggguucuaaugguguauuguugcaaaccugucuuugauucuuuuaaagauuauacugcaauauuuugugguuugggcaaauaagcacuguuucuggagacaaaucuguauucagagucuuggcugccacuuguuggcugacuuacuuuuagauauguuucuucugagucaguaaucucaucuauaaauuggagacagugauacuaaaccuuuuaacuuuaauuuuaaaagcgucauugauauuaugagcuucuaugaguuuguguuucggggaagucuuauaaccaaugagacaaucacggaauuuccuucuugcaaaugguguagguaaaggaacuuugaaacuucagugguacuuucauagucuguauuugacaagggaucuuuucugaugagauugguucuuguaguuugacuguuaauagaaaaaguuaaaacaguaggucauaaaaagugcugcauacuucucacuaacauuuuaacuugaaaugugcaaaauguauaaauagacuguuuuugugacuaggaccaagggccuuuuuuucaauauaggcuugcugauuggaacugcaagucuuauauaaaucuacaucuauaacaagucauauccaguuuaugcuuuauuucuuuaauauagauuaaaaaauugagacacuugcagagcagugguucucaaagugugguucccagcccagcagccucagcaucaugggaauuucauagcaugcaaauucuuugguuuuacuccagaccuacugaaucagaaacuauggaagguggggcucaguauucuaugcuuggcuuccaugcuacauuuucagaaacauuauauucuauauuuuauuauuuuucccagguuuaaaaauauuucucuuaucuuugccuauuucaacagcaguauuuugcagugacuugccuuuaucaagucuuuucaaugcguuugacuuaguuuuuaaagauacaagaccuuuuauuuuugcuuuuaugguuuaugugauauuuaauuaaauuagcuaauuacaauaacaauaaaacuccccuguugagguuuuggaacaaauauuguucugagugaauauacagcucagcaguugggagcagaaguguugaggggcaugcuagagagacuccugcaggcugugaguuuucaguauucugugggcaucugucaguaugguuaaagaggaaaugaacaauguggguuuacauagcaagcuggguaagugaagcuugaucaagagagcuucucauguguauuauucuauguaggcuuauauauuucuuggauccauuuaucuuuauaaccccuaauucaguacgcauguuuuagacuuuuguuagucuguagguagucuucuuggcuagaccccagaguuagaaauauguuuuuagugauuuucagaucucucaguucaguauuguggagaaauaagagaacccaguaguucauaugaaaaauaugugccuguuauuaugacaccaaaggggaaacucuguagcagcuaauacuugaaguagaaaacagauggaaaucuucuucucuagccuaagacugcagcuuuugcccuggcuuauagugccuacuuugauuugggaaauccaauuauguguggagauaauuccacaggugaaguguuugccuaccauugagauucuuaagggauauauaagucgauccagacucuggcaugcugaaucgaaacuguugcuccucagcaacauucuagauggaguuuugauugagcuauuuuuuaaugaguguuuuaauuauuacuauauuuuuaaccacauugcuaaucucacaaaaggaaagggccugaauagccugucuaagucaacucuggaucaucucguuacugcaguaguuggaucauaauacugcugugcaacauuaauagaaaacuacauaauguacagaaaauaacuauugcauaggaacaucaggauacuauagcaguuguccaauaaaacagcaguauuggucccccugaaguuguucagauagggauuugauaagccuaguauucauucuucacugacacaguaacucaaucauuucacugacaaaauaaugguugcuacauaucugauuuaacaaagaaaugaauguugcuuaaauccuuacgauagauugaaguuuuuguuagggauaggcucuaaauccguaucuuuuguauaguauaaauugugauucuguauuggaauuauacuuugcugucuggagaaguguuuauaaaaguaaugaaaauuuugguuucagguaaaacaaaaauuagaacaaaaauuauacugaaaauaauuauuacauaaauuuugaaugauaacuaugagcuagugacauauauguauuacaucauuuucucauuacaguaucucacuaggguguguuaucuagauuuuauagauggggaaaauugaauuaagaaagaaagugacuugcccaaggucauuuaaguaguaagugguggagcuaggauuugagcuguggucuguuuaacacuaaagcccaagcuuuuaaauacugcuuuacaccuuaauauccggugcuuuaauauucuuggccuucuuucaaaaacuucccucuuccugucaauuccagagauaacauucaauaacuugacaacagugaccuuucuaaacaaauacagugcguuacagaaccagauggccuaagauuauauuuuauuuuucuggcucaaaauaaauugccugcccuaagacugauaaaguccaaaaaaagacccuucugugucccaggaccucaucaggccacauggccagccagugcuguuuaucauaagucagccacgaguagaaaaccuaugucuuuauacuauaauuuagauuaggaccuaaugaaggggcaagaagcugguuuacuaaauaagaucauucaguaaucgcagugcauuugguagaaagauucugaagaagugaagacagaauucuaggcaguacugcugucuguucuauaaauuggauguaaggagaaggcugauuuauaauucaacaaacucccaaauuaggcaucccuuuuucccccuugcugggauuuaaggaggauuuuuucuaauaacuagccaccuuauucuugaucauucaaaaucugggugagaauuuucuuaaaagucuuagacagauauauuuuaaacguaauucuauauugggaacauaagugauuaugccacacauaggcauaaacaaugcuuucaugaguucaauuauacuuaaugaauuucacacuuagagagacaaguuuaagcaggguaggcauagaaauguuucaaagauauguugaagccaaacuuguaauugacagucagauauagugacaaaagaaacacuagacuuggaauuaggagaccucuguuugagacuuggcuuuaccauuacucuguaaggauccuugagcaagugauuuaaauucuccaagacucaguuauuuguaaaaugaugccagaaugauauuacuugccuuauuuuauugcaggguuguucugaggacaaaguuagggaacaggugacaaagguacagugauguacaaauggaugcuguuauuauggcagcaucuaauauauauaaggguaaauguccugagcugugagugggacagauuugccuuuagaauugcucugcuguuuaguaauuuggugcuuugggccaaagcaccacaaucuuuuugaauuucaguacucucaucuguauaaaauaaucaacaucacagauuugugagaauuacauuaauguagauacuauauuuaaauuuuuguaaaauagugaugggguaggaguuauuaucuugaacagauuucagaaaguuagaaaagaaauagccagagauuuuuuaucuguucccaaacaucuuaauaagauaaauuacucauagaauguuagaaugcuagaagagcccugugaaggucaucuaucuuauccugcucauuuaaagacaaggaucaccuccuaauacuuuugucaguuguacucuguuuauaugcauagaugauaacaucucaccagcaucaucaauuguaaaggauagcaacugucucucaaucacaauagauacagauuucugaaaauguaaagccaugucagagaagaacucuggagcuaguaucgggcugugaaaagaauuugggcuuuggcccggugcgguggcucacugccuguaaucccagcacucugggaggccgaggcgggcggaucacgaggucaggagaucgagaccauccuugcuaacauggugaaaccccgucucuacuaaaaaaaaaaaagaaaaaaagaaaaaauuagccgggugugguggugggcaccuguagucccagcuacucgggaggcuaaggcaggagaauggcgugaacccgguaggcggagcuuguagugagucaagaucgcaccacugcacuccagccugggcgacagagugagacuccgucucaaaaaaaaaaaaaaggaaaaagaaaaaaagaaaagaaucugggcuuuguugugaaaaguugagauggaaucuugcccugucaguuacuaguuugugacagugaaauauuuacuuaguauuuuguggccacauagcuaugcuguuuuuuuguuguuguuuuaaccuaccauuguuguuuuaacuuaccacauaggcuaugucugugucuauacuuaaaccugacuggcucuucauuuuuacauaucauucuuuggaucugagauguguuugauuuuuaugcuauuuauacuaaugguucuugaccuucucuuucuugucucuaacacauuugagacuugggauuacaauagugauccuugaauauugcaggggugcuuguggcaaaucagcaucuuggaguugucgguuagguguacuucgaaaaggcuuccuuuuuaaggcugguuuagggacuuacacaugagcuauaauuuuuuuuuuuuuuuuugagacggagucacgcucugucacccaggcuggagugcaguggcgcgaucucagcucacugcaacaugaucuauaauuuuuaaaacuauaauuauuuugggucauauguccuguuuuucuuucauuguugauuuuguacgguugaauuuauauuggugucuaaaaaauuauuugaaagcuaacuggacaguauuuuaaugugaaauuguaaaauaguuuuaaguguauucccaugagaagagcuguuccaaagaaaauaauaggaaaauaauauuuuaucauugacccaguaaaaacaagugcaaaacaaauuuauguucacaaucaagaauaaugaccuuucugcacuuuuuagaacccaguauugagagauuucguaguuuauauauugacuuuaucuuugacuuauugaaaauauuguuuucauccuuauuggguguccuggaaaaauacccaaguugauccuuaaauuugaaaaaagaaaauucagaacgaaguauuucuagauucuaaugguacuagacuagaaaauagaagauugguagguaaagaaaauaauguauaugaaauaguauaugaacacagaagcauaacguauuuguguuccuacauugaacacaaauucaguaugcauuuucugucuuuuugcagcaguucaacuuuggacauguauuucuuucuuucucuuuuuguuaaauaaaugaacagaauuuaucccuugaucaucuguaacauaguuucauuguaaccaauagucugggcuuucacuugaauguuuuuuuaaugaauuuaucuggagaugcuuugcauuuuucuaaauuuuggcuacacuaauuagagaguggguauuacgaaaaacugacaggcaguuuuaaaaaauauuaaaugaauugguuuugaaaagggauacaacuauguaguuuuacauuuuucaacuuguuuuuacauugcccuuuagaauguuuaauauuuuguaaugaaaguaugcgguuuuucuucuuuuuuuucuuuuuucuuuuuuuuuuuuuuuucaaaaggaaaacaaucggguaaaaaucugagaaauauuuucaguuguccaaggcuaauguugacuuaaauaggucuaggucuucaugguugacagcugcagauaauuagcuuuuucuuucuuaacaaagaaagcaaauggagcugcaagacauucauugccuuuucugucaucaaaauaauaauguauguauuuaacuccugcaguuccuuaaauugauuuagugcuaagcugccuacauuacauauaauaggaaugacaagugaaagcugcagcacauauuugcguggcaaaagggagcagugauugacagcaaaguuucucucuacaagaaauagcaguguuguggagcucaaaaagggccagauacauaauucuuaaaauuguagagcagauucaugaaaugaauuuuaaaaagugauugccacuugguguacuugagugucuuuguguuuuuggcucugggugaggggcacagauggacagaaucucaccugacugccaaauaucaauaaauuccuuuuaaguauguuaguauuuguuauuuaagaaugauacuuacaaauuuuagaucaaauugugucucuguacucaguaacugaguccuuuagcuguaacaauucacuguauuugaagaagccgaguaauacaucuauucaaauaaagauuuugaaggcccuaaauugaguuaucuuucauggaaaauacccauuuucacaugucuguaaaacuugaggcaucguuucuggaaagguaaucacauaggauugguaguuucuuuuggucagacagugguuaaaugcgaucaucuuucagaaguacucaaaaaauauucuggcuuucuuuuguucccaugacacauacccagaagccaugguugcaaggacacuuggugauugcugcugcaugaugcucugugaugagccuagagugcugggcuucauauuauaccauggaaauguuucuuauuuuguugacaacucugugucugugggaggcggggaggggaagcccuaugugugcuuguacacuggcagccucuacuggccauugcaaagagcagcauuguccucuguucuuuccauuccagguugcauaugcuuuuacuuggguuuagcucuuucuucuuugguccucacccucuuuguuguccucuuuugaagacuaguuauucuguuggaugucuugauuuauaauuaauaaagagcuacuaguccaguauuuucauuaauaaauuaauaucauaagugaauggaauucuucaggaccuuagaagaaguuaugaauauaaccuuuccuugagaaauaauuuucauguaagagggaagauagauuuaucuuuauguagguuuuaaaauacuuucucaguugcaagccuuaauguaugauauagagauuagucuuuuacuuaugacugacaaaaaacccugaugccuugaaagaaagccuuggcucagugauagacuuaauuacacacacacacacguacauacacacacacauauauauauuuguguguguguauauauauguauauauauguauguauguacauauauauguauauauaauauauauuguauauacauauauacauuauauauguauauacacauacauuauauauguauauacauauauacauuauauacguauauacauauauauuauguauauacauauauacuuacauauauguauguauauacauauauacuuacauauauguauguauauacauauauacuuauauauauguauguauauacauauauauauauauauauaauucuuuagauuuagguauaucagcuuucucuuagagguuuccaggaaguaggcauaaacucuuauugggcuuuaugcauaugaauaccuccggggguuggauagaggguggugucuaagcuuuaagucuagacagaaaaugauaaguauuuguaaauaaaagauccaaggaugguaguaaacuggauuauucuguuucagggauagaaacuuauaaaauguuugaucuaauaucuuugacuucgggcaauaauuugaccacaguagaugauuucuccaauaaaauagacucauuucuugacauuuacauuuuaucaguggcucuacuuacuaaucaccuaguuaucuuugaaucucuugguauuuucaaauaagacaucuaauugaaucuuuuuauacaaagucuccuauccaauggcuuccauuccuacugcuaccaccaauuccuagauuauuacaguaacuuuagguuagugcaaaaguaauuggcaaaagccacaauuacuuuugugccaaccuauacuaauagauuucauuuuuuccauguucuucaucuuuuaauucagcccguacaaccuagccauaugcauuugacuaaaacauugcuuuuauugcaucacauuuuuuucuuuuaauaauuuauuauuugcuugagaaaaugaaaaguacuaaaggauauagccaguagagcaagacaaggagcauggagcuaggaauaggaagaugugggauuuuugcuuugauuuuggcuauaugaccuuaagcauauauguauaccuuccugagucucuguuuuucuauuauuuaaaauuauuuguugccaagauugguuaaaauaauguuauaugaaauugccaugaguucuuuagaacucuauuuuccugcuacagaguaaaaagacaaaauuucuuagucuggaauuucuuuucaaacugcucauuucuguacuaugcauggcauaaauagguacuuaaugaaugcuguuugaauaaauucuguacuuccaaucuuguauuucucucuuauuuuccaacucaaauauguugucucuacucugaccacugaaaauguuguucauauggucacagcuacaucauucuccuguucuuugcccugcuaagaaugcuguccuucacuuuuuuuucaaauccugauuuuuaggaauagucaaguuccccuaucuccuuugaguccacuuuugcuuuuucuuuuuuucaccauagcaauacuuacuaucuuuaccacucacugcucuauuuugagauauauaguaucuuguauuauuaauaaaaaugcccuguuugcauaccuucucuucuuuguauacuguaaacuccuguauaauaggaauaauagcuuugauuuuuguaguuacucuuuaaggauauuuucauugaacuuguaauauauccagauuaacauaugggccaagugcagcggcucacgcuuguaaucucaguacuuugggaggcugaggcagguggaucaccuaaggucgggaguucaagaccaggcuggcuaaaauggugagacccugucucuacuaaaaauacaaaaaaaaaaaaaaaaaguuaccugggcaugguggugcaugccuguaaucccagcuacuaaggaggcugagguaggagaaucacuugaacucaggagguggagguuguggugagcugagaucaugcuacugcauuccagccugggaaacagagugagacucuguuucaaaaaaagaaaaaaagcaaaacagguuaacauauaagaaaugguuuauauuugccacgagauauuagaacaaggauuggcagguuguuagaagugagauacuaagaugcugucagacuacugauacucuugauuuauagggguaaagaguucagauugcaaggguuuggggaagguuccccucuggaaaagaaugaccugcauauuguuaugaguuagugauucuucuauuuuaauaaagcaccccuuuaacauauagauaccuuaauuaggaacagguccuuauauaucaauauuguuugcuugugaauauaaauuaagugguaaaaggcauagaagucauaggggugagagagacacuuaccuuuccaccgauaacuuuugaauuuuuuuuuuuuaaguauuuacauguuuauguguucaaaucuaacaaauuggaacuguuucuuggauggguaaguuaucaaacauucccaccaguauaaaagucuucaacauauauuucauugcuuuuauuuguuaaaucagcuuuauugggauauaauuuacuuacuguguaauucaccaauuuuaaguguacaauuugaugaguuuuggcagauguauacaauuguguuccaccauuacaaccaaauauggaucauuuccaucacccccacaaguuuguuccugcccuuuuguagucaauccuuuaccccaucucauugcuccuggcaaccgcagaucuacuuuauaguacuacaauuuugcuguuucuagaauuuuauauaaauggaaucacgcaguauguaguuuuugcaccuggccucuuuuagauuuuagcuguauauguaucagcaguuuguuccuuuuuauugcugagugguaguuuacuguguggcuauaccgcaauuugguuguucugauaacuauuugauggaauuuuucuuuuucaggguuuagcuauuaugaauaaaacaguuauacaaacacaguguuaugcaauauaaguguuuuuauggacauauguuuuuauuuuacucggauaaauguguacaaagcgauugcugagucauaugauaaggguauguuuuaacuuuucgaaguaacugccaaacuguuuuccaaaguggcuguaccauuuugcauuccuggcaguugcucuacauccuugucaacacuugguauuaacaguucuuuuuauuuuagcuaucauucuaaugaagguguaaugguaacucauuacaguuacauuacuuuguauuucccuaaaaugauuaauuuuuugaacauuuuuucauguaguuuuuggucauuugcauauauucuuguguaaaguguccaaaccauuucccuauuuuuuauuuucauuuuuauuuaugaaggcaggagugcaguggcaugaucacagcucccugcagccuugacuucccaggcccaaacaauccucccaccucacccucugaggagcugggaccguaggcguguaccuccaugccuggcuaauuuuuuuuaacuuuuuguagauacuggggucucccuaugucgcccaggcuggucuugaacuccuaggcucaaacgauccuccugccauggccucccaaaguguugggauuauaagcaugagccccagugcccagccccuaguuuuaaaaaaaacaguucuuuguuuccuucuuauugaguucuguauauauauuuacauauucuggauagaaguccuuuaucagagauauguuuuccaauuuuuuuuuuuccaagucugugggcuugugcuuucauuuucuuaagugugccuuuucaaagaauaagucuuuaauuuugaugaagcccaauuuauugauuuuuuuccuuugugcuuuuuguggagugcuaaagauuuuuaucuaaacgaauaucauuuagauugccuuguauguucuucuaguagcuuauaaucucauuuuuaggcuuaugauacccuuugaguuaauuauuguauaugauaugagguguuguaucuuuccagauggguaugugauuguuccaguuccauuuguugaaaaagacaauaauuuuuccauuuaauuaccuuagcguuuucauugaaaaaucaguugaccauauauauguguggguuuauucccauuccauuuuuuaauuacugucuuuaugacaauacccuauuuucuugauuauuguagcucaaagucuuacaguuaaguaauauauaaucccucccacuuucucuuguguuucaaaaguguuuugguuaccuuauguccucuacauuuucauauacauuuuuaaaagccuacugggauuuugauuggaauugcauugacucuguagaucuguuucaagaaaauuaauauauuaaacaauauuggguguuaugauccacgaacaugauaugucucuuucuuuacuuaagucuuuaauuucccuuaccagugucuugcaguuuuuaguggauaauucuugcauauauuuuuuguuaacuuuauucccauuauauauuuaauacuauuauaagugacaucacaugcuauuguaaugcuagcaaugcaauauuagcaaugcuaguauuuaaauacaauaugacuaguauugaaguaugguacacuuuuucuauuuugaccuuguaacacuguaauguuacuaaaugcacuguuucuaauagcuuuauuuaauuuuugguaaacucuuaaaaauguucugcauagacaaucauguuguuugcaaauaaaggcaguuuuuacuacuucuuuucuaauuugugugccuuucauuaaucuuucuuaccuuauugcauugguuaggaccuacagcguugaguaaaaauggggagggaggauauccuugcccucuuauauuagaaagaaaauauucaguccuucccuauuaaguauaauguuagcuauaguuucuuucuggaugccuuuuauuaggcugaggaaauucucuucaauugccaguuugcugaggguuauuuaugagugaauguuaaauugagaugaccuuauacuuuuucuuuuagucuguuaaucuggugaaauauccugauugauauucuaaugauaaagcaaccuugaauucuggaauaaaucccauuuugucauuaucuguuuauauguauguugcuggguuugauaggauuuuguuacagauauuuuguuauuugucuuccuaagggauauuggccuguaguuaaauuuucuuguaguaugcuugucacuuuuuucuuuuuuaaacaggguaacacuggucucauaaaaugaguuggggaauguuccgucuuuuauuuucaggaggaguaaaccccaacuuaauuaugaaucggaaaacacaaaaguucacuuguggcacucaaacaacuuauuucuugugacugaaauaagaaauaucuuaauauguauuaaaggguguguucucccuuucagauguucuccaaaugauuauuuguauguaaaaacaaaaaguaaaacagaaaauaaaauagcuuauuuagguaugcuuauauaggccuuuguaaaaauugauaugcaaauuaaaauuuaacagcuuuggauauuaauuuaauaucaauaagccauagauaugacauaugaaaauauauucacagagauguuaauacuuauauuauuuuguuuucguucauguaaacauuuugugaagucucuuguacauucucauuaagucauacuuuguuuauauuucagcuuaacaacuugucagugguaauuguuauguuacauuaaauuaaaaaaauucuuuuucuagcauaauauuguucuacuaacaguucuuuguggcaggaaacuauuccuugaacaugcaguaguucuuaaauuguaucccauuuagaugagaaaacugauagauguauuuagauugcuuagucacugauuugaccucguuggaugacuuuuuacauguugcuguuaaaacuguucuauuuucauccaaagcacauucugugaacuuuaggaucaggauuucaaaugcugucuaccaucuaacacgguaucuguuaaaauuguuuuggaugauugggaaguuggauuaaaugaauaaaaauggugaacuuuauuggguggcaaacaugaaacccaauuuauauuuuuuugugaugaaaauaguuuguugcucucauauauuuaaaaauauuagaauuuuaaccuugugaagagcuuuauaaacauuugcuacauguauuuugucuaucuaguuuagauaaauauuauuuauauuaaauaaauauuuuaaauaaauauuaaugagaaagaaaauaagaaauaguaaaucucagcgaugaauguuaaaauguaccaaaacuaccagauuuuauaaauugugauaaccugucaucuuauaagaaaaauaauuggugagaacauuaaauacauuagaguaagacuacaggagaaguauugagaggcguuuguaguucucuguuacauauguaauaaaaauaauauguuguuaggaaauugguuaagugauuagggaagcauugucuuuucucacuguagaaauagaagcauguauacuuagaaauggcaagaaaauaguacaguguuuugaagcuuucuuuugauagugggcauguguagccuauaacuaccuaagccuggggugggguuggguugggauuaagggagguaagguauuagcucugagagucuaugaaauccugcuucauuuaaaguagaucaaaaugaacuaagugacaugaauaagguuuuacaaugacugaguuuaucaguuucaaguuuagagcuaaggaaaguaaaauugaacauugaaaauuauauuuuuuaaaauguugguuuaucuuauuugaugaguauaagguagaggaaaacugggaaaauagggugaugauuguuuuauggaacaaggacuuuuaaaaaauaauauuaaaucuauuaugugauguuguuaaaauauuagauuauuuaguuucauccaugcauagauugagguguaagaggauuuguguucuuaaauugguguugauuuaauuugcaucucauaagaaaauugagcauuuuaguaacauauaauuuaauuuguagagcccagaauagauuuaguaucuuuucuaaguaccuguuauguaacuuuuggguuuuauuggccccugccuuccaucauccaauuugucacauucccuacaauaaagcugaugaauuuguguauucauaucuaagcuggguuguaagccagaguaaugguagaaggcaagagaaagauaccagacugggguccuuugauauguaaccaaccaucuuuugaaguugaacauuuguuauaauaaaguuuuuuuuucuccaucaugucacuauaucauuauuuaaaaccccuuuccucgauuacaaaagcaauacguacauuacgaaguagaaaggaacuacacccauacucucaccauccauggauaacauagauaaccuucuuuagguaaaauacuuucaaaaugaaauuguauuagaguuauuaguggaagauguccucuuuuaaauucuaccuucuaucaaacuauaacuuauucugaguaaaauggauaagaauguaguaggaugagauaacuaggggcugaagugauaauucacgagaagauugagaaggaaaagaauccccaugaaauuacugaagcacagaacaaaaagggaagagcaaaacaaaaaauucugacucucaugaguaugucuauggaaauguaaaguuauauaaauaaguauuguuauguauuauguauacuuucacuuauuauucauaaaauuuauuuugauucgggucgcuuuuuaguuagcucacugcauccaaauguaaaacagugucuucauaauagaggagugcccaguaacugcgccaauuuuauguuuuccaguccuuuauucucagaauuuaaucaguaggaucuuguccugaaacuuaccaugugucuuccacuuuucacagaugugauugggguagaaauucuuccuguuuaucugaaugagaacccuuugguaaaauuccuuugauucugagauaacuagaugaaauguguugcauaaaucaugucacagcaaacaguugucaccuggcacuagagcuugaugaaauuuaaaaguguuggcucauugccuguaguguucaguuacaguucuauagaaagucuguuuguacagaugaagcaguucuugguguaaugcaagauucaucucucaagugauagggugcguaugaguuuauuccagagaucuuuacucugagcucccaagacauacucagaggggcauuguuuuaauuucucauugccgucccuuuggcacacuuacaagaaaaugaacagaucuucaauuuggugaaauucuuagcauuuauuuaauucagugucuacggcaaugcaggaauguuuucaauacuauucuuggcagauaaucaaauuugaguuugaagaugcugcuuuugucuguaacuacuuauucccugucagcucuugucuucacuuucuucuacuaccaaaguuucuauauccaucuuuacuuauugguagcuuagucuuauacuuagccuuuucuuacagaauaauaaauaucuauuaagcauguguagaaaaaggguaaugaacacauguucauugacuccagaagaaacuacaacuacaggacuguauucuuuacacugugccaaacuuuauuccuaaaagcuacauuagauuuugccauucccagacuuuaaaaccuuugucaccuauaggaaaacauacagacuucgggggucauaaaacagguguauuaucugcuuuaaaaaaaucacuuuguuucuauuucccaccuccauuacucuucuacuccauagguaaauucugauguuucugaucugaauccuuuuauuuguaugugugcuuguaagacauguagauuuauuuugugugcagacaaauacuggaugugccuguauuuuaaauuuguaauacuuguguuaugcucuagacauuauuuauuuugaccucagcacucuuuuaaagaucugucuauaucaauggcauacaucuggauugcuacuccuaacugcugcauaguauucuguagacagcacuugcuucauuuuauuuauucuauguauuggugacuuuacauuacaaggccuuuuuuaauaacugaccccauauuuuuaaguuaucucuuggaauuacacuucaugcaccuuaaauccuagcugcaugaagcccaucauuccugcaugaaaacaguguccuuuuuuauauugccauggcuuugcacaugcuguucccuaggauacuuccagucuucuaaugacugcuuccucacgacucaacucagaugucauuuccuugaugaagacuuaagcagcuauuucaugcuugagcuaguugcucuguacucugcucacacagcacuuauuuuuaucuugggaauauagaagccuacaauuccaccuagcagucuauauuucugucuagauuccuugaagacagcgacuagauagaucucaggcaucuuuguauucuuuacucuaguuuggugaauugcauauagauggcaaucgguaaaacauucauugaaugaaugaaguguguggaguuccuuaaagugaaauaccauauaagcaaaaaugauucucguaaguaagaaaagguugggacacaaauacaaaugucuuauaaaacugagagaauggcauacaggaagcugaauccuaaaaugaauugaggcuuguaaagauacuaaguacuggaacauguucagaucaugaaaaaaaauaauaauaaaagaacaaacuacugguugggacagauguaauacuggauagugcagugaaagcagaguuauggaacuccuggguuuuuaauuucucuaucaaaauaaaaugauacucaaauugaguaaagaagacuaaugacaguaagggaauugaaguuaagaaaggcaaagcaaugaugagaaagcacuuuuuugcucucaacuaguuaauguccuaggauuaaaugacuugcaaauaugaaugguuagguaaucuuugaaccauuauggccaguaacagagaugccagaaaacuaaagaucaugcagauacuguuuuuauuuucaaaaaagagaggaaaagguagaauucuccuauuuuaagaucaguagguuuuauguuuauccuugggacaauucuuuucuuuuuuuuuuuuuuuuuuuuuuuuuuuuuuugagauggagucucgcccuguugccaggcuggagcgcaguggugcgaucucgguucacagcaacugcugccucccggguucaagcuauucuccugccuuagccucccaaguagcugggauuacaggugcauaccaccacacccagcuaauuucuguaguagagacgggguuucaccauguuggccaggauggucucgaucucuugaccucaugauccacccgccucagccucccagagugcugggauuacaggcaugagccacugcgccuggcccuugggacaauucuuuaacugaugauuagacagaugacuugugaggacuugaguaguccucuagggaccacaugggcuuccuaggagugucucaugugaaacaugugacuuuuuuuuccccauguagguggaguaaguugauuuagcacgguuucagacagugucucaugaaauguuuaugacauauuuaauagauggccaaauuaggaguuagguuauugggccaaguaaauuaauggaugguugaaauaauuugaugaaugaauugaugucagcuuggagaaagguauuucuagugacaugauguggccguuuuuuucacuuuguucuauuaaucauuuuuaucauggacuugaauuaaacaggcacaucacauuugcauaucacauaaagcugggagcaaaagcuaauaguuuggaugagggaauuaggauugaaaaaagcuuagccaucugaaaugauuagcugaaauuaagauggucuguaauacugauuaacauaaaauuuugcauauagguuugucaaauuaucacacuagccacggaucaaguggauauguuuuaaaagaaauucauaugaagagaccuggaaaguugugguuuaacugucacugccaugucccacagugccaugguuugaaugugucuccuccaaaagugagauguagaaacuuaagggccaaugugauacuauucgagcaugggauuggucauaaggucaugagggcuccuucccuugugaaugggaguaaaaccccuauaaaaacagcuuuacacagccuucaggagcgugcucuucugccuucugccaugugaggacacaguuuccuccauucuggaagaugcagcccucaccagacaaccaaaucugccgacaccuugacuuccagccaaggauugucagauauaaguuuuuguucuuuguaaauuacccagucucaaguauugcucugucagcacaaacuaaaacacaaguguagacuguuuuaauagaagcgaaguacuuggaauggggaagugcagucucuguacugaugagaagauaccauuguauucauuuaugguuuccagguuuuaagaaguaucugggaacuuuauuauaaaaaauauuuugaagaaucagaaugguuuccuaacauaacuuuuguguguguaguguagagaaauuauuagaauaauaacuuuucagauacuuaaggcugaaagaauuaaccuaguucuauauuugcucagcuuuuaaaucauguauuuacuagcaggcugaaaauugugccaagcauuggggauauaauagugacuaaaaacagaaaaacugaccuccuuuuuacucuuuauggcacugacagucugauggaaaagguagacauuaaccaaguaauuacaugaguaaauguaaauugcagcuaugauaacuucaaugaaguagaaguauacagugucaugagaaagaguauauaguaggagcauuugauuugcuuaguaagggaagggaagggaagggaaggcuugccugaauuaagaaagaauaugcauugacuaggugaaaagggguggagagggaucuagggugaguaagcauggugcuuaagaaaaacagccugucugaugcauacagaaucugcucuaaaccugaaacgguagaaaggaaugaggccacucagccuuuaaagaccuugguaagaagucuguuccuuaccuagaaacagugaaaaacauuugcuggucuuacauagaagaguaccugauuuaaauuuggaagauauuucuggcuacgguguggggaauugacuagagaggauuugguaaaacaccuaaggaagaguuccaguuggguggaugagggggcauugugcugcaagaaaugggacuugucagggaaaguggaauucaguucugaagacgaggugggagacaaugaagauacauuuaggggcgggagacuuggguaugagucucaguuuuaccauucguagcuuaguggccuuguguaaaucacguuauuucugugucccugauuuaauuguaccacguuuuucucauagguuuuguugagauuagaugauuugauacacaugugaauggcuuauaaacuguaaagcauuauauaaaaugaaagauuuguggggaaaaaaauagucaauaauagccauuauuggacaggguagccuagucauagaaugggauuuuuucagugguuccuagucuuaacuaguuggaauagaugauucuuuaagauuuuuaucauuguaguuucagauuucccuaucucuucucaguugcuuuggagcauuuacuaacaaggacagccuaaacauuuauagcggguccaugcuuuuuggcuuucuaguggcaaccaaguagcuugaugugauuuuaagugaguuuuacacaugcucuuucucuuauauaugaucucagacauaagaggcaauuuaaggaaucuuguagcaaaaucuaaagcaaagaauuagaaaguauaaaaaaauucucaauauaucuuuugguaagguagaacauacauaucugaaguugcauucaaguacauggagauauacauguauuucuucucucgaguguugccuguguauauguauguguuugugggaagcuaugcaaauacagauccugugaguagaaauauaccuuuauuuuuugaaaugguuuauuuuacaacccaagauaaaguagaaaucaggguaaaauauacuguuuagcuacuuuuuugagacaggaaaggaaugacauuccuaauucauagcaaagagugcguguagguaacauuauuuauucacauauuugugcacacaaaauccacucaaauauccauuuaaacagcuaauauauuuauauguacuacucuaacuuguauuuuuacuaaaauuauuuauguauguuaucacuagucucaaaaacugaugcccaaguuaaauguggacauaucuuuuuuuacagugaacuaaagcaaaaagaccgggguauauuuaaaaauauauuuaaaauauuuaaaaaaucuaaauuuaugccaucuucugggauaaugccaaagacaauuucaacuguagcacucuguauaauuaaacauguuuuaugucauuguucuugaauuuuuuguugcuuuauuguucauuagaauuacucuuuuuuuuuuuuuuuuuuugaaaaaagagucuugcuuuguugcccaggcuggaguacaguggcaccaucuuggcucacugcaaccucugccuucuggguucaaguaauucucaugccucagccucccaaguagcugggauuacgggcaugugccaccaugucuggcuaauuuuuguauuuuuaguagagacaggguuucaccaugugggccaugcuggucucgaacuccuggccucaagugauccacccgccuuggccucccaaagugcugacauugccagcauuacaggcaugagccacugugccgagacagaauuauucaauucuaaguagguaugacuucugcuugugucuuaggauuuggggcauuucuaugcagaagaaauacuguucauuuuaguuaguuagugauaaguauuuaguucccuaaugaacugcgaauaauaauugcugaaaaccaguuacacuugggggguguuuacacuugggaguugcuucuggauccauagcugaguagaagacaugacagagugauuaaucagaucucgucuacagacuuccauuuauacugauaaugaccauaauagaugggccugucacuaggcuaagaaauuuacauguguuuuuauuuaaucuuuccaacagucuuacgggaugugcguacuguuauuccaguuuugcagaugaagaagcugggauuuagugaaguuaaauaacuaguaaauagagagggcuauguuccauccuaaguugcuuuugauuccaagacugcuaugguauuuugagacggcugauuugguacaaaagaacuugauugaaaucauuuuagucuaaucuccuggagccaugcuacuuucuaugguacuauauuaaaaagagauaauacacagauagcagauacaaagguugaaaucagaaaccuauaguauucccuguguaauaauggauuucuuguugcuuuuauaauaaguuuuuaaauagcuaaugcauacacauaguaaaaaauaauucagauagccagagugucuauagagugcaaaguaugucuuuuucccacaccagccuccuauucccccacacagaagcaaccauuguaucuaaauugugguuauucuuccaaauaugguguuaacaugaauuuauuuuuauuuuuauuuugcccaggcuggagugcaguggcacaaucauaguucacugcagugccaaacucuugagcucaagcaaucuuccugccucagcuuccguaguaguugggacuagcaagcaugugucaccaggcccagcuauuauuuuuauuauuuuauagaccuggugucuccguauguugcccaagcuggacuugaacuccuagugucaagcaguucuccugccuuggccucccaaagcacugagauuacaggcaugagccaaugugccuggccauuaguuguuuuuuuaaaaaaugacauuugagcaucaauucuuaagaaaacuagaagagccagaucuuguaccagauugacaucugaaugggccaagcuagagaaggcuggagaaggaugcagaugacacaccuucagugaugagagugucagauagggcgucagcauuacccaccauccccauagggguaacagaaagcccuugcagcagguuugucuuguuucauagaugagaaaauugguuacuuaggucauguagggaguugcagguagagcagaacucagaugcagaaauaugcuucucauuuuuccaauucuacuucagcacaaaugacuuguggauuugagaguguaacgaagaauuguacaauugaaauuguacaauuccaaaauugacuaaggguuucuacugguaagccagauagcaaacuucagaaagccaaagucaguagcagauauuaaaaaaaaaaaaaaacuuuuaaaauacaucuuuuuauuuuagaauaaauuuagauuuacagaaagcaugugaagauauuaaacagaguucccauguaugcuacacccaguuuccccuauuauuaauagguuuauccacuaucagguuacucuggaaggaagucacuauaugcagccuacacauaagaaguggaagauuauguuccaccuuccugagggcuaaguaaauuauuuggaaugcuucugcacaagaaauuugucugucauucuguuuauuuauuuuuucagucaaaacuuauuuauuaucuuuuugagacucucucuguugcccaggcuggagugcaguggcguaaucguagcucacugccgccucgaccuccugggcuugagccauccuccuaccucagcuuccuaaguagcugggacuacagacacgccaccaugcccugcuaauauuuguaauuuuuugagagaugggguuucaccauguugccuaggcugaucuugaacuccugggcucaagugaacuuccuacuucagccucccaaaguucugagauugcaggugugagucccugugcccagccucagucauuuacauauauaaauauggcucauggauuauaugauuuuuggguuauaauccaguacuacaguuuuauugcucaaauuguuccaacuuuggccauugagagcucuuuuaguugacuucuauaucucuuuaacacacuuucaucauuguguuuuauuuuuguuuucuauuuugagcgcuucgcuuuccuacacugcaggaugcuccagauucgccuuuuauauuuccugcuucacuccuagaaucagcuuuuucuccauggaaguccgauucuuuuuauuggaaaauaguauuggaaaccaagaucugggugccaguuguaauugcagcucuuuuaaaaccaaauauugaauagaaaaggaaguuuuagccauuuucccagguaguacuaaauuaagucauugcaauaauuuauauaaguucacuggauugaauggaaugauccuaaggauuuuuaagggaaaauucuaagaauucuuauuacuguuuucuguuacuuuuuuaaaaaaauucuguaaugauaucacuugauuugauuuuuuuuguguguccuugaccaaaaaacuugaggcaaaacuucaaaacaugguaauuugaagcagguugggauuaacucugggauauuggaaagacuuuaaacuccauuaggaaaauuaacaagcauguagucuauaaaagacauguaauucauauuuauauaaagaauaauacuuucuuccaccuucagacaucuaagauuuaaaaaaauguucuuuuuaaaagaaagaauaguacuuucuuuuguaucacuaaacauuucaaauuuguguauugaacagaggauuggggagaauguuuuguuaaggaaagagaaaaacaaaaaaauagcaaaaaaaagagagaaaaacaugaccucugaggauaguuaaaauacauuuuaacuguguuuuauguuguuuuaaagagacguucccuguuauauaucucgucuuucugacaccagaauugagauuuucuuaaucugagguauuuucacauagaucaaacaacucauuuuuagagguuuuaaagggauuuauuuguaugugugugauugcaaccuuaguaguacugaugaaccuuuuugaaagcuuauauuuuaauuuuauuuuuucucugccuugccaggcaaauacucucuuuagcaucuaccauuucaauaaacaaguugaauuuuacagcccaucaagcaaccagauugguagaaccacaggaucugauaggugaaugcauaaacuauaaaaaccaaaaucauuuucaaagaauuaaccaaauguuuuuauccugggcuacgaugaucacuauuuguccuaaacuauuuuaauuuucugugucuuagguuuuuuuuuuuuuucuuuucuuuuuuuuuuauugagacagggugucgcucaguugcccaggcuggagugcaguggugugauaauagcucacugcagccucaguaauuguagcuucaaucucuugggcucaaacgauccuccugccucagccucuggaguggcugggacuacagauaugcacuuccacaccuggcuaauuuuuuuccuuuuuaguagagacaaggucuugccauguugcccaggcuggucuugaacuccugagcucaggagcuccuuggccuccccaguuccugggauuaaggcauggggcacugugccuggccaauuuuccguauguuaguuuaacuguaaagaauagucuuuuaaaucaaugugaauagaaaagugucaaauaaacugauaguguacaguuguaauuagaaagaagcacagcaccaaugaggaaaagaaccaggcagguaaaaacugagggaaggguaaaugaaaccaucucuaauaaauaagcaaacaugacuagugcauagaaaaacugugugaggcagagaagcuccaagagcucugggaugaaaauagcuggaaauccucaagagggauggagcuuaguguagagauggggaaguaauuuugaaauguugagaccuaugcuugaagagccuagaaacaaugaucuuggacacgacagaaggaaauuaagugucuacaguaugcuagguguugcucuccuauguauuaauaugauaucauuuaauucuuaccucuauucuuugagggaggguauuauuagcaacaauuugacagauggaaaaaaugagguacagaggggguugaaaacaugcugcaagucacauagcaacuaauuggggguaaacucaaagggccugauuuuuaauuuuaaaguaguuuggggauaaagauaauagacaaaaccaacaagguguagcauaggugcaaauucuuagggccuaggucacccaucaguacuucuuuggaguuuucuggguugaauugguuaaaagaaaagaguugaaaauuguuacauuuagauuuagguaguuuauugcaguuuaaaaauguggguuauggcugggugcaguggcucacacuugcaaacccagugcuuugggaggucaagguggaaagaucacuugaggccaggcguuugagaccagccugggcaacauagugagauuccuuccuuacaaaaaauuugaagaauuggccagaugugguagaaugcaucuguaguccuagcuacuugggaggcugaggcgggaggauuacuugagacuaggaaggaguuugaggcugcaauucacgcuaugauggcgccaccgcagucuagccugggcgacagaaugagacccuucucuauuuuuuuuuaaagaagaaaaagaaauauguggguuguaauaagcugcuguauugugggagggccucagaauggacagaggacucauggugauacagcugauguagcaaauggauuuggggauguaaaggucgaaauggaauuauuugguccuuuuaauuaccgcuuaacacuuugaacaggauccuuugucaaaaucccuaccaacugcacagaaugguuuuugacucuccuuuuuuggaaaggaucauuuuuaagagauuacucuuagacucuggcaaaaggauuguuaguauauuaguccauuugugagugggaaaaaaauaucuaaaaccacugugaauuguaagaauguaauuuuuuuuuuuaaaucauguguuuauguuuacagaguaaaucucaagagcaaauuaauuauaugucuguaguucuugaaguuaaguaggugaagugagggaaaagcaugauuuauucuugcuuuauugcuggccaaaucucuaggcuggccauuuuucccuuuuaaugaaaaugcuugugauuccuugucuucccauuggcucauaguugagagcucuguuaaguugucugugagacggaguauauuaggcuugccugauuaaaauuguucaugagagaucaagcagacaagggacuuuuagcauaauuaaaaaagcacugcuagccuuuaaauaggagauuucagagacuuuugaauucauauccaccuguagggaaguguguuuaucuaauuagauucugauucucuuaugaaugcuucuuacuuaauucaugcaugguguccuuucauuuuauagacuauuaucccuucaugcaggagacacaaaaaaugcuuaauggaaccaaaucuugaaugaacugaaauguuuuccuugaaagaucacaaugugauaaguuaagaagucgguuaccuccuuuuguuaaccuguguauuuauaaaaugagcaagaacaaaguugaaaauaguaaaagaaaaaaaucgaaacaaauuguauauccuguguucucugguuaaccugagaaaauuauaccagcauuugagaaauagucuucuuuuguuuaauggaugucuuagcccaaaguuuuugucuuuucauuuuucauuucucaacuuuugcauugcugggcucugaaaucauucaguuauuaucuccauguuacuaucauguuucagaaaaaaaugauuauacuuaauggaguuuaaaauugcuucuuuuguccuucugagguaaaguccacuguuauugacugaguacuuuauagagcacuucaguuuuuuuuucuuguguguuuuuuaaaagacauuuuaauucuucagaaaggaaugcuuuuuagcauaaaucaaaauguuauugcuauaaugaggcagcauguuagaagaaaauuaucaaggugugaauuuuuuuuaaccuacauguauaaggcauuaauuucauagacuaagggauucugacaugugaacacuucucuagagaaggcauuuuccucaacgaauaaguaaugcuuuguugucacccagaagauugcuuuagaacauuucucauguauuuaaaauaauuuuuccauuagcugagaauuguucucaaagcuucuugauuuuuuuuaaguuccaucuuauuuuggauuuuuuaaaaagaauuaguucuagccugauuuuaacauaaaacagcaguguccagcaagaacccaaauuauuuccauuuuaagucugugugagagaauagaugauaaaagaagccccucaaaccaaaauguaccauacguuacuccaauuuauuaagauugauuuuaggaaacuaaucaaacauauugaucaggcauaaaaauauuuuaauugaaaaucauaaagaauugagaaggaaaggagucugaaauuuuaaauggugagaguuguauguauguuuuuuuuuuugaagucucauuaucugcagaaggagugcacuaaacaagguuacaucuugaaaugguaaaaucucugaauaguuuuguuugugggaggaggucacagaaagguuauuccucuggcuuucuucuucuugacaagucaucagaguaguucacagaucuccugguuuccaaccauuuuacauucuugagaauuaauucuugcaucaaauuauauauuaccuuuacuuuugauuaaauaaacuauuuuaauaggaucacacaaguaggacagauaguaauaguugcuucaaugaagacuucauuuaggaugaaauaauauaaauuaauacgguauaguuacauguuauaguuauggcaacuuguauaccucugcccuaugcaaguacuguuucuuuuauauacucccccaguaacccacucguuuguguaucaauuuguuuguuuacucauucaccugcccaucaucuauccauucagucaaucaauauuuauugaacuguucucauauaucaggcaucgggcuugggcaguggagauacagggaugaguaacugucuuugaggagauguuuuugcaggaaacaaaccuacaaauaaauaauaccaguaugaauagagugguguacauguaaaaggagguacaucuaaaugugacuggaaugucaaagaagauuucaccaaaggaaacaauauuuaaacugauccuggaaagauaaaacuucauucaccaggccagaaaucagggcaugcagagaagugagaacagcaaguacaaaugcauugcauuuuuaaaggacuuugaaagaucuuaguaugucuagaauacaggagaaauaacaggaaauuaugcuggaaaaguaggcgggaagaucuccuaucgaucgcguugacaaguuuacacuuugccucuaaggaauuauaaggcacgaaagccaucaaaacuggaugcauaacaugagaaaauuuguauuuuuaaaaaauaaauugggugggaauacaggaaauauuuggagaagaaagaaagagucuguacgcagugaucaucagauggcccuuauuuuuucagugaacucggagugauuuuguaagauuggauuaugaagccagaugggcuugacuucagauccucaaccugcagauccccuuaacuucacucacccugagauauuucaucuguaaaaugggaaaaauagcuaucuugaaguauugauaaguugauguguucaagauguuuugcuuaaauuucuaggccuaugauaaauauucacuaaguaguggcuauuacuauuaugcauugaacucuuaacugcuuagaauugcauaguaaacauuauaaaugcucccuucucucaauaaauuuauaauaacuuacuuuaugaaaaauacaaacagacaaauacacauuugaaaacuauguuuaucuuugaagauuucuuuauugcuuucccuacgugaaagauaacucaguugaagauugacaagugcauucauuaaccuacaggcucccaaauacuuuaaaccauucaaaauguuggguauugauggcuuuaaguuucaugaaugugauuaaauguauuucuccccaaguacaaacuaucuguucuguuuuccuaauaaguggcauuaaagaucaggaaguacugucugucuccuaucccacauaggaauuucuccuagacccucaccuaacaaagugaucauuugaguuucugcuucaacucuuucugugacugagaaaaagcuuuauguuacaaagcaguccauuccauguucagacagcuucaauugucaguauauuccauugguguagcugauacagcuuccuuuuaauuucuccucuguggguacugauucucuccugaagccacacagaccaaaucuaaucagcauuuuacuugcugugccaucagcuguuuggcaaaugccaggauuccuuuuuugaggcuucucauuucuagguuuaguguauucccaguuuugccagucguugauuuugugaaaaacagcuuuguugugguauauuuggcauacaauaaacugcauauaguuaacuuuuaauuugauaaguucugauguaguauauagcugugaaacuaacaguacaaucaagauaguguauauacuaucgccccagaaguuucccugugucccuauucucuuucucuugccucucccugccccaccaagaucuaucccucccuacccuugcaauuuuucuucuguuuucugucacuauguauuaguuuacauuuuccagaacuuuauaauaauaaaauaauacagugugcauucuuucuguguggcuucuuucacuuagcagaauuauuuugaaauucaucuauauuguugccuguaaugguaguucauuccuuuuuauugaugaguaguauuucaucacauggauauaccacaaugaguuuauauauucaccuguugguagauaauugaauuaugucuauuuauugauuaucaugauuaaagcucuuaugacuaucgauguacaugauuuuggacaaaugcuuucuuuggauaaaucccuaggaguagaauugguuaggugauaugguagguauguauuucaauuuuuaagaaacucccaaacuguuacacagacuguuugcacuguuuuaaauuccaaccagcauuguaugagaauuccaguuucucuacauccuuaccaacaguugauguggucaguuuuuaaaauuuuagccauucuauuauuaaaaagucaaaaaacagcugcuggcaagguugcggagaaaaaggaauacuuuuacaucguuggugggaguguaaauuaguucaaccauuguggaagaccauguggcaauuccucaaagacuuagaggcagaaauaccauuugacucagcaaccccacuacuggguauauagccaagggaauauaaaucauucuauuauaaagauacacgcauguguauauuuauugcagcacuauucacaauagcaaagccauggaaucaacccaaaugcccaucaaugauagacuggauaaagaaaauguggugcauauacaccauguaauauuaugcagccauaaaaaggaaugagaucauguccuuuacagggacaugaauggaguuggaagccguuauccucagcaaacuaacacaggaacagaaaaccaaacaccacaucuuuucccuuguaagugggagcugaaugaugagaacgcauggacacauggaggggaacaacauucacuggggccuguuggagaggguuggugguaggaggcagggcaucaggaagaauagcuaauggaugcugggcuuaauaucuaggugaugggaugaucugugcaccaaaccaucaugacacacauuuaccuauguaacaaaccugcacauccugcacauauaccgcugaacuuaaaaguugaagaaaauaaaauguuagccauucuaauggauguguagugguuucuuucugugguauuaauuuguaccuucuuaaugauuaaugauguugaguaucuuuuuuugugcuuauuugucacuuuauaucuucuugagugacuguccaaaucuuuugcucacuuuuaaucagguuguuuauuauugaguuuugagaguucuuuacauuuauggauguaagacguuuauuggauauauguuugcagagccuagccugcuuuuuuucuucauuccuguacagugucuuucaaagagcagaaaauuuuaauuuugauuaagucuaauuuauuaauuuuaucuuuuauggauugugcuauuagcauuauaacuaauaaauuuugccaaaauaaaugccaaaaauauguuuaugucuucuuccagaagcuuuauguuuuacacuuaggucuauaauccauuuuuauaauaaacuuuuuacuuuggaauaauuuuagauuggcagagaaguugcagagguaguacagagguucccauauacccccauuccuuuucuccuuuugugaacguuuuaaauaagcaugauauauuuguuacaacuaggcaaccaggggguauauuacuauuggcuauacuucagacuuuauuuggauuucaucaguuuuuccacuaauaucuguuucuguuccaggauucuacauuuuguuuaguuuuugugucuccuuagcucugauccuugauggcuuuucugucuucccuuauuuuuuuaugaccuugacaguuuugagcaguacuggccagauacuuuuuggaguauccuucaauuuuguuuuuuugauguccuuuucuugauuacacagggguucugauuuuuuuuugggagaggugccuuucucaucacaucauaugguaucaauauacgcuuaucauugauguugcuuaaccuugauuaccuaagguaauauuagccagguuacucuaugguaaagucauuuauuuauuuauuuauuuuugagauugagucuugcucuuguugcccaggcuggagugcaauggugugaucucagcucauugcaaccucugucucccggguucaagcguuucuccugccucagccucccaaguagcugggauuacaggugcgugccaccacgccuggcuaauuuuuguauuuuuaauagagacaggguuucaccauguugaccaggcuggucucgaacuccugaccucaggugaucugcccgccuggaccacccaaagugcugggauuacaggugugagccaccaugcccggcugguaaaguucauucuuuucacucuuucuauauucuguuuuuuggaagcaagucacuaauuauagccuaugcccaaggaggggaggguuuuauagaguuuuauagaggguuuuauguccuaucuccuagagguguggguauuuacauaaguucuuugaaauucuucuauaaaaauauuuaucucuucucucccauuuauuucuccaaucauuuaucaguauggccucauuuuauacuucacauuacauucaaauacuacguuauuuuguuacucguuccagcuuuggccauugagagcucuuuuagguuggcuccugugucuccuuaacuuguuacccuccaccuuuuuuguugagcacauuuuauuuuuugauacuacaagaugcccgagucuuuuauuuucuaugccccagcgccagaaucauccguuucucaaaggagucuugguucuuguuuuuagagcuuauuauauagaaauuaagaccuggacacuggauaugcugguuguugccacagggugucacugugucuagguuugcuuggcagacagaaccaggaaacauauguaaaugugcuaacccauggaucucucucucucucucucucucucaauucuguagcuguccauuuguauauauauuaaacuaaauaugcguucauacuggugucucugacucuaaucucauaccauguaauucauuuuagugcgguuuauuaucauuaaugucucuauccaacaaugagaaacauggcuuccaucauccauuuacuugguuguacaaacccaguauacauauaaagcagcuucagaguuguuagccuauacccugcaauucauuuuuaguuaauuuuguguaugguguuagcuguggaccaaaguucauuuuugaaaauauggauauccauuuguuccaacaauacuuguuaaacuucuuucuuuacuuggaugccuuugcaucuuucuugacaauugguuaucauuuauauaugggucaguuuugaaauucuguauuccauuucauugguguguuuguuuguuuuuaccccaguaacauacugucuuaguuauugcacacuuacaguaagucuucaaaucagguaguguuagcucuccuuuuuacuuuuucuuuaucaaagguguuuuugcuauucuaaguccuuuggauuuccauaugaauuuuagaguuaacuugucaauuucugugaaaaagccuauugggauuugggauuuggauugcauuagaucuuuaaaugaauuuagcaagacuugacauguuaacaauauugggucauguaacccaugaacaaguuauaccucuuuacuuagcccucuaauuucuuuuagaaguauuuuuguaguuuucaguguauagaucuugcacaucuuuugucagauuuauuccuaaguauuuuguguuuguggaugcuauuauaaauuuauuuuuuuaauugcagcuuuuagguuuuaauaacuaguaaguagaugauauacaauggauuuaaauauugauuuuguaucuugcaaccuugcuaaacucacuaguucuuguagugauuuuauagaugcuaacuuucugucuagaugaucauauugucugaauagaauuuuauuucuuucuuuaaaaucuagauacuuuuuguuuguuuuauuuugcugauagcacuagcuagaacguccagcacaguauugaauagaagugaugaaagcagacaucucugucuuguucccgaucauagagaagaaauacuuaauuuuucaucuuuaaauaugauguuaacuacaaguuguuaauagauuucuuuaauagauggaaaaaauucuuuuauugcuacuuuucugagaguuuuuaucagcaauggauguuagaauuuguuaaauacuuuuaggugccuauuuagaugauuguuaaguuuuucuuuuucaguuucuuaguaugguagauuacauuuaaggugguccgaaacccuaaacaaacuuucagauccugagacugacucuacguaguucugauguauuauccuuuaugaauauuagauuuaacgguuuaagauuuuuacauuuauguacaugagaaguauuggugugugguuuccuuuucuuguaauaucuccauguguauuaaaguaaugcuggucucauagccuagguugggaaguauucucuccucugcaguguaugggaaacauguuaguauuguuaguauuguuuauucuuuaaauguuugguagaagucauuugagccggaguuuuccuugugggaagguuuuugaauuacaaauucaauuucuuuaauacauauaucacauuauuuguuucuucuugagugagcuuagguaauuugagucuuucaaggaauugauuacuucugcuauuaaauucucaaacuuauuggcauaaaguuguuaaaauauucccauauuaucuauagauucuguaacgaugccaccucuccuuccuggaauugcuaauuuauaucuuuuaauuucagaucagucugucuagagguuuaucaguuuuguugaccauuucaaagaaugagauuuuguuuucacugauuuuuuucuauuauucuguuuucuauuucaaugaauuugaccaugauccuuacuuucucucuucucauuacuugaggcuugauuuacucuuguacugauuucucaggguggaagcagaggcuauuaaguuaagaccuuucuuauuuucuaauauagauauuuaguaguauaaauuucccuauaaguacuguuuuaguggcuuacuacaaauuuuuauuuuuauuuuuuuuaauuucguucaguuuaaaauacuuucuaauccccguuuuuguuucuucuuugacccuuugguuuauuuagaaguuucauacuuaucuccaaaauauuuggggauauucuagagaccuuucuguuacuguuuucuaauucaguucaauugugagcagauaacauacuguuauagcuugaaucauuuuaaauuucagacuuguuuuauggccagaauauuauaaaucuugguuucugucaguuuuugauucauauauuuugagcucuguuauuuggugcauaaucauuuaaaauuauuaugucgucuugaugaauugaucacuuuaucauuaugaaauuauucucuguauuccuaauaauaguucuguucugaaaucaacuuucuuucugauacaguauagccacucuagauuucuuuugacugguauuagugugguauaucuuuuucuguccuuuugcuuuuaacuuauaugugucuauauuuaauguauauuucucacaggcagcauguuguugugucuugcuuuuuuaggagucuauuaaccucugccuuuuaauuuuuaauuggaguauuuagaucauuggcauuuacuacuauuauuuuugauaugguuccuuuugucaucuugccauuuguucuuucuuugucccaucuguucuuucuuuuucuuuuucuaccuucuuucuguuuuuacaccauauuuuucaugguuucuagacccuuuaagcaucucuguuguccucuugaccuagcuccaauuuauuuaaagauagauauagacuuacuguaucaaguucuucaagacugaagucuaaugucguguaaguauuuuugacugaggauuuguacaggucauuucgucaguucuaaaaaacacugcuugcuaauuuugcauuugccauaauacuuaaaugugaaaguauaugaacauuguaguugguuuugaaugaccuuuuuuaggaucaacugucggcuucuguguuauucccauucccugaugcaagacucugaggaggugacacacuggagccugaggugcuuauuuacgaucauauggagaacaucuuggagauggccagcuuguauucuuagguuuaucaguauguuucugucuuuauucaaggucuucuuuuuuuccauuuuauuuagggagaggaaaaagaaaauauauacgucauuaguuuuuuucaucucugucucucuacccauucuuucccauauagaaggccugguagaauauauuuuucaaaaaauugagaagcauuucccuauccaauuuuaaggaaauauauuuaauaugccaucugacauggagagagggcauucaggucuugugguuucugcagguaagcgcaucacaugaagaagggugaaaggagagauaggguugggcuugaauacugcagugguuacuuaaugagguuuugaaaccggcaaaucagcaccuuuuaacuucaaauccuaggaaguaggguggaacgaagucuauguaugaacuccugagaggccuaaaccugaaauagcuuuaugaacccuggccuaguacugaagaaaaauaacuucuccaaguucccccuugcuugaaguugccuucuucuacgaggauuuccuuggacuagcuuuauuaccagaggauuuuuguuaaagcaccucuaguuucuagaagcuauauaaaucaggguauucuuguucauucuguguucuaagucuagcucuuaaaauuucaaagaagcagaaugugguaccuccccauuaaaugcaggugcuuucugcccuguuuauuucaaacaguugaaugucuauaguaguuaggacugaugauuuguaagcugacgaaugaugccaaaaacuaaaugucucuugaguacaguggagccuauagucuagucuccaugaauauuagggcagugugccaacuaaagcuggcuuaauucugcaagcaggagcccuuugcagaaggauucaugguaauuaaccaauucaaagugcaauauuuuccuuucauuaauguggcagaaaacaacuaaauaucuacagcaagaauguuuuugacauuuucauuugcugcuuggaaaauaauggauacuaugaauugugcuauaaaagaaaacugcuaggauuuugucauuuccauuucaacuuccuaacaaaaacguggauuacucaaugagcaauuuuuuuuaaaaaaauuaauaggaagaguuggcugcaggaguuaccagaauugauugacauuuugaggugcuuggcuuguaggagauucuuagggaguuuauuggcucaggcuucuugcuugucacaucuccuucccuguaugucugaguaauagaauuccaguugggugugaucguuuccuauccuuucugucuucucaaguucauuuuuaucccaaauauugcacagcauuuugcucucuucuccuguuucuuuuggguuaaagaaguauuuauuucaauuaguucaugcgaaggauuguuaacuuuuuacuuuuaaaaauguacuuagggccagccaacuggcauguaguauuuugaauaauuuuggaacuaaguguccauugaugacaaauguuuugcuggaggaauuacugaaguauuuauucauuuuaagguauauuaguuuugacauaaauacucuuaucuguugauaguguuuaucuuuuuacuaaaaauauaaugcuuuuauaaucauaccuuugauugcuagacucuaguuauuaaaaacuugaagaucacucaaaauuuuucccuccugcaauuuugacacacuuucugggcuauauucuugcuucuguauguucuuuuauaaacuggauauguuuaguuagaaaaauacugguuguaauuaccagaaacccauuucagccuaucugaaaauggaaaucuagaaggauauugggauaacuucugaaaucacaaagaacaacuuggcuucaugaagaauuguaauuugccauagguaaagcuguuaggaacauagguaauacucuucccaucuuuuaugcuugcuucuaucuagaugucucuuacuucuuuacacuuuuuaguguaaagauguacuuuuuaguacuuucaaggauguacaugaccaaauauaguuaccuaucacuacuacuuaaucaguuaaagugaccagcauagagacaccagagugucagucccaguccugaaaauagcacgagagaaaauguagaccaacugggagcagaugauucacucuugaucuaauuaguuauuguugagagagcagcaucaugaaguacaaauuuggcugcuguggccccacucagauaaaaggcaguguuauccuuuuuuuuuuuuuuuuuuuuuuuacaaugcagaugcuucuuaaguauaaggauaucaaaagaaauucucugugaaugugaauaauuauccauucaaucaauaaauauaauuuuguguuuacaugugucaggaacugugcuaauugguagggauucaguggugaauaagguaaauacaauauugagguaacauucuagcagaguaaauggaauuuguaaaaaucaccguauaaauaaauaaaaugcagucaugaacugcauaaugagguuucagucaaugauggacugcauauaugacagugguccccuaagguuauaauagagcugaaauauuauuauagccaagugaugucuugaugauccugagccuauguaggccuagguuaauguguauguuugugucuuaauuuuuaacaaaaaaaaguuuuaaaaggaaaaaacuaaauauacaaaaagauuacggaauaaggauauaaagaaaauauuuuaguacagcuguacaguguauuuguguuuaagcuguguuaucacaagagucagaguuaaaaaauuaaaaaguuuauaaaguagaaagguuacaguaagccaauguuaauuuauuacuaaagaaugaaaauuuauuuuuauaaauuuaauguaggcuaauuauacaguguuuauaaagucuauaguaguguacaguaaugucuuaggccuucacucacucguugacucacccagaccugacuucuaguccuauagguuccauuucuguuaagugccuaauacaaauauaccauuuuuuaucucuuaugccauauuuuuacuguaccuuuucuauguuuagauauguaaguacuuaacacuguguuucaauugccuauaauauucagcacaguaacauacugaacagguuuguagccuaggagcaauaggcuauagcauauagccuagguguauaauaggcuguaccaucuagguuuguguaagaacacucugugauguuuacaacaugaugaaauugccuaaugaugcauuucuuaaaacauaucccuguuguuaagcaaugcaugacuguaauugugaaaugugguaagugcauuaaagaagacacccauggcugagcuagagaacuggcauuuggagugcagaaggaggguggggagaagguaaggacacuuacugcacugcuuucuaaagaggugacguuuaucuuuagacuugaaagauuagggaaggauguuccuauuaaggaaaguggaauguacaaagaccuugaaguacaaggacuguagaaaguuuaaggaaauacaagaugaucauuguggaggaacauaguagaagaauuuaggaugaauuugucaacaacuagcuuuuguaguguauacauagaccaaggcucugauuuaauuccuuagcauuuauuagaaaaucuaccauguuacagagauugcuagauuugguaagcuuacaugcgaauaaggugaacauaaggaugagccuuauaaaggaugacacacuuaauaaugauauaaggcagagugguauauucuguuagaagcguauuuguucauuucuuaaauauuuauugagugcuuuauuacgugucagacacugaucuaggcacucaggccagauaguaaauaauuacuaauuauguaggaccucucuucucauggggcuuaucagagccuuguuacucaaaaauacgauucucugaauaguaucgucagucaacuaugagauuguuagaaaugcagaaucucaggccccacccagauguacagaaucagaaucuccauugagauuucacaugauuaguacaaauaguauagauugagaaacacuguucuagagcaggguuuggcagacuauggccuuggugccaaauccgccuggcugccuauuuuuguaaauaauguuuuauugggacagccaugcccauuuguuuacauauuaucuaugacugcuuucacaggcaauggggcauuugaguagcugugacagggacucuagcccacaaagccuaaaauauuuacuacuuggcccuuuacagacuuagugucccacccuuuguucuaguccguaaacaaguagcgugacagauauuuuuacuuauuugauugugaaaaucuuuauggaauaggcaauguuugaacaguucugaaaaacauugguuuaacacauuuuuagccuguaaucuacaauacaaaugaaauacaguugacccuugaacaguguagugguuugggguggcaacacccccacccaagcacagucagaagcuagcuauaacuuuugacucccucagaacuuaacuauuaauaggcuugccaauaacauaaacaguugauuaacacauauuuucuauguuaucuguauuauguacuguauucuuacaguaaauuaagcuagagagaagaaaaugcuaccaagaaaaucguaaggaagaaaaaauauauuuacuauucauucaaugggaguagauaaucauaaaagucuucauccuaguuaucuucacauugaguaggaugagaaggaggaagaguagggguuggucaugcugucuuggggaaguggaagaggcggaggagguagaaggggaggcaggcacacuuugugugacuuuauggaaauacaguugacucuugaacaacaugggcuugagcuacauggauucacuuauauuuggauuuuuuucaaccaaaugcagauaaaaauacaguauuaugggauacacaacccacauguauggggccgccuuuuuguauacucggcuucugcagggcugacuucaggacuugaguauucagugauuuuguauauauugauuuagguauacauggguuugguaaacuuacacgcuaaccuggaacuaauccccuauauauacuaagggacaacuguacauuguaauuuguaucugacuuuuuugcuuuaucuuuucucuaaaaauguuucuuuacaguaccaacccuucuuccacuguuuacuuuaguuuuagcgcccaugucauagaagcauccaagucauaaaagaaaccaaaagcuaucuugaguaauuggaacccuucugccauauugucuaauuuaacuucguuuucuggcauugcuucuacaucuucuuccucauaaucuggcauugguuuggaugcacucaaggaauucaagucauauucuguuaauuccucugguguggugucuguucuuggauuucuccaagauccaugucuucaaaccuuucauccauuaccuuuuuuuuggccacaucuacaagcucuuucaugacuuccuugcuuggcacuguucuaaaucuugugaagucauguacaaagucugggcagaguuauguccaacaggaauuuaugguuugggcuuugauagcuuucacagguuuuucuguaacaaccauggucucuucaaugguguaaucucuucagacuuucaugacguucucucuacugggguucucuuccauaguaucgacaguccuuuccauugaguacuaugugccuuaaaaauccuuaugacccuuuaucuagaggcugaauuagagauaauguguuugggggcaaguagaucaguuugaugccuuugguacugaacucaugggguucugggugacuggggcauuguucaauaucaaaagaacuuugaaacacaggccguuuauuuacaagguacuucuugacuucaggaacaaagaaucaguggaaccaauccagaaagcuguucucaucuucuuaggcaguguggcaaaagagcuucucauuguacaaccaaaagcuuagcugguguuuaucuuucuucuucauggcuuggggaacagauuuauagauaagaccaguccugaucauaaacccgacggcauuugcacaaauaguggaguuggucugcugcuuccucccuuaaauccuagugcuucucuuccuuacucauauguguucuuuguggcauuuuuccccagaauagagcacuuucuucugcauuagaaaccuguucauaagagauaugcuuucuccucgaugauuuucuuaaauuugucugggaacucgucugcugcuacuugguuggcagaaacugcuucucuugucuugacauuuuuaagucaagccucuuucuaaaauuaccaaaccauccuuugcuggcauuaaauucuccagcuuuagaucauucaccuuccuuuugcuuuaaauugucauauaaugacaacuuuuucuugaauuauauuagaaucuauagguaugcuuuucuuauagcaauccugcacccauauaaaagcugcauuuucaauaugacagaaaaggguaauuugcaaaaagugcgggguuuucauaccuguuggcguaacuguagugacaacuucauaaauuuucuuuucuuuuuuuuaaaucauucuuaugcuguguucaugccuuugguacugaacucaugaaaaagugggcaaccucagccgcagaccuuaaucuaugguacauaugaaacaauucaacuuuuuguuguaauguaacuuuucucagcuucuugggagcacuugcagcaucacuagugcugcuucauaugggacccaugguguuauuccagguuuauagcauugcacuaaauaugaugaaaaauacgugagaacuguaagagaucacuuuuuacugugauacacaauuuacuggaaagaugaacugcucacucagagaugauuagcaucacaggguagauagucccagcacuugagcucacucacaauagcaacacaagguggcuacaaaauuauuacaguugcacaguagguauuauaguuaauuuuaugcaguuauuauuuaauacggcaucuuuacauuuguuuacacuucucuugacugcaaaugguaccgugugcauucuaaguucuuuuguaagguuugauacauuuuaacuuuuuauaauggauuuauauauauuuuaugguaguaaaugauaaaacagacuaguaccuacauauauuuuaugcaucaugacauaccuucaucuuaauuuuuugauauuucugggggacucauucuuuaugugauuuuuuuuuucaaauuguuacacaucucuaaaaaauguuccaauauauuuuuuggaaaaaaaugcacauauaaguggaccugcacaguuuaaagcuguguucuucaagggucaacauuacauugaagucugauauauaaaacauauuuaaaaauucaaaagaaugaaucagauuuugugauggacacaauuauggcaaguggagggcagaccuaggaaauuaaaaauauuggugucauugugaugaaauaaaaggauaacaauaguauacauuuauuucucuaaaaaaauuuuaccaagugccuuugaggcacaaauguucauuugaugguaaugguauuuugaagauugcuaagacuuauguuuauaucucuaucuuauuucugaggaaacugauacuaaaauuaaagcaaaaguguuuugccagugaguacaacaguaguagagcuggaacuaacugggaucuaugcuuucuaauuaagcugauuaaaauuuacucaaucaaagagauuuaaggagauugaugguuacagccuagcaugcuauccaucuuucauuccaggcuuuaaccuagaacacucugcuauuaauuauccugaguauuagauuuacauguaagauuucuuuugaaagucuuucaaaacaucauuuuauucucuuacauacccuuuucucguugaaaauuauauuggucacucugaauacaaagaguauuucuguuaugacacugaugauuugaauacagaaaucacuugcuugaacagcuaugacugauaaguaacuaagaaaacuugggaaccucagugaaccugguaaccuaagucaacuaagguuugagacuuuaagaguugucaaugggauuauuaucuuggcucugcaagugggccguggguuggaagccacugcuuagacagaaaccuguuacuuugugggcugcuucaaagagauugagggcuuugaaauagggagauaucaaguccaucucucuauuguuuaaagcaaauguaaagcagauguauagcagccgcuaagauacaucugcuauauaguaaauuaaaagagggcauggagauguguagcuacccagaguaccacugagucacuaucuuuuaauuaucggccugcccaaauacuuugcaagugaauguaguucaggcaagccagaauauaagacggaaauggguuaggaugagauuagcaccuccaggagccuagagggaaaaaugccuuaucuaguccaguggaaaaauaccuggggcuucacauccuacaaucagacaguguucagguuuuaugagaaacugagguuucuagaaaauccgaaaauaguugucaauuuaugucuaucuccacagacacacacaauuauauuauauuauauauauuuguauauuauauauauaguauugguauauauuaagauuacauauuaaacauuuucuuuaaccuaaauuuuuaguuaaucauaagaauaacuaaaaauuggccgggcgcgguggcucacgccuguaaucccagcacuuugggaggccgagacgggcggaucacgaggucaggagaucgagaccaucuuggcuaacacggugaaaccccguuucuacuaaaaauacaaaaaauuagccggacguguuggcgggcgccuguagucccagcuacuugggaggcugaggcaggagaauggcaugaacccgggaggcggagcuugcagugagccgagaucgcgccaccgcacuccagccugggagacacagcgagacuccgucucaaaaaaaaaaaaaaagaguaacuaaaaauuaaaaagaaauguuuuaaagaaauuaaaacguuuuuggggcccuagagaguauuagagaguauuaugggcccuuggcacugugccuaauggguaauuuagcccugucuaucucuaagcauuuguuugaaugagaauaucuaguaucuagaacaauugagaaacucauccuuggcaaaaauacgcuuuauuuguggaacuauucauuucauguaaauguuuuaaauuuuuaaaaaacuuucuuuuauuuacuuugucauuuaaaucuguuguaguuuggggacagauagguuuccacagucuuuaaauauagcuagaaagaccuuuauauucuguugguuguguggcagugagaucagacuaacuucaaaaauugggaaaugagaauucagaucauuugagauuuucugaauuuucuauucuuuuuauuuugacuugaauaaaaauaagcaaaguaaggguuaugaaggacagcaugguagcagaguauugcugauauuuugcuuguucaugaaaaaggaaaaguaugggaagaaagacuuuauaaaauaaauuuuaaacguuuuuacuuaacuucagaaacucuacaaaacuugugauauugugaauacuuucaaaguguuccaucaucauuauaagaucuuaaaguucugagauauucuaucaaaauuauuuagcgcuaccuauucauucaacucaagcugauaaauuauacaaguuggggauggggagaaaagaggagaaauagaaauugaaagagugagagagaauaagaacaguuuaaaguaaugugugcaagagcuuuugcuacuugccuugauguaaugccuugauguaauaccuugaugcuggauugauucuucugccauaaacagugauaaaacugaacaaaauauaugaggcaacuuuucacauguuggacaacagacagugcaagacugugauuauugagagaaggcagauacauaaaaagagccccacauuugcucugcauuucugccuagggacauuuuccugacuauguaacaaggacuuggaguccaagcagaaacaguggcaccucugagcugagaaggcagagaccagaaucuaggccuguugaagcagcuggaaucuggagcggggcaccagaagggugaaggcugcacagaaauggggauccagaauucugaauauggguucccuucaagucauggcugagugaugaacugcacauauggcaagucaaacugugggcuuaccagagaguuccugcuauggaucugagaaugaaaagauaugguacagguuucugguagauguuggagcugugucccaaguuuaauucugccaaaagagaggagcuugagaaacaccuugggauuuucucaaauucauccuaacaaaacauaaacaaauucaggguguuuagacaguaauuauacugccugagaacaaagauuaccauucuucagaggaucauagcagaauccauguucucugcauuguauuauuuauauaguaacaauauauauuuauauauuguauuauuauauaacaauauauauuuauauauuguauuauuauauaacaauauauauuuauauauuguauuauuauauaacaauauauauuuauauauauuguauuauuauauaauaacaauauauauuuauauauaguauuauguaauacaauauauauuuauauauuguauuauuauguaauacaauauauauuuauauauaguauuauauaauaaaauauauauauaguauuauauauauauuuuauuuauauauuauauuguauuauauauuuauuauauaguauaguauauaauaaguuacugcacgugcaaaagaaaaaggaaaaguaugaccaauagucaaaauaaagucaauagcaguagaccuugagauggccuaguuguugaguuuagcugaaaaaggcucauguaugcauaccaauaaaaggacuuaaacaaacaaauuguggucuuaaugaguaaacggguuagaaaucuuggcagagaaauggaaacuacuaguguucuauaccagugguccccaaccuuuuuggcaccagggaccgguuuuauggaagacaauuuuaacauggacuaggggguggaggaaugauucaaauacauuacauuuauugugugcuuuauuucuaugauuauuacauuguaauauauaaugaaauaauuaucuacucaucauaauguagaaucagugggagcccugaguuuguuucccuccagcuagacagucccaucugggggugacaggagacagugacagaucaucaggcauuagauucucauaagaaacaugcaaccuagaucccucgcaugggcaguucacaacaggguuugcauuccuaugagaaucgaaugcugccgcugcucugacaggaggcagagcucaggcaguaaugugggcaauggggaguggcuguaaauagagaugaagcuucacuggcucaccugcugcucaccuccugcucaccucuugcucaccuccugcuguguggucuguuuccuaacaguccauggacugguaccuggguggguuccacagacaguugagggguuggggacccuuguucuauaccacuguaggaugacuauaguuaucaauuauuuauaguuucagauagccagaagaaggguauuggauguuuguaauacaaaaaaaaaaaaaagauagguauuugagaugauggauaugcuaauuacacugacccgaucaucauacauuauauguauugaaacaucacuguguaccucaugaauacgucaguuaaaaaaaucacucauuuauaaacauagauggaauuaugacugaauuuuucaguuaaaugagccaauaaacugucuuuugugcuuaaaaguaaaaacagaaacguuguucauaaacaugguauaaaaguuguaaauaaaauauaaguaaauccaaucguauaguauauuuaaaaaagaucauuauuccaaaauaauugaaugauggguuuuuuugguuuguuuuaauaaauucuacuguguaugaaaagcuaagugaaaauucaagaacugaaaagaacaauaacuaauuaaaaauuuguuuuacgaucuccaacaugcuauuaagaaauaucauucaacuugaugcauaucagugaaauuuauucaaucugauuaacuuagaagaaaauuaaagaaaaaugaacagagauucagggaccuaagguacaauaccucauggucuaguauauguauaauugcaauuacagaggugaagagcaugaaaauggggaaugaaaaguauuuaagaaauaauuguugaaaauuuuccauuuuugauuaagaauacauugacuuauacauccaguaaguucaguaaaccccaagcaguaugaauauacuauaaugugccacauuaaacagcugaaauaucuaaucguuauuucaggggguucuauguguuccacauuauucaggaagaagcagcuaacuuuguuucacauggggaacgauaugguacagagaagauagggcuauuuuauacauuuuaaaauguugaaucauaagguuuugcugaaucugugggucuauuuaaaacuaaagaacaauguuuuucaaaucauaaaaguaaugcaggcucauuggagaaaauacaugaccauacagauauauaaaauuuaccucugaucacaaggccuuugacacuuuuauccuaccacauuucuaguuuguuuguuuuugccacguaguagggaaucauuaaacaaaaacaaauuuucuuuucuuuucugagacacggucucauuguguugccaggcuggcgggcaguggugugugaucauggcucacucaaccucugccuccuggacuuaacgcaucuucccacuuuagccucccaaguagcugggaccacagaugugggccaccaugccuggcuaaguuuuaaaauuuuuagauuuuuuguagagacaggguuuugccuguugcccaggcuggucuugaacuccugagcucaagugaucuaccugccuugcucucccaaagugcugggauuacagguaugaaccacugugccuggccaacaaaaaaucauuucuuauuaaggcauccuacucucuaaaacaagcccuaaacucucaucgccacuugaaguuuuuaucuugagacuaguauuauucuuuuugugagaaaaucucaggaugugaauucgaucuauauguauuauauauguauaauuuuagagauauaccaauuauagaugaaaaauuauggaauugcagagcaugaaaauagcuuguauuugccauuucuguauuauaaaaacugaauacauaguuucuuuuuuaauuauuaagacagucaauuaugggccgggcgcgguggcucacgccuguaaucccagcacuuugggaggccgaggcgggcggagcacgaggucaggagaucgagaccaucccggcuaacacggugaagccccgucucuacuaaaaauacaaaaauuauccgggcgcgguggcgggcgccuguagucccagcuacucgggaggcugaggcaggagaauggcgugaacccgggaggcggagcuugcagugagucgagaucgcgccacugcacuccagccugggcgacagagcgagacuccgucucaaaaaaaaaaaaaaaaaaaaaaaaaaaaaaagucaauuauguaauuacagugacucuacuguugcuauucccaaaugugggaagaugaugcccuacugaacauuuuucacagacaucucuggguauuuaaauuuuuuucucauugaggugauauuuggacaaaaugaaauugaagugauuuuguaccugaaguucaccagggacagccuccuaguucuucuucuuuuuuuuuugagaaggagucucccucugucgcccaggcuggaguguaguggcgcgaucucagcucacugcaagcuccaccucccggguucacgucauucuccugccucagccucccgaguagcugggacuacaggcaccugccaccacgcccggcuaauuuuuuguauuuuuaguacagacgggguuucaccauguuagccgggauggucucgaucuccugaccuugugguccccccgccucggccucccagagugcugggauuacaggcgugagccaccgcgccuggccuucuuguuuuaaauauauucuaagauuuuguucuuuuuaaaaauuaccuuaagauauauauauauauauauauauauauauauauaugaaaauauauaauacauaaaaugaaauauacccuuuuaaaaaauguugaguugaguuuuuaaaauuuauaucuauguaaccaccaccauaaucaaguuguagaacauuuuuauacuucccgaagcucccuuguacccauccccagccccaggcaaacacugaucugcugaucuacuuucugucucucuagaugagauuucuguuuucuagaauuucacauaaauggauuaauaaagcauuauguacucuugugucugguuucuuuugcucagcccaauguugagacucacucaugugcuauguguaugaauagcauaugaauaguucuuuuuauuccagaguaguauuucauuuuaggaguauacuacaguuuguccauucaccucuugauguauauuugguuuucaguuuuagcuauuaugaacaaaguuucuaugaaucuuuguaagucuuuguuuagacaaaugucuucauuuuuguuagaucaauacuuaggaguggaauauugggucauaugguuacuauauguuugacuucagaagcaccuuucaaagugcuuccugaagugguuguaccguuugaaaacauuccuuccuucacagagagcuccaguugcucuguaucuacucauuguuuuaaaguugaauagaauucucagcauauguuuggauaguguuaaauugauauuaaggaagaagccuguagucaucaggaaucugcauuuagucggacuaaacaguaggauaguucuacaauaaggaaauaacuuauuuuuugucuuuuaucuucccaagguugucaguuuucacauagaucuuuauuuucuugacaaaaguacuauuuuuauagagguuuuuaauuauuuuuuuaaauauagcuccauugucacaguccagauaggcaauccuacuguaauuauauagaaauuacauuucugaaauacauuucuccuucugaauccauuuauuuuuauaaaaccuccugaaccccagugucuuauauauagcagauaucuuacauaguacagguguucagucagugcacauuuuuugaauaccauauuuucucuugauuauauauauuauuuaccauucaagcuaguagcuaaauuggacaaaacuguaaaauaauaagccugacuuauuuuggagucuucuuaacuggcauauugaaugauucaaguuguugaauuugaucuguaaaucacuuaaaagaucuuugauucccaguagcaucaaagguagaaaagaguugcuucuaauaaggcagaaggguuucuccuuugcuuugucuaacaauucaaaauaaucuuguaagguugggcagaucuaccccaugccaggguggaauagccacaguguuucuguguuugacuuuaggucaucucuucucuuuuaaaauacacacacaugugaacuuccaccauuaccaccaccauuaccaacaacagcaacacaaagcccaaguuuguuucagggucaguuugggaauguagaacauagccauuguugacucuggagucagcccugcugggcugaaacaagacuaguuuucauuuugggugagugggauaauguucauugcuauuugugccaggaagauuuagcugaagaguuuucacgugagguaaaucccauggguucaguuuuguucuccagccucuugucauacuaguaauuuuuagggcugcuccugccuucccuuagguaccuuuucuacucugaagaacaaaucaggucuccuuauccaaaugccuccuuagauuuuuuuuuuuuuuagaagagucacuuacaacacuaucaugauccccaggaaaauauagaagagcacagucucuggcuucagaguuccuaucaauuccugucagcagaacuguauauccuguuguuggaaugaaauugccugcuagaguaauuuugugauaggcucucuuaggugccauugcauuaggaauagaagaccagaggggcagagagaaagaaaauauauuagaggugaugugaguggaagccagcauucgucuaugagggcuuacuuuccauaugugaucugugucacacagcaacucuaccuacaaagacaauaaacgagcuccaugcuuugauuuguccaucuguaaacagaguaauacuaccugugucaucagguuaaugggauaaccaaaugaauucauauaggucaaggacuugcaaugcugagaguuuucaucuucugcuauucuguacaacaauaaggacuagauagaguauuugcuuuaaaaaugcacgcaccuucugucauauauuuuuacaaaauagacuagaagauguuaaccaggguuauuucuauggaguuggauguuugguaauuuaaauguuccuuuuuucuuuaauaaaguuuauuuuacuguaaauuuuagaugaaaggaggauauucagcucuuuacaaguaaugcugccuaacaguugcauuuaaucaauagggguuucuucuccauugcuuuuguuagcuuucuccacuugguuuugaccggcuccucaagacuuuguaagcuuugaguucagaacguacuguaaaccuuuaacaagaugaucugaguaguucuuuagagguucauuaauaucuuauuuugcuguugauuguggcuuagauaguuauucucaguguuuguucuggcucagucacugaauguggccauccugcaggggacaagucacuccagagccucaggagauacuguauugauuauuuguugccuucuuguuuuuuuuuuuuuuuuuggcacauaguagaaauauuuaucucugagaguccacagauuucauuacuccuuaggcuaguuucuguuguagccacagaacuuuacagaugagaaagauccauauuugcugguuucagauuugacccaaggauaucuuugguugugcagaucaggaucuaagggauuuaaauggacagaaugcuuucugacaucuuggaucaucugaagaaaagaaccaggaaugaauggagguaaggaaguaaaggaaagaacaguagugaugaaugaaggcaguuauggaaggauacagggguuuauagaaauaauuccugacuuugcuguggaaccugccucuuaaaauuuacuccucuucuuuuaucuaugugggauacggugaugcagcugaaagacucuaaaaucuacaguuaguuugggggaagauagaagucaaguuacugcuuacuuaaaaugaccuuagacaagucucuuaaccuuuuucaguuucuucaugugcaaaauacaguuauuaauaaaaaauaucuauacuaccucuuaaaagggcuguugugggguucaaauaaaauaauguauguaaaaauauuuuguaaauaguaaagcuguagcuaaguauuugauggugauauuuaugacugcaauuggucuucacaacuacuguagcuuucuuauguugcucugggcuucuguguucacauuucagcuguccucuguguaggggcauuugguuucaugaaccguagaauguccuguuaguacucagccuguguaugagugcuuuccuggccuugaucauucucccaaguggugaaagcugcugacuggugugcuucagugcaaaaaucuggaagaaggcagcacacauggugagagcuuuaauguacgcuggcucacugaaggauggucggaggcugggaggcaguucugaggaacaaguggugcugcgggccccgacguucuuucugccacauuuagcuagucucccuccugugccuucacgugcgacgaugacaaacugccuuacaauuuugagugcgguaggaggaggagaaaaagcugauugauuucucacaugcagagguuguguuggaauuuuacgguuugccuuccaugugagccaguucugcaucugcagauucaaccaauuauggauugaaaauauuugagugugaaaaacaauaaaaaauuauuaaacauucuacauauaacaaaguuucauauguaccccaugcauauguacaaauauaauuaauaaaaaaugaaaaauacaguguaacaacuauuuacauagaauuuacagaauuuuauaugagggacuagagcauccauggaucuuuguauccucaggggauccuggaagcaauacccugcagauaccaacggagaacugcagguuguuaaagguacaguaaauuuaaucaugcacuuaguucucagaagaguacagcaggauaaguugauacuuuacagacuuauuugguauuuuauuaccauauugauucagguucaugcucauuuggcccagguaagaaggguuugccucagugucaaaaagacagagcauggauuacaaauagcaguuuuuauuaaaauaugguauuuuuaagauacuuaguaaaaaauauacuuguuuuaucuuauucugucaaacauauaagagacccaugagauuauuuuaauuaaagaaaaaauaaaaacuuguccuuuugauacuuggaagauauuauaaaguauaauuauaucaauuugguauucuuuacaauuugauaguacagcaucuauuuuugugcuuuugguaauguaugcaguguugaaagcaucgaaguugcgcaaaauaaaaaaaaugugaacuguguuccacauauauguuguuguuuuuuuaaaccaaauggaaauuguuccagugcuauacugcugaauguuacccuuuagccauuuaaaacaaauucauaaauacauguuuuauccuucaaaauuaaaauuaagauauucaaaucuauaaauucugguugaauggagcauauaauaagaaauaggugaaggcagcaggacaacauuaauacguaacuuuucuaucaucucaugugauauuauuaaauguauugguuaauccaaaaacacuccauguaauacauaaguuuccacuggaucaugucucuugcuuugaaaagagauugccccagcuuuguuuuaacauuggcauucaaauaacuugaauaauuugucuuuuuaaaaauaugaauucuaagcaacuuauuuuucuaugaugauauccuauuuuaauugauguuaccuaauuuaaaacguuuaaauuagugauuugauuaauaagcuucaaguauuuggccgggcacagaggcucacaccuguaaucccagcacuuugggaggccaaggcagacggaucgccugaagucaggaguucgagaccagccuggccaacuuggugaaaccccgucucuacuaaaaacgcaaaaauuagcugggcaugguggugggugccuguaauccuagcuacuugggaggcugagguaggagaauugcuugaacccaggagcuggagguugcagugaucugagauggugccacuguacuccagccugggugacagagcaagacuccaucuccaaaaaaaaacaaaaacaaaaaagcuucaaguauuuauaaaucaaugcuauguaauaauguuuaccauuuauugagcucuuaccaugcaucaggcacuguuguaagcccacagaaagcaguaacuuguugaaucuuuauaaucacucuaaggcgguaagaacuauuuauaccauuuuauagucuauucuuauuuuacaguugagaaacuaaggcauugcuacuuaaguaacuugcccaauaucauggcuacucaacugugguaaagcuagauuaugaauuuaagcaauguggauagagaauucagcacuccuauucauugugcuaugugaaauauagaaaauuuacaaauaaagcacagaaugcucacauuaaucagauaaaggccaacaaauaugcauaucuauuuuguagaaucuauaucugcuuuuauuaggugaaaauaggcauuuaaagaacucagauauuuauauagugucacuacuggccaagacugcucauuuaaaaacacuugcuauuauaaaccuuauuaagcaaaucauauguucuucccggaacuguuuuuuaugugaauuuugugaguuuacaaauuuuagaaggauuucuagaauucuuccuguucuaguauuuuaugaauuuaugauccccuuuccuuuaauccuaauucugaaauuguucacuuguaaaacuguugauuuguuuagucauuuaauucuuuuucuuuuguucuucacccaaauuuauugaggggguucugcaucucacagaugauaguauguguucauuuucuucaguucaaaauacuucuguuuuaauucuuugacccauggguuaguuagaaauguauuauucaguuuccaaauauuugauuugcuuuuuauuuuuguuacugauuuuuaacuuaauucuuuugugaucauacaaauuacuuuguaagauuugaguccuuuaaaauucauugagauuuguuugugaucagguauggucugucuucuuaaauguuuuguguguacuugagaaggguauauauucuguuuuuggguagaauguucuauaaaugucaguuugcacaaauugauagaugcuguucaaauuuuuuuauaucuuuacuacuuguuauaucauuaaaagggguauaaaauauccaucaauaauacugcauuuuauuauuucuuuuucagaucaacuagguuucguuuuauguauauuggaguucugacaauagguacauaaacauuuaggauuguuauauucucuugaugaauaggcaggcuccuuuaucauuaugaaaugacuccucuuauuccugguaauauuucuugcuuugaaauuuccuuugauauuaauauagcauuauauauauuuuauaucauuuuaauuuuaaucuaucugugucauauuuaaagugcauuucuuguagaaagcauuuuguuugucuuuguuuuuuauaagguuugacaaucucugucucuucauugguguguuuaaauuuuauuuaaugugauuauuaauacgguuggauuuaaaucuacuguguugccauuuauuuuuuguuucuucugucuauucuuugguuccuuuuuccuguuuucuugccuugucuuggauuaauugaauaauuuuuaugauuccauuuuauguuguuaauugacuuauugcucuacuucuuuauguuuuacucuuucagugguuacuaaaugguuuaacguaugcugcuucaacuuaucacaguguaccuucaaauaaugugccacuucauguauaggguaagaaaagccagugauucucaacagcaccagggacaaugggauagaggaccauacuggaaucauauuggguguacauaugggaacuuugagaauuucucacuucagaugcccuucuauuggcuuuuuuucccccuaauaagaauacugauaacauccuuucuuuuucuggaugagaacacugaggaucaguuuaaaguggcuuuaguaaauggcagaaacaggcccaacauagcauaauguaaugaauacccgucuuuaggucaguuacaccuggauuugaacucuaguaaucuuguuugcuagauaugugaucuuggacaaguuauuuaaccaguauaauguucaugcuaaaauauggagaauaaucaccuuacagggcuguugucccaugugcucauacaacacuuuauuucuaucuugauugucaaaauuaacugggauaguauuuauaaagcaccuaguuaaauugcuuggcaggacuucaaauauacuugucauguaaagauucuggaaguaauuggcugacucccaaguaagugcucuuauuuuacuuacacaguaaauuaucucugcagacuuuaaucagucauuuacaccuugaaacauguugugcacauguuagagaagcaaugauuaauauaacugaaguuacuaugagcagguaugauaauuaaaccaaauagguucagaguuugaagagaucuagguagugaauaaaacuucaggaaggcuaguggcugggacauucaggaacauugccgccaccuucuaggaauugauagagagauugaggggucagcacugauguggugugagagggaauauaaucuugggucucauuguguugcaaagaggcaguucauauuauagaauuagaauuuagguaaaugagaaggauuuggagcaagagacuagaaagucaugauauacaagugaaaguugaaguugcaaaauauuucagggagacuguguacagagaagaacagagaaggcaaaggguguaucuuaggggauuaguccuuguugaggagagaagaaagaagagauagccaaggaaguuaaugcuuuccucuucuugggaucuuucccagcaucuaacagcagcaaccugccuucaguaauggaauacuuuauugaauuuauaguggaugugggucuuguuaguuuuauucuuaaauagaucuggaacuauuauuguguauauuaaaaaugcuaaucauuggccaggugugguggaaaaugguacugguuggcuagccaggguggcucacgccucuaaucucugcacuuugggagacugaggcaagaggauugcuugagcccaagaguuagaggcugcagugaaucaugauugcaccacugcacccuagccugggcaacagagcaagaucccaacucuuauauauauauauaugaguauguauauauauauauauaugaguauguguauauauauauaaguauauauauauaagaauauauauaguauauagauaagaguauauauauaaguauauauauauacuuauauaugaguauauauauaagaauauauauauacuuauauaugaguauauauauaaguauauauauaaaaguaaauauauaaguauauauaugaguauauauaaguauauauaugaguauauauaaguguauauaugaauauauacacacacauauauguguauauauauacacacauaugaguauauauguguguauauauacucauauauauacuuauauauacucauauauauacauauauacucauauauacuuauauauacucauauauacauauauacucauauauacauauauacucauauauacucauauauacauauauacucauauauacauauauacucauauauacucauauauacauauauacucauauauacauauauacucauauauacucauauauacauauauacucauauauacauauauacucauauauacauauauauacucauauauauauacacucguauauugcaguagauacuacuagcauauauauauauaccacauugcaguagauaccacuagcauauauauauacacacucauauauauacacacacacacauauauauauacucuuauauauguauauacacauauauauauguuagugguauuuacugcagugugcccuuuugguaggacagcaaauaugucuuuggaucuuucaacuaguaugaauaaugaaagcuaacucuauuguguuuuuaauuucucacugauuuugcaagauaaugacuuuacucuuaagauugacauucucauaacuguugaauauuucaaauauggaacacaaauuuuguuucuuuuaacuuggaaauacagaaaacauuaaaaguauuguaagcagacuggaauauggcaggagcauagccuuuacagucagauguaguuccauguguguccuaguuuugucuuuugccaauguugagcucuuaggaaaaguauuugaucuuucuggaacucagugucccauuucaauaaaguacucaaccaacacacacauaauuuucacacaagguuguugugaaaauuaaaguauuaaguuuauuagcagauaugugguagguguucaauaaauagcagcuuuuaaaauuuuuaauuggauguaacagaggagguaaagaugaaagaagacaaucuugauuuauugggagaauuucuaaguaccaaacacuagccuuaccauucuucauguuaucuagguggagaguauaauuuuuuucuuuuccugauuuauuacuuaguauucauccucccacacugggauauuauucaaaaaagcauaaaggguuuuucacuugcagccuuacuaagaguugucaagagaacugcuacacugcagaacuuagcuuauauuugcuccaacugucucuacucaaaagguguuaaagcaaugaacuguuagggugaauuucacauucaggaagcauuuguuccuugucuucagagcaaggagaaagaaacagggaugaauucuuuaaagaaacugugucuaggaucugcaguaguuuuagauauuuuucuuuauugagguuuuuguauugucuuguuaaguuaaacugaaacaugaaaagagcauaaucuaaauacuaaaggugggccauuuaaaaauaaaauaaaaguguucacuucuuagcaacuuaaacaaaucauaagcuauaguaugauguuccuaaaauauuaaacucccauaugaaaauaguuugauuguauauccuugagaaggaacauaaauuaccuaaauuaugaauuguuuauuaagucuuauaguauuucauaaaacaauuuaucaaguaaauugaaugcacugaaagaguucuacuugguauacauuacaguaugcuuuaacaaguauuuuaauauuuucuuaggaagaugcugauguuucuauuugggaaauuuggauuaaaagcugggacuaguauccuuaggagaauagguuguaacugaaaaaaaaaaaucgaucuugcuauaaaaugacaauuuuguaaaaauuucuguuuauuucucaaggagagagguuuuuugguuuuuccuguuaaauugagaaaauuuucuauauuaaaggcugugcuuuaaccaauuaaagaagugugauuuuuagacucaauauaaaacauauuagaaucuuauuuucugaaguaacccuguucucuauaguuauugauuuuuauucagcucacauuaaauaauaaacagguuuucaacauuggugguagcuuuauuaauauucaauuuggaagaaacaugaauuuaccaguagaauugccagcaucaauaauuuuuaaaaguaagaaauuugcaguuuuuuucuggucauucaaagcuaguuauaaguuucccuuucuuucuaagaauaacuguaacagaauugguaugcuuaaaaaguggacagaauccuauuauuuuaagccaggugauagcuuuuacugcaaccauguugcaucuccugaaacuacccuaagcuucaggaaaugccagcuucacccuuugcaccuuucuuuuauaaacuuuuacuaacauauuuaccuuaggaagaugauauuuuuguuuagagcccucucaagaagaaaaaaauaacuaaaugaauuaauauaucuuuauuaaaugguuugaagccuuucuuuuacuucucuauagauaauuacuauuuauuuacuugaaacgaaaauagcauuaucuuugagucaacuuaagagcucaauucuauaauucauaacauuccuuauaaaauggugugguagagcuucauuauggauauucaaacagaucauggcacuaaccaugacucaaggucaccuugauggccuguccaaccuuagagucugugagcuuacauuucucugaacauagauaaaguaaaguaauacaacaugauuaguguugaccuuuaguggucuuauuaugaaguaguucuacuguacuuuggaaaguacaagccaggaauacucaaaucagauacugaucugauuucacaguaagcuuuguuuugagacacugaauauuuuggccauguggcuuacgucuaaguacugaaaauagcuuagcuguuauuuuugaugcccauaauguuuaaaauggugugaauauaagauccuauggauaauguuacgaguaguuguccagaugugugaaaauaauuucaaagaagaaaaugauacaauuaagcugcacuccugacucagcuuauauauguagaguauuuuggaggggcuguuguguagccaguguuugacuauggggcugacuagguccguauaauuggagguggaggaaagguagagaagggaacaagaggccugcgcaguggcucacaccuguaaucccagcacuuugggaggccgaggcaggaggaucacuuuagguccagaguucuagaccagccuggccaacauggugaaauccccucucuacuaaaaaaaaaaaacacacacacacaaaaauuagcuggauguggugucacacaccuauaaucccagcuacucgggaggcuggggugggaggaucacuugaacccaggaggcggaggcuucccgggcugaaacccugucucuacuaaaaauacaaaaauuagccagucugguggcgggugccuguaaucccagcuacuugggagaauuccuugaaccugggagguggagguugcagugagccgagaucaugccacugcacuucagccuuggcaacagaaugagacccugucucaaaaaauaaauaaauaaauaaaaaagaggagagaaaggagcaagggagaaagggggaaagaaagacacagagcgaggaagauggacuggguugcucuccuacauuuaaaaaaauuccauugcugucuuaauugaaaaagaauuuauguauucauuguugaguaaaccuuauaaggaaagggaauauaauuuucauaugcaaauaaccuuuccguuuuauuuagaaaacaccguccuuauaaauuugguuugugagaaaaguggcuccauggaucaugagaaguaaucagcucauauuuguguguaauuuugaauauaauauguaaauauuagcuaacucuuaugguacaacaagaauaucauuuccuucauaagcaagauuacauagaaaauaccauuuuugagucaguuauacugggagguguuugcuucuaccuugcuuuaauauauuacagaaauacugcuuuuauguaaauuaggcauggguaacuuaugagcuaguaaaaaccaauaguaugcaucagaugauuaaagaaaucaagcggcgugguugguuucagaguuacauuuguacaaagcaguuuuuaaaucuuuuuaaaagaaugcaugaacauaauauguaaagagguaauuggaaaacauuuuagcguagauaaauaguacauguuguggaaagcuuguaaaccugccaucuaaaacugauuacccuuacgagcauuucaugcuguuugacagugaaaagugcaccuuguaaaagcuguuacacaaaccauuacauugaaaagguuuccaucucacaccccaaaauuacacuuauuugcugcaagugaaaauucagaauuuguucccuguuuauuuugguugcauuuacuguuguguugaauuuugcuuuuucccucuuccaggaaaacuagaaauuagucuuuuugguuuauuuauuucaguauaaauagagucaguuuguauauuauaaguggcauccagagaugauguaauaauaaaauucugagccugagacacucagaaacucuguauaauaauaaaauacugagcauggaacaccaagauacucuauguaaaguauuuugguagauagagaaaaacaaguuggcaagaugguucagaauuccuauagaauauaaagugcugugaaccauuuuaguugauagcgccacacacacacacacacacacacacacacacacacacacacacacacaguuuaucucacuugaaaucguguuaaacacccugaaacagagccuuacucaugugagaaagagacuuggaaacgucuaagagaagcucuuauuuuaagauugcauucuccauguuauaugaguauuucuuuccuuguguaguaagcacuuugcgcgucugucaggccuugcuaccucugagugccuuccuccuuucuucuccuauuaaccauagccuauuagaaagagcuuuugacugggaauugggagucuugaguucuaauacuagaucuuauacuaauggauccauuugguugauuuuucucaguuucucugugaaaugggagccugcacuggaugaucugaauacuuuuaagcuuuaaagggcugugauuuugggaagcaggccaauuaucugaaaaccgauuacuccuucaccaaaagaaaauuuacugggugaucaauucacugaauagauaguuuuuuuaaaaucaguuugcugaaacauaaauuugcugaauggccauuuuguuaaauuuaccaaauacucugauuuaucauuuugucuaaugaccaguuuucuaaauugucaacugccugaacuguguuuguauuaacuacauacaaaguuuaucacaaaugaugcugcauagaauagcugcaaaaguuuuugaaauuuuuagugggaaguaauuauuaaguuuuaauuugauuuuaauuuuuccauugcaauuucaacccugauauuucgcaguagaauuauuuaacagucuaacgcagcugaaugccaauuuuaucauugauauuucaaauacugaaugcuuuuuaguuacuuaaaacggaagcaacauguucauccaauucaauugguuaacaagugugugaauuaagggaaguauacaauguacuuaaguggauagaaaauguguuaaaagaaagaaaucuucuauaccaucauuuauacacuuuuuggcauucaaaacauuuauaacacuuugauuuaaaguaaauagauucugauccccaaaaguuguuggccuagaagauagcaaaaugacagaauauuacauggguaggccacagugcuggauuacaacaguauuuacuuucacguaaauuaaaagcuugaaccaucaacuuaaauaucggagaauucuuaaaagauucuuugaaacuauuuuauucaguacaaguagcuguuaacaauauaaaugguuaaaagaaacaaguuuugacugaauggguaauuugucaaauuggccauuuggcaaaauaaguuuauuuuuggcaaaguagaccuaguuuuaucguacccgaucaccaucucugccagggacggggaaaaagaggcaguaguggaagacuacuacuguauuuggaguuagaacacuuuuuccucggucacacccuauaagccaaguuggagccauuuggaaggucuucucccucuguguuuauuugcgugugcaugugugauguacuguguguucaacuuaaguuucgauaccaaagaccuguugucuguguguguggccaugugugcgugcgugugugugugugugugugugugagagagagagagagagagacagagacagagauaacucuuacagcacagacuuuuugaaauagugaaguaguacaauaaaaaggccugggugagacuugaaaaauuucuuuuugcuuuccucugcuugaccgauccuuguaacaaaguauguucuauauaagcauuugacugaaacaacaaaaugaaaagaucaagguauaugcugaauuacuuggcaugcaccaaggaaggauggcccugugcucaagcaggaauagagauguugguuguacugcaggguuaccuaugggauugcuauggggcuuuauuacccugaacagugucuuuggccuauacagccuuccuuaaagcucuacuucucaguuauugcccuugauugcagugccauuaggaaggagaguuaaauaccauuuucuugccauugcugaaugcaauuugugaucaaauguaaaggucagggagcaacaaccccuggcaccugugccagaggcucacugaaacaagcucauuggugaaugaacgaauugagauugccccuucuuuuggcgucuugagaagcugcaggcagucauuccuacuccuuuagaagugggcguuaugguguguaccugagagcucaacucugagauuucagaaagaaaagauucugaaaucacuguggcacauugauuuuuaacauuuucugagcccuaauucaaauuccaacaagccuaucuguauugaugcuucagcagagguaguguagaaacucugaauauuccaugauucaaucauuuuuauuagucuuagcugagaucuacagaauagacagucagcuugucagguacucugcauugcuggaaaugaaauuaagauauuuuuuagaggaugaucuaucacggaaaacuauuaacuggauuaaaaaauuauagcauaucuaauucccauaauauagaagaaugaaaacagaaaagacucuagacaggacuacauaauaguugguguguuaaacaucuaaauuguugucauauuauuagccuaauacugcauauggcuagguuaaaaaaacaaugaaacaacauguugcuccuugacuuaguaggugauauagcauauucaaguucucacucugccuauuucuaguuauaugaaguuauaugaccuuggugcugauggaauuauuuaaguucuaucaauuauuaaauaauuaaauauuuaauuauuuaaguuaugccucaguuuucucauccauaauaaaugggauaauaauaguaccuacaucaggauuucuguacagaugaaauaauguaugugaaguccuuacauaaauguguuaacuaauuaguaacuagaggcuucuuagaauaccuuuuuuugguagaaaguuucaaugauuauuaagagaacauagaagaauaucaguugaauguuaccaagcucaaauaaauuucaagugguuaauuaacgaugaagucagaacaauuacuauuaggcuaauuacuuauucuuagcauuucagcuaugaaaauuaacgauaucugagugcuucugucucauaaaaacaaaggaagcauaccaggccacuuauucuaagaugacaugauuagagcauuggaucugaauccacaauucagcgaaucagauguacuuauuaaaacacaguaaaugauaugucagaagguucagagcaauagcugaagacuugauucguucauuugaguuuacuuaauccuuaucuuguuucuuuauuuuaaaaaacuauacacaaaaucuuuugagucuuuuaauucuuugaauaugggaguuguuauaaaauuccauuguaauagaaauugaacaugaagucacauuagaaaauuaagaaaaaacacaauaauuugauuaaaaaugucuguaauauacaauuauauuuauguagaauuuuaaaaaauuguguagaauaugccucuggugcagcauauucuaauaguaauguuucaauagggucuuaaacucaucuucuuuggagauuguucuuucaacaaaucaaagauucuguguauauauugggcacuguggcuacauauguaagugaaaaagauaaggauaguccaugcauucauggaguuuauagucuuguuggagagacaguuacacuauagaugugauaauugcuguguacugaguaaagauaguaugcuauaggaauaccaggaggacacuagauucggacuuguuaagagcaagauggaaaagcagugguuguuugggaagcuaucacgggaaaguaggauuucuccugagaccugaaagacaaagugaagauuagaggagguaagaaggaaaaauuguuucaagcagaagaaacugccuguucaaauguccccaggguuggccgagucaguggcucaugucuguaaucccaggauuuugggaggcugaggcagguggaucacuugaguccaggacuuugagacuagggugggcaacauggugaaacccugucucuacaaaaaaaauccaaaaaauuagcugucaggcgugguggcaugugcacauggucccagcuacuaaggaggcugagaugggaggaucaccagggacugggagguugaggcugcagagugagccaaguuugugccacugcacugcagccugggcaacagagugagaccuugucucaaaaaaaaacaaaacaagacaaaaaaccaaaugccccagguuuggggaacuguggguaguuccauaaggcuggauuguauauaaacuuggggagacaguaggcaggagcuauauucuaaagagccuccuaagccuuguuaaguaaggguuugcaguuuauccugagggcacugagaaccuauuauagguaguggccugaacucuagggaucuguguggcgagauauagauauguggguguauuuuugagauauaauuaggaagcagacucaguaauuuauuaaauuuggaagaugagagaaaaaaagaaaucuggcucuuacuuuuagcuucuuugagaaaaaaggaugccaagaugacuggaucccaagauuaccacuuuuaucuuaugccgucaguagaauuugaauucauugagggcagacuguguauuccccaaggcauguaacagcaguuauuggcagaaaguuuaauagaaaagaugaaaaucuaaauugaauuuugaugauuucaugugaacagguggacuuguaaugaugauagucuauuuaaagagauucaauggguaguuaaaaaucuagaacuguagcucaauagaaggaaggauuauugacuagaguuacagauuugggaauuauucacauauggauaauaguuauuaguggcuaaacucuuuaaaacagaguuuuaaaaacagaguguuguugagagagcagaaaaacaccccagcucaacucuuuuuuguuuguuuguuuguuuugguuuuuuuuucuguucaaagggacgcaauuaaacuucugaggcaaacagaaagauuggccagacagguaggaagaaaaccggaaaaaaugaaugucuuggaaggcaaggaggaagcuuuuugauaaaagagauugucauuaauuucaaguguaauuugauaguacaaugagugugaaaaauaagaaaaggucauagaauuugcagauuaaaagauuguuccuuagugacuuuggaaaaguugaucuucucuuggagggauguggcagaaacuaaauaacaaagugucagcaguugaguagaaugggcagaaaugaagacagugacuguagauaacucuucugaacaaguuugguggugaaagaagugauugggauguuacacuuaauguauuaucaaggaaaaagaagaguuuuuuuccccauuuuagucuccaucgaagaccaccaaaguuugagagagaugacaaugaaacuuauuacaugaaauuucacacuuaucuaaaauauuauauaaugacaacuauauuuuuguaaggaauuuacaguugauuuugagcauuauaauaaaccuaguuaaggauauuaacuaaagauuuaugagauagccuaggauaaccaacuuuagauaauauagcuauauaguaaggagauuuuaaaggaauuauuguuucuggaggcaagaaaaugcuucauaccaaauuggaaggacagccauccauggagugcaucaccaguucccauagauaaguaccaguggaacuguuuguaauucaguauagaugacuuauuugaaauuuuacugauuuuuacagagaaauaauuuuucuguuaaguauccgaauuuacaguauuggcuauagucuuuaaucuguuuacauuuuucuccuuuggccaagucuuuauuccaaguguauauacauauacauauaaugaaaaucaauguaaaaauuuaauagcauuauguuuuacagcaaguguuuucagaauuuauguguauaugaauauauagagguuuuuuugagguccaccuacacccauguucacuacauuugccagaauggcaguaaugagaauucaguucuuuaagauauuguacauuuaaaaugggguauauuguuucuauuauuagcaauguuauuauacaguauuauuuuccucuuuuagauguguugaucucuuugagucugucauuagaauaguuaggaacugcaaaagacucuauucugcacuuuuauuaaaagaaaaagagaugagagaaaaaaauucuuguguaggcaagauaaucuagaggaacacugucauuggagucuuuucugaugugaagaaaauuaagaauuucuguucuggcugucacucccuguaaaaucuaaaggaaacucuguuuggugcaguacuaccugcucguuucuuuuguggcucuguaaauaaugcugccuuuuaagccaaucuuugccucccuuugcuccuguccuguaugucuuuccagcaguuuggcuucaguguuaagggauuguuuuauuuuaguuuuugguaauuaguccuuuaagauaaaaauuacaguaauuucauuucuuucuuuaaguaauaguuuuucauaaucuauucugagucaaggaaagaauuaguuaagagaacaccuuugaaaagugaaaaaaguuacucagccaaccuguauauguuaccagugugcugauuaaucaucuucagcauuaaucacugucaucaguuaucacaggaagaugacugcugaacagucuacacuauuaucauuccuucauuuuucuacagaucaauuuaguacaaagauuuauuguacacagucaugaggauuacaacaucaaaccuaaauaaagaggcagcguuuuuauaauacagaaaaucaugacuuuuuuuacauuccucauuuacuugauuuauugauuugauaaagcccuguguuuuacaaugaauaaauuuuucacaaagauguguuuuaaauaaagaaagguugguguuugacaacaguuuauagcuuaacuaguuuuuucauuuguacugggugaaggcggaagaaagccaaguguuuuauauucguaggugaagcaaucagcucaauauauuuuuugucagaguuuuaagaaauuaaauuuaguaccugacuauuuaaacauauauuuaaauguaguacgugacuaaacauauguuuaaaauacauauauauguguaacauauauaugcauuaauaauuucuacuaugccccaucauuguacaucgucuuucuagaagaugccuaauguccuuagguguuuuuuuguuguuguuagaguuaucuuaauauuguucauuaucuacuccagaauagcuggaauuguguacauuuuguacuaaauuuauguuaaaugucaguaauuuccuccccaaaagcacugcucauuuuaguugucuuaauuuuaauagaaaucuuaauugcuauagacacuauauaugcuacuauuauuuuccagcauuuauuuaggaaugcugaugcugaaugagagcauuaguaauaaaaguauuaaauauaaauauauauaaauauaaaugcugcagaacuucaauuacaauaauuuugguucuauguuuuaaaaauaguaauuuucaccugcaaaacauuuauuuuuuucuguaaauggcauuucugugaucuuauguugaaucagguuucuaaugcucuuguaaauaaguuauucuugaauauggucacauuuuagaugucguuuauuuuuacuauacccauuaaguaacuaucauaauaauuuugguuaauucgguucaaguaggaauuggaacuagcaccuuuugucuuucuaugcuaaggauaaaggaaggaaauucucuguugagcuugaaaauuaaauuacaggucuuuguuuucuguacugaauuuaaaccuguuacauuccucaguguuaaaaauaauacaguaaguguaguggaaccaaacuuugcagacuuuggucuuuaggagagcaaauuauuucaggaugaaagaccccaauaaaaauuagguggauacuaccuauuuuuaagcuagcccaguaacauaguucuguuugauaaguaauugauuaggucagacuauuaauccauuuaaucuggcauguacauugugagugauaaaaggaauccaacugugaauuugaguguauuaaauaaucuucaggaaguuccacaaaaaacauuugaaugccuuaaaacuugcaauaaugcauguuuguuccaaacacauuugcuuugccuagguuuuacccaucagguugaagaaaugcuaaucuuguuccauucagcaucuggguuuuugcaauaucuuuuccuucucguagggguuaauuagccuucuuucaaaauguggccuauuuagcuguagauucgcaugauucagccagagcuggcuguacaaagaagaaccguuaacaggcggguguguccaacugcuuaauuagccagaauaaaaagguccuuugucaaacaagcaucuguugcucaugacacaccugacagacacauuaggcgaggaugacuagacugaaauugugcaugucucuccuguaagaauauacaacucauuuacauaugggcugcaucauugacaaacugcagggguuuauuuagcuuaucaaaauggauuaaugugacggcauuugugacugauaaacaaauaucacuugaaagaaggcugugaaggaacuaaacuaaccaaauuacucccaaacauaaacaaaacaccagaaaccacugcuggaugaaugggaacaccucaaauauacucauaagcuauuaugcugggaguaaaacaaaaccuaaaauggagcaugcuagggcacugcucucaugugaugauccuuacuuugcagaaauguuggaagccuaccagaauacuaugaaugugucagugggcuuaaaugaucuguuuagcaaaauuuggcgggaggguuauauuccucaaacaugcuuuaacauucuaauuaaucugcuguuuuuaucaggucuucagaauuaaucacuaaaaaugccucuggaaaaauacguauuaguuggguuuuauggucucuguugaaagagaagaaauacuuccuaacuuuggugucagagagaggggaugucuuucuguuguuguuggaaguguaaaucauguaauaucgauugagaaccccaaagauugcugucuagaccaacagucucuagcuuuucuuuggaagcccuaucaucaugauauugcaaagcaguguauguacugguugacaucaugugcuuuagagucagacagacaucaagugaauucaggcuuuuucucuuacuaguuguguggcuuuuggcaaguuauuuaauccauuugugccucaguuucuuuauuuguuaaauggggauaacaccuccaucaggggguucuucugaagauugaacuagaaaauguauuuaaagcacuuaguguagugccuggcaccaggaaaaaacuauuacaugagaggccaaauuaugaacuuuucaguuaaucuguggaagggauaugauugauacccucuaaugucauaaagcuuggcaaagagagccucucugucaaggcugaagauaguaaaaucagaggaaaaugaaauugugucuaugaaggaaaauggagacacaaaagagagacuaaguuuuuaucaacuggcaugacccuauauuccaagagccaaguagaucagaccuaugagcaguaauuugggaauaaacagaacauauacuaggacuugguugauacuugaugggauacuugguugugcaggacuaggcuuuauguaacaguuuggaugugguuuauagguacagcuggaggcuugauggaaaguucuccgugacucucuagcuuuauguuuuacaaccauuguuuuuuaccuaucuuauuuccccuacucuauucuauaagauuccuccuauuaaguaguugacaacuuuuucuuuucuuccugucucauucuaaaaauucaucaguuugccuuucuuacuugucuuugugcagcgucuguauggccuucgguaagugauguaacaucucugggccucaguuaacucaucuuuaaaauaaggaaaaucauaguuuuaaucuagugauacaucuauugauaaaaucacuaguuuuaaucuagugauacauuucuagcaguaaaauggucuaaacuuggguauuacuuuucuguguaaaauuaauauaaaugucaucaauauuguuucaaacccaaaaagcaauuuucuuuuuuuuuuuuuugagacggagucuugcucugucauccaggcuggagugcaguggaaugaucuuggcucaccgcaaccucugccucccagguucaagugacucuccugcugcagccuccugaguagcugggauuacaggcaugcaccaccaugccuggcuaauuuuuguauuuuaguagaggcgggguuucaccauguuguucaggcuggucucaaacuccugaccucgagaucugccccacuuggccucccaaagugcugggauuacaagcgugagccacugcccccggcccccucaaaaagcaauuuucuacuucaaucuuuauauguagaaauagauuucugauuacccucaaaagagucacaaacucaaaugccuauagaggccauucaauugaaaagaguauaaccauuuaaauaauuugccuauagaacacauaauaugugcucaccucuuuaaaauuuucagauguuucaagaaauucuggaaauuuguuucuuuuuuguuuuuuguuuugagacggaguuuuggucuugucgcccaggcuggagugcaaugaugagaucucagcucacugcaaccucugccucccaaguucaagggauucuccugucucagccuccauaguagcugggauuacaggugcccaccaccaugaccagcugauuuuuuuuuuuuuuuuuuuuuaagcagagacaggguuucaccguauuguccaggguggucuugaacuccugaccucaggugauucacccaccuuggccucccaaaguguugggauuacaggcaugaaccacugugcccggccuggaaauuuguuuuuuaguucaaaguuuucugauuuuuaaauguuagcaauuaagaauuuuguaaucacucugagucaaacaaaacccgaguggggagucaaauguaguccauagaaggccaauuuccaaaucuaugccuuuuaucuucugauaugcucucccagguggcuuauugggaguuguuaagaauuacuuuaaagguaguuuuaauuuuuuuuuuuuuuuuuuuuuuuuuuuauuauacucuaaguuuuaggguacaugugcacauugugcagguuaguuacauauguauacaugguaguuuuaauuuuuaaagagaacuuuuuucuuuacauucuugcauguguuugaucuaaaacaguugaugucaaagugugggucauagaccaaaaaaaguauguagaguagucuguaauacaauguaugugcaaacaaguuagacucuggaacauucccauccagcucugggggaaauaggaggcagauuuagugcgagugacaucauuguaagaaacucaucuacucuuaguugaacagcuuaaaggagaagcuauaacuggcaacgcugucuuccucaucuguacacuaaacugacagaggccaccagccaucuuggaguugacaagagaggcugaaaaagaccucacagaagaugauaucuaaugucugguucauuccuuauucuuugcagaaaagcauugccucacucuuacuaauaguuccucugcuauagcacaaauggcauauaaauguguaauaaaucaaaggacccuggcuuuugcuuucuuuuuuagggauuuuuuuuuuuuguuuccugucugugguagaagaaagaggaagaggcacagacuggguucuuaauuuguguauucucuccccaaauuuugagaacuauugguccucuaguaauacucguuaggcaagaauuuuguguaguaaaaaauagugucauucucaaacauuuuuggucauuucuguggucuuaaugcugguucaaagauuguguguguguguguguuuggagaucaguacuacauuuaaauaaaccaccauuugugagauuucacauaaaaaucuggacuuucaguuucuuucggaaaauggaaggaaguuucccacauacucacaauaugcuggagcugagcauuagcuaacccaucuaggaguauuagccacugaauugaucacuuuccauuuauuuuguaaaccccuagccacuucugcucucugugccugagguuccucauuuguaaaugcagauuauagucauaccaacugcauugaguuguuacauggauucauuuuuaaauuaauaaauauaucaagcacuuaaaagaauucuuagcguguguugaacaaucagugcuaguuguuacugcuauaccuuuugcauguacaagguuuauugugcugcuuuagggguuucacuaacaaaagaaugagaaaauaauccccuaaaaagaugccaaugucaaaguguagaaagaaaauuaagcacagagucaaagugaaaaagcccagucccaagucuacuccugucaccuugaacaagucucuuaaucucucuggguuuuagguuccucguuuacaaaauaagaagaauagaugcauugucuucagagguccguuucugaaauugaauaugauugaagguuuugggggaaaauuagaagaagucaugcugugacaacagaugccaagagggguuaauuuucuccuugaaaaacugaauacucuuucaaaaauuucuuaguuaaaaauuaauguucacuguauuucauauagauuuaaacuaugaugcagugcuuuucuuaugcuaccaauuaaacacuguuucucuugcuccauuccuccaggaaagaaaacuagaaaucuggucuuugcucaauagcaaggaaauucauauuucuuuuauugaaugcauaaguaguaaaaggggaugucaaggccaggaagccggagaaagcauaccuguuagaguaaacaauggcaggucaggcaaaacugagaaacguggcauguuuaauugugaaugagagaaaguacaugucuuuguuuacaaaucucauuuacaugauaguagucucccucaucuuucaacuguauuaaauguuauggauuuggggcuaucuuuguauaagacuauaaucgaauuuugauuuuaguaccauauuauaccauacacaaaauuaguuaacuugauucuuuggcuaaguuuagggcauaucaguuggcuuuuggauauacguuaauuguuuuagaucaccaaauaguaaguuuuaaaguuggaaaggaccuuagaaaugauuuacucuauuuaugcagccaaaagacacaugaaaaaaugcucaucaucacuggcgaucagagaaaugcaaaucaaaaccacaaugagauaccaucucacaccaguuagaauggcaaucauuaaaaagucaggaaacagcaggugcuggagaggauguggagaaauaggaacacuuuuacacuguugaugggaccauaaacuaguucaaccauuguggaagucaguguggcgauuccucagggaucuagaacuagaaauaccauuugacccagccaucccguuacuggguauauacccaaaggauuauaagucaugcugcuauaaagacacacgaacacauauguuuacugcggcacuauucacaacagcaaagacucggaaccaagccaaauguccaacaaugauagacuggauuaagaaaauguggcacauauacaccauggaauacuaugcagccauaaaaaaugaugaguuaauguccuuuguagggacacggaugaagcuggaaaccaucauucucagcaaacuauugcaaggacaaaaaaccaaacaccgcauguucucacucauaggugggaauugaacaaugagaacacauggacacaggaaggagaacaucacacaucggggccuguugugggguggaggggaggggggaggcauagcauuaggagauauaccuaauguuaaaugacgaguuaauggguauagcacaccaacauggcacacguauacauauguaacuaaccugcacauugugcacauguacccuaaaacaaaguauaaaaaaaaaaaagaaaugauuuacucuaaauuauauucuggugacauccugacagccuauaaaagugucaagaaaguagaauucaugacacuuacauccagguaggguuuguguucugagaauuaagaacauuuugauauaauuuuggaugauaguuuauaaagggauuuaaacaauuuauaacaaaugagauagaagguagcuuucaaugaaauuuaaccuggauagucucaggauaagaggugcuaaugggaauuuuuuuaaagaauguggauuaguaauuauuuauaaaguggucagaaugaccauacacaugcacggacugucaugguaguauguugggauaagagguaugagaguugaaaguuaguuucaguauaggauuuuaagaacaauuguaaggaagcuagucaugcaggagugacauuuuaaacuuuaauuucauuuuaaucuauuucagagaccaucaugcagacaucagagacugggucggacacaggcucgacagugaccuuacaaacaucuguggcuagucaagcagcagugccuacgcaggugguacagcaaguaccaguacaacaacagguaaggagcugcugcucuuagaaaagaugcuguuacuuucauuauguuggcuguccaacauaccuguauccaaaaauuauuugaacuuuacugucuugcuaugauaggcauacuucaguuuuuagguucauucagcaaauguuucuugagcauuucuuggaugugccagguucuuucugugcuaggcuauagggauacaaaaaugaauacucaaguuauaaucuguauucucaaacagccugucuugacuccuaaagcaaguuauuuuuucugauaugaccacucaaaguuuucuccuucucuucucuccucauuguuuaucacaacuuucuauuucuuucauauugaaaugucagcaauauuauacuuuauuuaguuggcucacaguaguacuuaauaggaugcaugcaccuuccaggcagggauuuugccuuugugguauuuuagaaagugccuuugcauuaggugguugauaaauacuguugaaugaaaauagaauaaucuucaaggucuggagaucugacucaagcuauuuaaaaaguugggagugaauucaucaucagauauuuacuacaggucuuauucauacgcagggcaguuggcuuguuuggaaagauacugacaaaguaaugcuguucauguauguggauugugaacacacuggccugugauuucuucuaaagaguggugagaacauaagugagaaagaucauaugucauauaacauuaucuugagauucaagauuugccuauaauuucuuaguauuaaagagacucuuuagcaaacguugcucuuacaauuauaaauaagugguuagggagaaggauauagauggguuauagaugaugaaggacauuuuuauaauugauagaugcaagguuauauucuuuacaggauauagaauuggguugggcagggggugugcugcaaucguacagaagucauuggcuuuuaggauaaguaaagacaucugagauaaucgucuuguguuuguuuuguuuuguuuuuugagacgggagucucgcugucucccaggcugcagugcaguggcaucaucucggcucaccgcaagcucugccucccggguucacaccauucuccugccucagccuccagaauagcugggacuacaggugccugccaccacgccuggcuaauuuuuuguauuuuuaguagagacgggguuucaccauguuagccaggauggucucgaucuccugaccucgugauccgcccaccucgaccucccaaagugcugggauuacaggcaugagcuacugugcccggccauuuuguguuuauuuuuuaaacauuuuuaaaaaaaucuuagcauacucugccauauacacauauacaacuuucccaucccucaagcuaccaguuuauuagauugaacuauauauaguuuugaucuacaaaaaguguuacauguuucaaucuauugcuuauguuccuuuuauuucuuuuaagcauauucucucuuuuuuagaauuguagauccagagcauacauaugcagguuugcuuuauggcuaaauuacauaauggugggguuugggcuucuaggguacccauuacccaaauagugaacauuguacccaauagguaauuuuucaacacuuauccccuucccacccucucuccuuuuagaguccccaguaucucuuauugucaucuuuauguucauguguaccaauuguuuagcgcccacuuuauugguuauguuuuuaucuuuuuauauauauuuuuuaaccauuaaaaaugaaucuucacaauggugauuuaaaaggcucuguuauuauuaaugccaucaccaauuuuaagacucugaaccuuauugagaaagggauagcuuuugucaugucaucugaagagcaaguaaagaacaauucagacauuguuauaacuaacuuuaaaaagauaacaguuaucuuuuuaaaggcaauguugaacauuuaacucacucugguuuucaucucuguagaagaaugguuuugagagagugccuaucacuaacaagagugugauggaaauaguguuccuaucucuggaaggugccuucuguaaacaugaaaaaaaaguuuucuuuuuauugaauuuacauauuaucaaauauuuacaccaggucuuaauaggguauauaauaguauaaagacucaaaaaacuuagcaaggucuguuauuuuaaaaaaauggccuuuaaccucccccauucucccacaaaccacuccucauaggcaacuacauugaccucuuuaaaccuguuauucugauauuuaccuccauuuauuuaaauauaguauacuuauuuuacugcaccuugauuuuuuaguuuuaagcauuuuaaacauuaccuuagcaugcccuucuuuuggucccuaacacaacacacacacacccuggcccacccacccgcccacccacccuuccugucccuuauguucuugacagauugaaccauauguguuuuuuuagguacaaaaacaauaauuucaugucucaaccuauaaguuauauuuuaauuucaguaaauucaguaaauucagugcuuauauuaccaugauauauaaaugcuuuucaaauccagccuuguaguaaacagugauuaccuuccuuuccuguaaaacucauuuauuuuucuuagauuuaaugacuguguuucuucuaguuugcaggauugccauggacaagccaaacaccaaucugauuucugaucuuuuuuaugugguuuaugugauuuuuuuuucucugaaacuuuguagaauauuugaaauuccaguuuuaugaacuuuaugaugaugugcauugaugcaggccuauuuucaaauacuguacuagaaacuucaugggccauuucagucuggacauucaugcuuuuucauuucugggaaacuuuauucaguuuuuucauuuaugauuaccucccccucuguuuucuuguuuuuuucacuuuccggacuuuuuuuguucuauuuucaauuucauuguucaggccuuauauuauuuuuaauuucuaucacuuuuuuuuuaauuuucaggaauuuuuaaaaaauuccuauguguuccuuuucguaauaucauguuuuaauucaugguuuucuuuuaccuuucugaagauauuaauuuuuuuuuaacuuguugaaauuuuuuuucucuuuacauagucuguuucuuuuaagguacucuguucuguuuuguuuuguuuuuuacuaugucucugucuuucauguuaaaagcuuuucucugaugucugacaaucuguggguguuuauccauauuuuaaaauguggauauaagacgcugauuugaaugcaugagugagucuuguugacuucaaaauggggucaucugacugacaaggcuuuuuaauuaagaacccucugauguucaguaucuuuguuugcccucuuuggcuggucaauuuuuuuaagaagacuuguccaacuuccugccuagugggggaaugcuuggcugccugggagcugaguuggggaaagaguuggguauuuauugcacgaauuuaauuaaucuuucucuuuuuucaugugguauuacccaugcuugguauuccucaaugaagagauuaagccaaagaacaaaccuccaaacauuuuacuaaaguuagggaaagccaguuaccuuacugcguagggguugguagagggaaccugauugcuucuuaaguagaaucacauuuuauauuaaauacauauauuaaaaacaaaaauuggauugcugucagaaguggaaaaucagugucacuagccauaaauagaagauuauacauacacacccucaccacccccaacacuucauucuugaccucauaaaaaauaaucuuguguacaccuggaccacacuuuggaaaaaacauuguacugugccauauggcucacucccaacaggcauauuuuucauuuccucaaguuagcuuuuucuucugggacauucaaggcaggugauaccuuauauuccuuuacaccgagcaaagaaggugagaacacucauuuucuuuuugucaacaaaguguuuuauuucacgcaguuuuuuguugugauauuugccuggagacccuuguuauguuguccucccagacuuauuuagaagcauguuuuucuucuuugucguuauuuuucuuuuuuuuucuuaaguagaauagugucauguuugaagcuccccaguauauuccagugguguccccguggauauaaauugucuauaacugauaagauucaugcuauaauuccuauuccucugacaugccuauaauguuugaauuguuaaugugcugcuauuaucuuggguuugcaaacuauaguaaaaugccuuuaaaaguuuccagcuuuuguuacugacccauaauggauauagaaaucaugauauugaugucaaagguaguuacuucuguugauucaacuuuucauuguaacuuugcuuuguugauuuugacauaaagagaaaguuuauagcuaauuuuuaaaauuuugaggcauucaauauuauauauagguuggugcaaaaguaauugcgguuuuugccauuaauuuaauuuuugcaccaaccuaauauacuagaaugaugaguguauuaguccauuuucaugcuaguaauaaagacauacaugagacuggguaauuuauacaggaaaaagcauuuaagggacuuacaguucauguggcuggggaggccucacaaucauggcagaaggcaagggggaacaagucaugucuuacacggguggcagcagguaaagagagagagcuugugcagggaaacucccauuuuuaaaaccaucagaucucauaagaauuacugacuaucacgagaccagcacagaaaagaccugcccucaugagucaguugccucccaccggguuccucccacaacaaugugggaauugugggaauuacaauucaagaugaggcuuggguggggacauagcaauuccccacaaguuugcuccaguucccaacaaguuucucaucuccaucugagaccacuucagccuggauuucauaguccguaucauuaucaccauuuuggucaaagccauucaacaagucucuagggaguuccaaacuuucucacaauuuucugacuucuucugaguucuccgaacuguuccaaccucugccuguuauccaguucacuucuacauuuuuggguaucuuuuacacuuugacauuuugggguaucuuuucaacagugccccacuuuacugguaccaauuuacuguaccaccccaacaugauucaaucaccuaccacaggguugcucccaagacaugugggaauugugggaguuauaauucaagaugaaauuugggugaggacacaggcaaaccauaucaaugagaaaccagaaaauuucaggauugcaguauuauacacuucuucuguuucuucaaagccauaaggcuucuaauuucaccguguaguaaguaccgaauaaaacaauucuaaaauuguuuuuaugauuuuuuguuuauuuuauaugaccucaaguauccauuugucacacuuucuuagacaauaugguucagggauagagaauucugaacaaagaauagcaagaucuuacuauguacagggcgaauauuacuuaccugaaaugccugggaacagaaguacuuuugcuuuggaacuuuuuucaguuugugguauauuugcauauacauaaugagagaucuugggggugggacccagcauuaaacaugaaauauauguuuuuuuauauauaccuuauacacauagccugaaggugaguuuauacaauauuuuaaguaauuuugugcaggcuauuacuugaggucggguguggaauuuucuucuuguggugucauacuggcacucaaaaaguuuagaauuuuggagcauuucagcauuuggauuuucagauuagggauacucaaucugaaaugcuauaugaaauuuccugucuuuucaugaucucacaaaacaucauagagucuuauuuccaaauauagacauuguugcccaauucaauaaaauugauaaaaauaucuaaguaucuugauuagaaacucaaauuuugauauuacccauccuaucaucuuuauaaagacuuuuuggaccaaugggucucuauagaauaugacuagaaauggauugcuccuucuccucauccuucauccuugaaugauuugguaaagaguuucuuguagauuauucuuuguuuuucauuuuaugccucaaccuaggaggucgucuaaccccugcuuguccuagaacugaguuaaacauccaggagaaagacaaaggaaaaugucuuccuacuauuccauggccagccagauuaguuuucuuuucaagguagaacuuugacagaagucagaacuuucauucuuuauuauaaucuugggcuccagguauuccacaaauacugcuaacauugaggauaauuucuaagccaucuugaccauggcucuaagauuuuuuuccucccuuuuaaguuuuucaguuuuaacugccuuugcaacuguaguccuccucucuacuaucucugucugucuuaccucuuucuuggagaagagcacaaaucuuuuucucucaaaaugaguaaauguauugucucuauauuguuucuucuaaauguaacacaugagguauaguggagcccugggguucagggacuucuauugaguucaaagcaagauuuucuuuuuuucaaagaagcuuucaauuuugcugaaauuuuuuuaugauuagaaauuguagucuuuaccuuuuccugcuaagggacucagagaguuuguuucugguagauuuuugguuuguaauugggauauuugaaaccccuuuguaugccauaaaagcuccuuucaagacuauauucaggaaagaacauuuguuuuuuucuauaaauugccuagauagacuagagaaggacacuuuguucauaaucugagucauuaaaaggaauagaauagcuaguuggcuauauugguuucuuuuugguuaguaucagccuaucacacauuuagccuuuccacauaaaauaugguauauccugcaaacugagcauauuauccuuguggucaaaaagauaaaagacauuuucuuuggggaacaaaucuaaccagaguuguaaauuagguugcaggagaagggcaaucuucaaguaagguaagauuuaaaugaauagucuccauuagaucucuuuauuuuggguaucuacaaaaugaucuguuaaucuuuaggaaauagauuuuaguaauuuaaguguaauaugaauacuucuuagauccucacauuucuuagaccguaguuucaauacugggucauuuccaucuucacuucuguuugccauauucugaguaguaugucguuacaaccaguaagaaacccugauaauuagaauuauaccgaugauaaaguuuauugucauuaaagcaaucaguagugauuuuuaaaaauugccuauaguuuguuaaauucauaauagaguauucuguuggaucaaauuuugaucaaaaguaucuuaaaugaauuuguuaguuuggggagcuaugcccaagauagugcacuccaucauucuugucuuuaucuuucuuuucuguucagggucaagagguuugcuuucugugaauccuagcauugauggacaugaauagaauucuuuucauuugagaccauuauuucauauaaucagcugaaacaaaggcauuuuucuccgguuugcucuuacuugggacuugauucccauuggcuugguucccugaggggggacaguguucucauaauuaagacuguggcagacauccugaaagauugaguuauauuuuaaaaugaauuccaaaugaaugucuuuuugaaaaaaaaaaagacaaugauuuuagcucuuggagagauuuauuuuuagaaccagaacugcaaaauauugguauccaguauaaagaaguaagguguuuuggaggaccaugcugauuuacaauggaaauaagucuugcugugccaauccaauauuaaggcccuuuuguugaccaucucuacugaauaguuaaaaaaugagagcucuacuauuuaaguaguugaguaauaguaugcuuugauucucuauuaaguaauuaaaaaaauuuuuuuuuauccagaguuagaucauugugaucaguucuagauaccauguucuaagaggaaugugccaggcacuauguuaaaugcugggguuucuaagaaaauuugacaugguauuugauggguaggaagccagcuuuugaagaaaauacaaguuugauggaauuugauacaaagugcuuaggagcaaagauggaagauugucuuugggagugagggucaauaaugugacaccaaagaugugacccuugagcugcaugcugaaggaaaaguuggaauucacaagaaaaacaaacuggaagaggguaucucugguaaaggaaagcaugaaagauuucaagugaaauaaggcaaucugugaaggugacuggggagaggaaccugggaagugagggauauggaacaguguugcacaagagccucuuugcagaagguugaaucagaugacucauuugugauaccuucauauguguccccucccuagcauuuucauuuucuuccuacucaguugacuuauuucauuagguauuccccgacugccaauuuuccugauaagagacauauguacuugucuacuacauuuccuuuuuguauguucaguucuuaauccuaugaaauuuggauucuccccauccaacuugaaacugugcacuucuggacaagcuaaauccaacauuauuuucuaggaucuuucuggauuuuucuuugacacuugauacuauugacuauuaucucuuuuuucuuccguggcuucugggcuuccucuuguauuucuuugaggacuacuucauaaagggaagcagauuuuguggaaauugagugggcuuuauuguuggaaggcauaaauucaaauccuggcucuaguccuuucuacuuauaugacugggcaacuuauuggcuuuuucugaaacucaguuuucucuucuauaaaauaauuguaacaaugucuugcucauuuauagcuaaaaauauuaaauaauacuucugcuaaaauauuuagguuaguaccugauuauaauaagccuuuaauauguuuauuauuuuuuacuauuauuauuuucauuguuauuauuaauaguaguaauaguaguagaauucaugaucuucuaaaaaaaaauuuggaguuuuuaaacuccuuuucuuguaacauuggcuuuuggccacuuucucuuuguucucacuuucaaguaacuuauccucuguagcuauuuuagaaaccagugcugcuuucauuuucuuuacuagucaagaacuuuuguuccuccuuccuuguauuggacuggauuaugagucagggaggcucagacucuagaucagaaccaacaccaacuuccucugaucugcagagguggugguggugucuuucacuuugaauaggcacccaguguagucaucagucguuugaaaaaaugccagacaauuucucaauaaagauaccuccaucauuuuaucuaccucauaaaauauaauaguuuuggaucaaguguggcauugugauaggauauaagacuuuaggaaauuaggguggaaauaauauauuauuaucuuagaugaccuuauuggaauuugaguuucuaguuagaaaaggcuuaaacuauuccuuuagugcaacuauucccaaggacgucccagaguugaauugcaaggaguuuucuuuucuuuucuuuucuuuucuuuuuuuuuuuuuuuuuaagacaggcuggagugcaauggugcaaucuuggcucacugcaaccucugccuccuggguucaagugauucuccugccucagccucuugaguagcugggauuacaggcgcacacugccaugccaagcuaaauuuuguacuuuuaguagagacgggguuucaccauguuggccaggcuagucuugaacucaccuuaggugaucuacccgucucagccuccgaaaguucucagauuauaggugugagccacugcacccggccaagaguuuucuucuucaacagaucacuuacuguauaagacuauguauagacuuacuuuaguugauuccauaguuuuguucuuagagacauacaauuucuuuccuauuaauaucuaauuugccuaucaaacuaucaauuuuagcauuaguucuuuuuuugcugggaaaauucaauguguccuauaaaauguuuuacaugaguagaaaauagaaaacuuuaggauaacuggcaccuguacuuacauauaauuugaacaguuugcaacauaauuuaaacagagcaccuacccuuuugccauagcaaauuagaagaauuauuuaugugugcuaaaaauacacccucauucuaauagaucucaauguauagcugagucuguuugucaucagugugucaaagaaagguaaacuuuaagguccaaaucaaaauugucauuuauaguaugagcuggucaaggaaguuuccccagagggacugacuuuuaagcuaagauuugaggaauagagguaacagugagggaauaaaaggaaguguuuauucagggaagugaguguaugaagaccuggcacgagagaggagcugguggguuuguggaguugaaacagagucuauauggcugggggagagcgugggaagggugugguaagaguugaaguaggguguuagguggcaccuggacaggugucuugguaucuugagcuuaugaauaauauuucagucugcacuauaagcuauuuaaguuuucaauaauagcuaucauuuugaauuuaccuaccauuuuacuucugucagaaguccaguucaaacaauggaucauaguaauagaagcuacaaucuacugagcaucuuauuaugugucccuaugcuuaaugcauggcucauuauuucucaagcuuaaaacaacccugcaagguaguugguauuaucugccuuuuaugggcgaggaaacugggccuaaaggaauuuaaauaacuuguuuuugauaauagccacuuggucuugacagccugugcuuguauuugagaaguauacgccaggacaguaauuauaaaaugaauguaugugagcuugauguuacauugcuuucaggaguggggcacauauuaucuguuuagcaaaugauucuuuuuuucaaaggcucuuucaugaaaccaguaaauacuggccaguaguaaaugcucaauauguauuggaggaauacacuaaauaaugcaaacaugagguauucuguagugucauuguguauguggagaggaaaggacuugggccuugcucacuuaguuuccugcugccccugauagcagcucuuuacaugccuuuguggaaccucuagggauuuauggaacacaguuugagaaucaucuuuucuccuggauacuucuguagccaaaugaaucggucaucaaaaaauuucaagcucuguaucaaacugaaccacuauaucagaggguuaauuuaauggaacacuuacuuuucugucccugaaaaauaauuauuguaccuuuuuuuaaauccagggcugauuuuagaaauagauacacaaguuaugccuuuuuauuuucuuugaaaauguguguugaaaguuuuacauaucuucuagaauuuaucagguuuuccgcuuaccagaaacccccauccccaugcagaacacucugucccugccugaaacaaaauaaaacaaaacaaaacuuguguugacaucagucaaaccauuucugaaaagacucugaugguucauuuuccuuacagcccuugugaacugauaggcuuucuauuuaaagcaaacuggagccacucucuuuguccuggcugcguaguaacucagugcuaagucuuaagucuaauauuuuaacuaauauaccuugcuuuagccauuuuuuuuuuuuggccaagagucauucucaagucaucugacuucaugagcucuuaagcucuacuuccagagauaaagcagucagaugaauuaaacaagauaaacugugaagugcuauaagcccucugacagcuguacuaaacauggcaaccccaugguaaagaacauaauuuacuuuaugucaagaaggauuaauuuuagcucuaccaaucacuaugcauuaucaagaaaugucacaagcaaaaguaguaaagcaaagaagagcacccaggauauaaaggacuauuugagcaaaauaacuagcaaauuuaaaaaagugauccuugaaccuccuaugcccuaccuaaacucagacucuaaguaugaacaucaauaaauauagaaccuuaaaaaaagagggaaaaaugauaaaauccauguaguaaaauauuagcaucuggguaaucugcggaaaggaauauuuuguauaauucuugcaauuuuucuaggaaucugaaguuguauuaaaagaagaacauuuuaaaauaaauaacuuugccaaucugaaauaaguucaaaaagugauaauaugagcuacuaauaaauuauagucaauagccauagguauuuauuuaguguuuuaucuuuaaacaaauaagaacugaaacuuugccauauauauucuaagcaauaagagcucuucaaaaaaauauccaguuuaaaccacuuuauagucaccuagagaaauauauagcgaaaaauaaauuuugagguuuugccuaauuuucucuacauuuccuaucaacucuuguccugaaaauuacuaucaagaaaauaaauuuguuugaaaaacacauaaaacagauguuaauuaagaauuacagguacucuaaaggacuauuuuuaaaacagguguguauaaggaauuggugguacaauuggacuacuuuacaaaccucauugcuagaaaauacaaacuaaaugauucucaagaaaaagacaaaagcauuaaaaauuagaaaucagguacuaaacuaaaaaauuauaguuagccaguuucuggcuuugcuuuuuguuuuaauuaguaggauauauauccuaguagacugaaggcccucaguuuccaccccaaucucuaagaaaagcuagaauaauuaaaucaauugaucaguauuuuuuuaaaaaaguuaaacucacccaaauucauauuauaguugacauauuaauuauugaaugugggacagaauacagauuuuuaaauuaaauacaaagguacaacuuuucaucuuuuuauaauuuaaacucuuaaauguugcuuuaaaagauuauauuuuauuucuuuaaaguacaguuuuaacaagugacuuuuaaaaguaagccucaggccaagugugguggcaugugccuguagucccaacuacuugggaggcuuagcaggaagaucacugaagcccaggaguuuaaaacugcugugagcugugaucaccacuacaucucuagccugagugacagaucuaagggggacaaaggagauagaguggagucuguuuuucaccuaacauauaauaaauuuauauauuaaccucaaggugucaaauggagaaaaguggaacgagcuccaguugaaacaacaagcaaacaaacaaacaaacaaaaaaguaaggcucaaaacugaaaguaguaauauauauaacuuuuuauuucugguuuacagauuggccaagcuguuucuuguaaauccgcuuagcuaaccaagggcaugauuuuucaugauucuuuuuucucugucucccuuuauuauuugguguuucuggguuauuaaguauugauagcuuuggauccuguuagaucugugcuuuuuauuaguaguaauuucagcuauuuauaaauaguaugauuaaagaagagaaaucaaggaaaagauauauauaagaaaauaugaugaauggaauuauauucuuaaauaaaaaugcuuaugaauauaauuagguuuaaagaagcauugucccauuugugaaucucaaguuaacuuucuaucucaucauuagcagaauuaaaccauaauacagauuuacauguuucuuuuuguuuguaaacaaaucuaaaaaaucuguauguugaaaugauuguugaaaugauagagcaaaauuauuucugaaguuuuuuggaaagugauacuaaauaaauuaauuuuacuuugaacaaaccuaagcuucagaucccaguaauaaucuuuuuauugauuuuuuucuuaugggacugauaagaucaucgauuacaguccuguuuacgaccauuaauaacauaauuauucuacaaaaagccuuuuuaccaauaauuuugggaauuuuuuuuggucuuuguuuugggcuuauuuucaagguuuuuccuugaauuugagguucccuugacuuugaggguuuguugccuauggguucauugauuugguaggcaguuauaauauuuaaaacucaugauuaugcuuaauuuucccaagcacuuuuagaaauacauuuugaaaaauggaguguuucuuuaauuauuuuaauuagguauuaaaaauaucuaauuuuaaagauaucuagauuagauauaaaaauaacaaagcaacagcgcaucagagaaguugagaaacuuuaucaugggaaaaaagugaucuagagaagcuaguguaauaaaacaaauucauacucuuuaaagcucaguauaaaaauguucaguauaaaaauagcacuacuaagaaugcuaauuaauuagaugguucuuaacuaauuguguuaaaucuaaguagacaauuuauuucacguggaaaauauuguuaauguuugagcuuaaauuauauuucuaucuucauuuugguugguaauacuucaaguuagcauucauuuaaugugguuuuuguccuguuucuuaugaagcaguaauaauauugcuguaaaauauuagagauaugaacuaaagggauagugacuugaauuugaucuaaugagauguaggugaaucaaaaugccaggucugccacuuacaagcuauaugguguuaagcaaaucacuucagccuuacugagcuucacuuuuuauaauacugauugagcaucuguuaugagccaugaacccuguuuggugcugugauaugaagaauguugauguuaggucaaagagacugguagguaaacagaagaugacauaaagaaugguaaugucugagguauacauaggggaugugggagcaaagaggugagucaguuggugggaggaggaagcugugggaaacuuucuagagagggugguacuucuucaggguaccaccagucuuaguuuucuuaucuuugaaauauaauuugcccauaaugaggcugggugcaguggcucaugccuguaaucccagcacuuugggaggcugaggcugguggaucaccugaggucaggagcucaagaccagccugaccaacauggugaaacccucaucucuacuaaauacaaaaacuucaccaggcaugguggugcaugccuguaaucccagcuacuugggacgcggaggcaggagaaucgcuugaaccugggaggcagagguugcagugagcugagaucacaccauuguacuccagccuggcaacaagagcaaaacucugucucaaaaauaaaaaaaauuaaaguaaauaaauaaauaaauaaauaaauaaauaaauaaauaaauaaauugcccauaaguuauaaaggucaaaugaaaaaauaauugauguaguggugcucugcaaacugcaaagcguuuuacagauauaaguacaaauuauugaucuguaugucacauacucugcugagaacuggagacaugcaaaugguugcaaagaguaguguuucucaaagugugguauauggauguauucucaguuaucucugugugugugugcagguguaugugcuuauuuagauaaaauuuuuaaugaaacuacaaauugaaucuauuaauagaugagcugaauaaccacauuauaacugagauuuccacucaauuucaguguguuucauauuugccuaugaucuuuuucauucuagguuaaacuacuuuaauugucuugcacuaaugaggagaaagagaaccagucuuaauaugaaaauguuaaagcuaagugauaucacaggcaaauugaauaaaaaaaaaacccaacuucauuguacuaguuggucccacacugucauuguuuauaccuugcuuuauguuugcuuauguuuuaauaauauuuuguggaggucagcagucaugaccccagggaagccuucuugauuguccuaucuagauuaacuuuccuuuaugcacucuccuagcccauguaccuuuccuucacagacuuuuucauuaguauggucuuaauugauucagguaauuagugucucuccccaaaacuguaauguacauugaugauccagggaccaugucucccuuugcucccacuguaguccaaccuugcaugcacuaugucuggcacauaauggguccucaguaaauguuuguugaaauaaugagugaacuagguuaugacugaguugccuucuaaauugacaguaauuuauuuacauguuuaguguugaauauguacaggcacacacuccaauuuuuaaacuauaauuucugaauagcguaagcagucacuaucugauguauccaaaauggagcaucucuauucuagguuagugcaacaagacuuacuagaauaugagaaagaaggccgggcaugguaguucacgccuguaaucccagcacuuugggaggcugaggaagacggaccaccugaggucaggaguuugaaaccagccuggccaacaugaugaaaccccaucucuacucaaaacacaaaauuagaugggcaugguggagcaugccuguaacccuagcuacuugggaaggugaagcaggagaaucgcuugaacccgggaggcagagguugcagugagccaagauugcaccauugcacucuaaccugggugacaagagugaaacuccaucucaaaaaaaaaaaaaaaaaagaaagaaaaaaaauaugagaaagaaguguuagaauuuuuauuucuauuuauuuuuacuuaaaaauaggagauauagccaagauauagaaacuuauacauaucauauauaugaaugaggcauccugaggggcgaaaaaugcaacuuguuuguuacacuuuccauuuucagcaagguggauuaauggauuauguagucugauuuuaaacuaacuucauaauauugacaaguggcuuaaaaauuuuuccacauauagcuuacagauugaagauugcauuaauauugcaggcagaaacaagaaaagggcagaaugaguaccuguccaauucuucgacagucauguaacaauuugaagauauuaccuaaauaagaaguuggcucuaaaauuccaaauacuaagauuuuugacacauggauuuaugucuauuguauguauuauuuucagugaugaauucuuauccaaguguauauugugcuguaaaauuaacuaaugaaguugccucaaugaacaggauacuuaaauauuugaucuuuaguuuuuauuuuguaauuccuauuuuuguauguuuuguaaaguguauacuuauauuuauacacuagaacauguauauaauuuauaaguaaauauuuuuaacuaagaagcaaacauaauaaaaaaauucagaaacuaccgaacugaaaauuucuaaguauaauuuacacgcaauaaaauccaccuauuuaaguguacuguuugaugaguuuuggcaaacauauauaccuguauaaacaucaccaaagucaaaauacagaacauuuucauuaccccaaauacuucccucuucuuuguuauuaguaccuuuccucucccauccaaauucuaggaaaauacuggucugcuuucuguuauuuagaucgcuuuauauuuuccacgacuuuuauuugaauuuccaauaaaugaugucauacaacauauauucuuuuuuuuauuauuauacuuuaaguucuaggguacaugugcacggcgugcaguuuuguuacauauguauacaugucccauguuggugugcugcacccauuaacuugucauuuauguuagguauauauccuaauguuaucccuuccccucaccccaugacaggccccggugugugauguuccccuuccuguguccaaguguucucauuguucaauucccaccuaugagugagaacaugcgguguuugguuuuuugucccugcgauaguuugcugagaaugaugguuuccagcuucauccaugucccuacaaaggacaugaacucauccuuuuuuauggcugcaugguauuccaugguguauaugugccacauuuucuuaauccagucuaucacugauggacauuuggguugguuccaacucuuugcuauugugaauagugcugcaauaaacauacgugugcaugugucuuuauagcagcaugauuuauaauccuuuggguauguacccaguaaugggauggcugggucaaaugguauuucuaguucuagaucccugaggaaucgccacacugucuuucacaaugguugaacuagcuuacagucccaccaacaguguaaaaguguuccuauuucuccacauccucuccagcaccuguuguuuccugacuuuuuaaugaucgccauucuaacuggugugagaugguaucucauagugguuuugauuugcauuucucugauggccagugaugaugagcauuuuuucaugugucuguuggcugcauaaaugucuucuuuugagaagugucuguucauguccuuugcccacuuuuugaugggguuguuuguuuuuuucuuguaaauuuguuugaguucauuguagauucuggauauuagcccuuugucagaugaguagauugcaaaaauuuucucccauucuguagguugcguguucacucugaugguaguuucuuuugcugugcagaagcucuuuaguucaguuagaucccauuugucaauuuuggcuuuuguacaacauauguucuuuugugcaagcuggcuucuugcacucaucauaauguuuugggaguucauccauguuauuguguguaugagagguuuuuuuauugaugaguaauguuucauuauaccaauauuuauuauaguugguuuauccauucaccuauuguugaacauuuagguuguuucuggucucaaacauucguauauucucagggcauagguuuuuauuucucauggguaaauaccuaggaguggaccuguugagucccaugguuaauuguuuguugaaccguauaagaaacugccaaaauauuuuucaaacugguuauacuauuuuauauucccaccagcaguauaugagaguucuacuugcuugacaucuuugucaaacuugguauugccaauauuuuuaauuuuagccaugcaaaugaguuauauagugguaucucauugugguuuuaauccguauuucucugaugacuaauaauacuaucuucuuaugugcuuauugaccaacuguauaucuuaauaucuuugccuacugagagcuuacuauucuucccuuucuacuuuuauuuaaaguaguaaguaccuaauuuguguauaauuuuuuuuuuuuggagauggagucucgcucugucacccaggcuggagugcaguggcgcuaucucagcucacugcaaccucugcuucauggguucaagcgauucaccugccucagccuccugaguaacugggacuacaggcgugugccaccaugccuagcuaauuuuuuauauuuuuaguagaggcgggguuucaccguguuagccaggauggucucgaucuccugaccuugugauccacccgccuuggccucccaaggugcugggauuacaggugugagccaccaugccuggcuaauuugugucuaauuaaauggauuucuauaauacacucacauagguguaaguaaccuuuuaaaauuguaacuuaaaaccaaggaaagcaagaauaaaauaacuuuaauaaugaaaaaguaacauaagugaggucauguuuuugguaagaaauaaauggaauacuaaaaaugaugugaaauuuguuuaauuuuagaaaucuuaucagcuuguauugagaaaccugguaauauaugguuagaugguaugcuaguuugaauaaauuuaaauguggccgcagcaugccauggacagaguuagauaagacaaauaagcuacaucaugguguggucuugcucacugggaucagaaucaaaguaaaauggcagacaugugcacagcucauccugauagcugucugaccagaguguauuaucaggcgcacuccuauaauucugacugggaguuaauggucuucauaguggagaugacagcuuuggaaagagaucaguaguaaucuucaaucugaagaauuuuguauuugaccauaagauuuucaacauuuagguaauacuuuagugaaucucuguagagagcuugaguaaauauuagucacugaggcucauuuguuggaucauagagauuaauguuuauaauguacauacugcaaauaguauggauaauauuuaugggauaaauaauuuuuuguucuaauuuuguucaugaaccuuguaucaugacaaugauaaauuacguaacuguuguuaaugcuaauuugaagacuguggagcuggaagaagucuuaaauguuaucuacuccaguuuuuuuuuuuaaccuguauuuuuaaaaauuaugguaaaauacaaaauuuaccaucuuaaccauuuuuaaguguacaguucaguguguuaauuacauucacauuguugugcaaccagucuccaggauucuuuucaucuugcaaagcugaaacucucuacccauuacaauuucccauuucccccugguaacugcuguuguaauuuuguuucuaugaauuuggcuucccuaguugccauauaaguagaaucauacuguauuugucuuuuugugaucuguuuauuucaguuagcgaaauguccucaaaguucauccguguuguagcauguaucagaauuuccuuuuuaaugcugaauaauauuccauuauauggauauauaccacauuuuguuuauucauucaucuucccuuggauacuuggguugcuuccaccuuuuggcccugcccuugugaauuaugaugcuaugaacaagcuguacuauugggaauuaugaugcuaugaaugggcuguacaaauaucucuuuuaggcucugcuuucaauuauuuugaguauauacugagaagcggaauugcuggaucauaugauaauucuauuuuuaaaauuuugaggagcugcuauacuguuuuccauaacagcuauaccauuucacauccccaccaacagagcgcaaggguuccaauuucuccacacccucaccaacacuuauuuucucuuuucuugacaguaaccauccuaauggauguaaagugguaguugugggguuugugugugugugugugugugugugcgcgcgugugugugugagacagagucucacucugucgcccaggcuggaguguaguggugccaucucgacucacugcaaccucugccucucggguucaagcgauucuucugcuucagccucccgaguagcugggacuacaggcgcaugccaccacuccuggcuaaguuuuuguauuuuuauuagagacgggauuucaccgugugagccaagauggucuugaucuccugacuucgugaucugccugccucugccucccaaagugcugggauuacaggcgugagccacugugcuuggcugguacuuguauuuuuaaaagucuguuuuucuuuuucuuucucucuuccuaaucuuucgccuucuccuccuccuauacuuuuuguccuccugcuuuuggcaaacaggucuguauauaaaauugaucuucccagaacuucacagaacugggaaaccuagagcuucaccuuuccuuauaccuuuuauuccugaaggggccaggaggagaacagaagagaaaacacagaucucuuugacuuucuuauuuuaaggcugaggaaacugaggcccagggaaaugaagugcagccacacaggcaauuaggacuaaaauuuuuaauucucuauuuaacaguuuucuuaaacuacauaggugucaaagaaaucuuuaaagaucucuaauaauuuuuucugggugggagugugaauuagcuuucucagguuaccuagaaagauauugucugaaguguggaauguuuauucuuuugggaugugaugugauuuuaaguggucuuagcugccaaaagauggacuuccguugauuuuggaaaagagcuuuaagaaaauguugaauugcagagugaggaguuuauucccucauccauucucucucacugucucggaguagucagugaggucaguuuggugcagaguaucuauaaagccucaugaauauuugcuagucuucccccauaccuacugacacaccuaaaaauagggaguaguauucaagcuuagagauacaaacauagagauauggcaacgaauaguuggcuaguacuaaauaccuguuuugauauuauuuuuaguuuuguauuauaacaaugaaagauggaagauaguaguuuaccauuuuuucuuguguuugcaaccuuuuuuccaagagauuuaaguagaaaauggaagaacuguuaaguacauaagauacgaggugaggccaggcacaguggcucaugcauguaaucccagcacuuugggaugccaaguugggcggaucacuugaggucaggaguucaagaccagccuggccaacaugguaaaacccuaucucuacuaaaaacacaaaaauuagcuaggugugguggcgggcaccuguacucccagcugcucgggaggcugaggcaggagaaucacucgaacccuggaggcagagguugaggcaggagaaucucucaaaccuggggggcagagguugcagugagccaagaucacaccaccgcacuccagccugugugacagagcgagacuccaucucaaaaaaaaaaaaaaagaaagaaagaaagaaagaaaaaaaagauggcaggugcuacauggagauggcauauauacugcguuaguuuggguacuaaagaagcagacucugguacaaagauuuaaguacaaguaguuuauuugggaggugaucccuggaaauagugguaggauauugggaaaaucagacagaaaggggcuuuauccaauacaguuuuucuuauuauauaagauacagcuguggauaauuaucacaauggagaaaucuggggagccaguauuaucccacaucucagaguuaucccacuugagggaugaggaagccucugguguuuauacacguauuucuguuggucauaggcagagagauacaggggugguuaauuuccugguauugcuagcuaaugugaugguaggcaaagaagguauuaggguaccaagaaaucucucaggcaaagaaauacaguugcuguagugagaagcuuggccgguguacacugaagagguaagggugaauguauacagauuuggggcauguaauauuuaccacuuagguauuagaauaaugacuaccuuagguaaucucuauuguggcuaaacauuuucaaagauaugaauuuauagccaccucuguuauuaggcuguaaaguguugaaacuguaaagggaauuuuucuugguaccuaaacauaguccuuccaguugcuacuugaguuuguuuucagauccuuuucucaaugggcaaaguacugaaagugucuguucccauaguauuccuuccucuauuugaauaaagacuauuauuacuagccuucuguucucuacuaacccaaauuauuuuagguuuucuuuguuaugccauuucucaaucauuuaguaauuuauguuacucuuucuuggacuuccuguagcgucuuuucaucuuacuuaaguugaugagucuauuuucuauagcugcuuuuucaggauaauacaauuaaugaaaagaagucuuauauaauuuaaauuucuggccacauguaaaacuucauaauuuauuaauuaucaucauuugaauaguaauuuaaaugauuuuaguuauacagaucacugaaauuauccccaaagucauagcauaucuauaucaauuauuugauaguuauuguaauauauuuuagagcugcguaagcggaaacacuuauuuaauccuaaguacuuugcucuaauauaaaguauuaaaauuaaagaguaagaauuaauugugcugcuaaagaaauggaauugguugcaugauuuuaaaguaucuaaauucauuuugcuuuaucuuaacuccacuggcaaauaaaaaagggcuauugcuagcacuaugaacagagacaucugaauuuuugaaaauggaagccgcuguaaaugauaaacaggcaacccugguguuuagagaacuuacccuugauagcaacuaauaauauucccuugcaguuauacacauacaauagugaauaaauugaaugacuuuacuccuaauuagucuuuccugcaaauauuaaauaauuuaauaauauuuugcuuuuuuuaaaaaaggauucaucuuauguuacaacaguaauuucaagagucuuugcuuuuaauuacauucuuggucauuacucccacagauauuuugucauucuauuguggccauaugucauuaugagaaacuuaauacauuacuguucaguuuucugagaggaaacaccccacaucauagacacaugcaccaauuugaauuacuuaucuggacauuguaaaguaaaauacuuaaucucaauuugcaguuguauaagcauguauuuuauauaguggagaaaggagaaauauuuuguauacuuuuuugcuuuuaaucuuuagugagcuauaauuuauuuacaguaaagugcacagauaucaauuuaugcaguuuauuauguuuugagaagugauuguguaacccacacuuaaauuaaggcauuuuuaucacucuagaaaacuuuccucuggcucgucccaaucucuacccuccccaucccucgaucccagaaacaaacacuguucugauucacagauuauauauauauauaauuaauaguuuuuaaaaaauaauuuuuaaaaaucauguacuucauagaagauuugaaaggauagaguuguaaauuuauugaagacuguuuugaaccacagaguaggcaagggacugaauauugauacuaugguuggaaaaaggaaucauaaaaauauauuauaauuuccaaaacuacuuacuuuugaauaaguauuuuguucaguuuucugaggauaaauaauuaauauugaauugaacccuauauauuaccuauguguacucauuggauaacuugcucuagggaucauuuaauuuuuuuuuuuuuuuuaauaauuugaaacauccuaaccagcagucuuaaaaaaacugcucugggcugggcgugguggcucaagccuguaaucccagcacucugggaggccgaggcgggcggaucacgaggucaggagaucgagaccauccuggcuaacacggggaaaccccgucucuacuaaaaauacaaaaaaaaaaaaaaaaaaauuagccgggcguaguggcgggcgccuguagucccagcuacucgggaggcugaggcaggagaauggcgggaacccgagggcggagcuugcagugagcggagauggcgccaccgcacuccagccugggcgacagaucaagacuccgugucaaacaaacaaacaaacaaaacaaaaacaaaaaaacaacugcucuguaaaucuaauucgucauuaauugagccccaaauuagucaucagcaauuugugauccauuucuuuagucauuuguucuuggcuucaaaauaucauuugcuuucgcuaguguaaaaguauucuuuaaguaauuaucugauuuguugucagugcuuacaaagcuuucuuacaucuucagaagcaguccuuuuaugguagaauuuuaauuucuaccauuucaauuacuuuuauucuuguaaaauagcauauggguggagguaugaaguaagaaagucaugaaauaaggaaaaauagaacuccuuuauuuggaaauuucuauggucugaauguuuguguuuguggacaaaauuuauauacugaaauccuuacccccaaagugaugguauuagaagguggggauuuuaggaaaugauuagguuaugaggauggaguccuuaugaauaggauuaguguacuuacaaaagacaaccuagagagaccccugucuccauccacgugaggacauaggaagaaggucagucuaugagccagaaagcaggcugucaucaaacguugaaucugccuugaucuugaaauucccagcauccagacugugagaaauaaauuucuguuguucguaaguuacccaguuuuugcuguagcagacugaacggacuaaaacgaauaguuccagcacucuucacugucuuccuaucuuuuucuccuggugugcuauuugccuuugugauuuuuuccuuggaagcucaaagcuacuugucauauuucaguuuguaucugccuccuuuccuucaccaaauccuuauuaaggauucccucuguacuauuaauagcaauugugauaaguaguaaagaagaaauagacauuguuccugacuuuauggagcuuacuuacaaaauaaaauuaucuuucucucgucuacaucagaauuaccacuguuuuugcaaggaagcuaguuauacuaagauguaaguggaugacagaacauugaaauuaacucugucauccaguucacauuauaaacuacaguacuuaggagucauucuuuguugaaggguuccaggcaggugggugauagauuuuagguggcuaggcauucccagugacugucaguugacugaaacuuguuacagcaaugugcagggacacuuugguaauuaggucaauaauaucuuuuguuuacuaagccaaaaaccacggagaugucaaagaaaaucaguuaaggaaaugauaucccugucuaucuuauugguaagaccauuuucuuaucuuuaaauuauuucaaugcccuuuuacuuuucucuauauuuuuuaagauucuaaaacuuaacuauguuguucucaguccucuugaaauugaaaccauuaucuuuaauauucacuaauuuuuuauugcuuuaccuuauuuauucuuuuguuuuaaaaaugucauacaagugccaaagggaacacauuuuacuaaaaaggauucagauagaauagaaacacacaaacaaagugaagcuuauuuuauuuugucuugucauccugguaucauuaaaauuuucuuucaauauaucuuuuuuuaaauuauauaaaucagcuauauaucaguuuggauuucucuaaacugcuuucagaguaauauuucuuagaguaugauaaguuuuagaaagguaauauauuaugcaauaaauugcauuuucacuuagaggcagaagaucaacaguggaacaauuuaugcuaguggaacugagauuguggauuaauuccuauuuuaccaaaauauugaauucucuuguaaacauuguagucacugcauguauguagcuaaaauacugaaauagcucugguuaucuuauauauccuaaccucuugugaaauagauuuucaauucuagggauugaugauagcauucuccuaaauuuucaugugauacuuuacucauugacuuugagauuucgucuuguccuuugauauuuuuaguuuucaauuugcuuguaacuuaacuauucgaacuuuuugaggaagaauuauccuuguauuucaccaaagccuuaacauuuagcaggaaauuaaggauuuagguuguuauguguguuacucuuaauuagggaaugucaaugaaaguaaaagcaaagaaaggggaagugguuccgaguguauuuccuuuucccuggggaauucugaaaacccauggagguguaaaauguugguaacaauuccuuuggacucugucuggauuaguuucuucuugcuguguaucaaauuacaaggauguaguagcucaaaacaacacccacuuauuaucucacaauuuuuggaggucauaagucugggggugcuugauugaguucucuguuccaugucucacaagacugaaaguaaugugucugucacauggggcuuuuguuuagagauccuggggaaggauccauuccaagcucauugaguuacuggcagaauagcagaacuaaggccucuguguuaucuuguuggcugucugaugggaucuguuccccacuccuagaggcugccugcuugacuucucuuguagccccuccauuuucaaagcaacaauacggccuuauguauugacucugacugcugccaccagccagagaagcacuccgcuuuuaaggacucaugggcuagagcaggccuacucaauuuuaacgucagcuguaccauauaacguaagauaaucaugggagguauuuuucauuguauucacaaguuauaggaauuagaguuucuaaucuugguugagggggaggcauuuuuagaauucuccuuacccuaccacuuugaaaucuauuaucaaucuucauaauacuuuacucauagccagugagguagagugaagcauauaacucacauaugaaagggcauuaagaaggccuaaauuuuaaaaugagaguuuugcuacaaaggauauggggaaacuacuacuuuuuugagugggaaugcuccuuauuauaaauaauucauuuaucucccaaaugcaugcaugauuucaaugcaauccaacugaaacacccagaugacuuuugaauguacauaagaauagccaaaaagaaagaaagaaagaaagaaagaaagaaagaaagaaagaaagaaagaaagaaagaaaggaaagaaagaagaaagaaagagaaagagaaagaaaaggaaaggaaagaaagaaaaaaaaaagaaaagaaaauuugccaaaaacagacuagugguagagaaagaacuuguuuuauuuaaucucagaagauacuauacaguuaugguaaucaaaacugagugauaucagaccaggaauaaauaagcacaucacuguauaaaugaaaacuuaguucauuauguucuuuaauaguaaaauaguuaaauaaguuaagcuucgucuauacuauggaguacucuaaaaccaaaguaguuggugcguguauguaugugcagacacacacguauacacgcacuuggaaacagcuccaaagauguauuguuaagugcaaaaaaacaaacaagaaguaggaaaacacacauaucucaccuagguuccuauacuauauguacucuccuauaaaaagacacugcauccggggcauaaaaugcucaccuaugguguuucccuuguauuuguguuggguccuguagcauauucucaauagugagcuaugagcaacaguaccauguauuauuugugagccaagacauuuaggagcuaguaugcuucuacaaucucucagcugcugcgagccuacaucacagugacacaacuaaaaggugguggaaccucuguuaaccaggguccccaagugagcguguggagcagggcccgcugcaccacugacugccacacagacagccucccagugguaacuccuaaguuagagaguuaacuuagaaacauuuucuaaguuagagagguaacuuuggaguuaccacugggaggcuguguguguggcaguuaguguuaacucuccuaguuaguguagacacaguuaaacacaugaggaugaaauuauugguaggggguuggaggauuguauaccauuaucucugugaaguggaauagcaggaagugugagcauaaaggaugcaguugcauuuuacuuggauuauuucuuuguugucugaauacuuuaugaaacuguguuuauauauaaguuuuguuaucagaauacugggaucaguaaaaugcaguucuccuaaaaaguagguaauauauuagcaguuugcuucaaaauuaacuuuacccuugcuagaggaguauuaugguugcuacucuuuuucuuuucuucagggauuuagaugaauaguaaguugauacaaugaaacagcuauuuuuguuuuaauucaugcaugaaauguaaaucucuaaaguaaaagucuuuuguuggugucuuuaugaagaguauaauuuauaguguaugaugugcagugcauuauuuucuaauauucugucuuuugcaaacuaccucaugauuuuuugcuuuauccaagaugcccacuauauuguuacuuuuuuuuuuuuuuuuuuugagaugagucucucugucaccaggcuggagugcaauggugugaucucggcucacugcaaccuccacuuccuggguucaagcgauuccccugccucagccuccugaguagcugggacuacaggcgugcaacaccaugcccgguuaauuuuuuguauuucaguagagacgggguuucaccauguuggccaggauggucucgaucuccugaccuugugauccaccugucccggccucccgaagugcugggauuacaggcgugagccaccacgcccggccuguuacuuuuuuuacuuaacuguuuucuauaaaauuacuuaaaagaauuaauuuaaaacaaaaacuuuggaccuaaaaugaaaagccagcaucucuugacauaaauauaagauuuaucuuauauucauaaaacugaauauaguaaaaauuaaauaauacuuaugagauauggcuagcugcauuugcuuaaaaagacccaguccuaagaccugccuucucuuaaaaagugaaauuauucuucaauagaacguugguuaagcuuaagaaggcuucaguuaacauacugaggauuguagaaccauauauuucauggggauauccaaaccugaagucagcaaaugaacaaaucuacaagcgugguuauggccaaaucaauaagaugcaaauugccuugacagauaacauuuugauuggucaaucucuugguugagcaucaucugccuggauggcaucaaccaagauaugccacaucuuggcaucaaccaaauauggcaucaucugccuggaggauuuaauucaugagaucuauacaguuggaaagcacuucaaagaagcaaauaacuuccuguggcccuucaaauuaacuucuucaggaguuggaaugaagaaaaagaccgcccauuuuguaaaagguagagaugcuggcaauagggaagaccagacaaacagucuuguuaaauggaugagcuaagguguaucccaugauuauuuuuguaaccuagucaauuacuaaaaugacugcuuucaaauugaaaaaaaaaagugaaauuaguaauuguuauagaugguaaaugcugagaccuuguccuugaaaaaacagaaugauuuuaaagagaauugaaaaugggcugggugcagugguucaugccuguaaucccagcacuuugggaggccgaggcccgcagaucaugaggucaggagaugaagaccauccugcccaacauggugaaaccccgucucuacuaaaaguacaaaaauuaauugggcauggcagcacacaccuguggucccagcuacucagaaggcugagacaggggaauugcuugaauccgggaggcggaggcugcagugagcugagaucgugccacuacacuccagccugggugacaaagugagacuccgucucaaaaagaaaauggaguuaaguuuuuaguauaugauuuauuguuacuuaaugucuugccuuuguacuaccaauaucauuauucccauauuuggggaaacacugguauugugggaggaauucuaggauuagagucagaagaucuggaaucacugccagcugacaccaugucuuugaguugucauuguaucuuuguacuuaugucacuauuuauaaaauggagauaaaaaugccuaccauuuuuacuucaccuuaggauuuuugcaaagaucaaaugcaauauuauugcauaucacuauuaauaauaguguuagcacugguuuaauaaucauguauaaguaagaaguucugcuauuuagacuauagugcuuuggcugcaaacaaauaauucauucuuguaauuuccaguucuauacccugaaagaaccgacaucuuuauuuaacucuccuguaaauaugcauaauaucaauagacaccgggaguaaguaugaaucuguaucuauguauucacagcagaaaauacauuuaaaguacauauucuuauggucucucuagaguugccaaacuuaauuuucuguaguuagauauuuugaugugcugcauacauuuauugauauuuuauguuucuguaguuucauuuauuauuagaaagacuagaggagccuccuguuacaaagaacucuccuaauacugcaguaagcuugacaucuuuagcucauuugcucuuucuggucaccacaguauuauuuaguaaaugcuuuucccaauaaauuauuacuuaguuuaguagaaucuuagcauugguaggcucugcuaggacccaagggaaauaaugcuuaauacaguguuauaauccugauaaaaugcuacucacuuuguaagaaguaaugguugcuauguuccuuuggauucacaaaaauagguuuauguauuuuauguaauaucuauccuguuuugucgcugagaaauuauucuaaacuaaaucuuuccugaguaacauuccugcucccagacacacucccccucucgccuuugaaaccugcuuuacuucuuccaaguagcuucugcucuuugaugccagucuauuuugggagaaauaaaugguaggcaucuagggaugauuuauugaacuaauucacuuccauuuaauuccuccuuucucagauggucacaaggucaagagagccaggacccuacugcuauguuagccuucauauuauucuucucaagaaguucaggcauaacacuauuacacuuaugcuguccucacaaguuagaguugccuauagcaaucauguaguuuuaguaaauaauuccuauaaagcauaaguuucauguuuaacugcaacccuguauaagaagcaggcuuuugauguuuauuggauuugaaccugcuggaagcaucuguuaaagucuaaugaaagaaaauuauauccaaagagcuaagacuuucugaaaaacagaagaagcuacacaguuuauaagugauagggucaucuaccacaggggcaaugagugaauuuauaauguaaauaaacaaauucuguuuucuacauaaaaugaauucugucauuuaaauuaacaauacaauauuuucuaaucuuugacauucaucacauucuuugacauggaagggcuaccauuccuagaagauucacagcaacuuuguaauuaacauugaauaugcaaggaaguccuuuguaaauuaauguuaaagauccagggaaucuccuggcucuugcucaauaaacacagugagagagaauuuaaguaauauuuuuuccaacccccuuaaccaugcuuuuuguucucugugauccugugcucaugaaguauaaacauccuuaccuacaaauuauaccaaacauucauaauacuuguagaacuuguuuuuggcaagauuuauuaaauagccugugacuuauuuuauuuuauuuuacuuuauuuuugagacagggucuugcucuguugaccaggcuggagugcaguggcacaaucauggcucacugcagucucaaccucccgggcuaaagcaauccuccugccuuggucuccugaguagcuaggacuacaggugggugucaccauguccagcuaauuuuuuauuuuuuguagaggcagggucucccuauguugucuaggcuggucuuaaacugcugggcuccaguaauccacccaucuuggccuccgaaaguucuugcaauuuauuuuacuuuuuuuuuuuuuuuuuuuuuccuaaagaaacaaggucucacuauguuucucaggcuggucuugaccuccugggcucaaacaguccucccgccucagccucccaaaguguuggaaugaauaccguagccucccaaaguguuagaaugagccauugugccuggugccuacuuuuaaccaagacugaaaaagcuguuuucagguuuaugauuucuauuuucauaacccuugcuuacagagaaaaucaguuuuucccguaugcuuuuucuuuucuugugucuucccuucuagcauauccguacugugcuuuugacuuuuuuacuucucuuuccucaauugcuucauuucccugugguuuuacugggccagaaauaccgacugaguucuauuccuucucuuuucucacaagguuacuuuuguaauuaaccucccugcugcuacucuggaugucuuccuucuccacuguccuuuuauuaauagcuguuauaauguggguccuuuuuccuucuguuucacauuuagucagucacauagcagccucuaccguaacuguucuaauaucccauguuuuuaaucugcuaagagcucuccuauuucuuguaggucuauuaaaaugaucuuaauacaguuuuugacauuucugaaaacuaagguuugaaauguuuggugccaaccaaauguguaagaaaugcucuucugugugaaaggcaaugaaggccuugacauaauaaagaaauuuuuacaaagagacuaguauuguucuuagcugacuaauaagcuuaacaauuauaaaugaacucauuuacuauugaaaaggauuucuguuuugaggugugauucauuuuauuuuucuugaagcacauccgaaauaacauauuguauaaauuuguccucaaaauauacuaauugauucuguugagcuagcacguuuuccugugguauauaauuuguuuugguauucacuuuuuuaaaaaauaauacaaauuacaaaaaaaguacacaaaauuagcaaauguauuuguaauagaauauuugaauaguaauaugaggugcuuccauauauuuaaauaugcaucaguaagagaguguuaaguuuuuuaauucaucuaguguuuaugaauguaaauacaucaugcauauauuuauauuugggggauaauuuuuuuucccuucaguugacagaauaaauucugguacagaauguuauuacagucagacuucauugcugccaacauacugauguguacuagguaaccauuuaaaaauuaacucaaggucauuuuaaaccugauauggucaggucauuuuaauucauugaacacuuaauuagugaaauugcagauuauuccugcuaauuccaccuuuguucuucucuuuucaguucacauuuugcccauuucacuguuuuuuuuuaauuuuaaaguagugaaaaauauuuguuuauucucuuuggaaauauuucugggaauuuauuuugggaaaggcaaugaaauugagaugauuaauuucauagagaguuuauuuaauuaucucuucucuaagugcuuagauaguacaaauaguaaaugugucaguuuaaagacuucacaaagauggguagaaaauaaaauuauuggggaugguaaugaaaugacuacaagaugcugguuuccccaucucuuuuagaaaugcuaaccugaauaguuccugcacuaagauaauggcaacuaaaauagaaaauaagcuuguaauagauaacuuaguaaauauuugaacaaaaauuaauguuuaacauaguagcaacuaauauuugaacaauuugaaucacauuugaucauuuuagaacgagaaaauagcaugcaacuuuacuuuaaaauuucaccuuugguuuuuaaugauacacuaaugguauuaaaagugaucauaucaguucacuuugaaaaaauaaacauuuuuuucauuauuuaaaaaaauacacauccccauuuagaagauucuaccaauuuuauaauauucucugggcauuguuuguuauugaauaauuauuaaauauaguguguuuuccccgugcugaacucugggaacauaccaacaaauauaaaaaauguugcugcucuauaugugcacuugggccagggcuagggaugggcuggaauucucuuauucucauuucccauccugugucuggguguauacauccugauagacuggcucuguggucacaguucucuuccuggaccugacugacuuuacuuuggguagaagagagcauagcuauggcuuuccaauccaccuuuacuauuauaacaaaggcagagccucacugccuaaacagcaacaauaacaacaacaaaacaaauaacaaacucuaaacuaaaaacuaggguaaagaaaagguucuugagggucuuaacuucuuaacuucucacugguagaaugagguauguauacauaagauacuuucgcuuuuuugguuccucuuuucauugucugcccuuuuuuaaucccucuuugcuuccuccauuaucuuuuaccuuugaaaaaaaucccuucucaaauugcaagcgguaugcccaauuccauuucuuacuuucaccaaaucguuucaagggucucguaggcccagauuaaaggauggcagaaaaaccaugcauaccagaugauaugggugggcucugugucccuacucaaaucucaccuugaauuguaauaauccccaugugucaagggugggaccggguggagauaauugaaucaugggagcaguuucccccaugcuguucccauguuagugagugaguucucaugagaucugaugguuuuauaaggggcuuuccccuucgcuuggcauucuuucuucuuccugccaucaugugaagaaggacuuguguuugcuuccccuucugccaugauuggaaguuuccugaggccucccaagcccuguggaacugugauuuaauuaaaccucuuuccuuuauaaauuacccagucucagguauuuuuucauagcagugugagaaugaacugauacacuggauaauaauaaaaaugguguuaccgccaaaauaugcuguaauucaguauuuucacuauuuaauuuggucuuccauucacuuugucaauucguuaacuugguagguaguguaaagaauuaugcccuauuuuuacguuguacuguaaagucuccaugugaucaagagacguauuuauauauugcuauccuagacaaguuagccagcaucuauccagauuucuuuuccaagauucuugacauuuucccaguuucauuucuacuuuaauuauagaaucucaugauuuuaagggacccuugaugaacauuuauugugcauauuuauggcugaaaccaaaugggaucuaaagaugaaauuuucacagacauaaagacaagacucuuguuuaugaaguauuucauaauuuuaccaguuauucaagauguauuauaauugucauacagaccuaaaccaugauuuguaucuaaacuuaauugcuuuggauccucacaguaacccuuuugauagauuagauaucauuuuuauuuuauacacaaggaaaucauugcuuaaagaaauaacugacgacccuaauauccaguaucagcacaagaaccucuuaauuucaaauuaaccaauuuuuccaccucacaguauugaccaccaugaagaaaaccaguugagaaucugaauuaguacuaagcuaugugcuaccaccuguguauucauaaauccugagagcaaaaugaaagaaauagucucuugugggauaaaauaaguuacagaagaccuuuuagagaaacucauuuuuaaaauauauauuauaguuguucauauuucggggauacauguguuauuuugauacacauaugcaauauguacugaaccagucaguguaguugggauauccaucaccucaaacauguaucuuuucuugguauugggaacauuacgauucuucuagcuauuuugaaauauauaauaaauuauuguuaacuacaauuucccuacuauacuaccaaauacuagaacuuacuacuuuuaucuaacuguauuuuuguauccauuaaccaacuucucuucauccucccuuccucauuucccuucccagccuccggugaaauuugguuguaauauaagcuauuaaauaaaaauucucuuuaaauacugcuuuccugcgugccacaaauuuuauguuguguuuuuauuaucuuuaaauucaaaauauguucuaauuucucuuguaauuguaacugcaaaaauaaaaauauuauuuuguuuaaaaauuuagaaaaguagagacucuaaauuuuuaauuaggccucaaaggaaauaguggauuucuauugguugaugagauaauuuauguagagaaaacaauauaagcgaugagaagguagcaagaauguacaagauuuuaauggaugauuauaaaggagcggagaggcuauguuugaaaauauccaucaagguuuacauauuauuaaugaaaugauuuuguguccugguuauuuuguuuuuaucuaaaauaugauugggaugcacuuaauaauuuaagcggaggcauuauauuaugaaaaaagugaguauuuuugaaagugccaaagaucugucuccuacuauuaaauauaauauuuguauuuuuuucuauagaugcuuugucagguuaaguaaauuucuauccuuagcuuacugagugugugugugugugugugugugugcgugugugugcauguguguauguguguguguguuuaaucaugaauggacguugaguuuugucaaaugcuuuucuggcauuuauugaggugaucauauguuuuuuucuuuuauauuguaaauaugguggauuguauuuguggguuuuuaaauauuaaacuggcauugcauucuuggguuaaauccuaccugauuaugauuuauuguccuguaaauauauuauuagauuagaucuacuuauauuuuguuaaagauuuuugcauuuagguuuaugagagacauuaguuuguaguauucuuuucuuguaaugucuuuucuaguuugggucucacuuuuaggcuagccucauaaaaacaguugggagagguucuguuguucucuguuuuuuaaaacauuuguguuagauuggcaauuuuuuucuucuugacauguuuccuacaauuuaccagugaaaccaucagggccuggaguuuccucugcgggaauaaauucaaguuuacauauaugauuugggauuggguguuuuggggccaguuuuggucauuuaggccuuuuauaaacuuuuuccauuucaucuuaguuguugaauuuauugacacuacguugucuuuauuauuaccuuuuuaaagauguauagugacguuuccccuuucauccuugcaauuuguaauuugugucuucuuuuucucuuugauaagucuaccuugcuguuucuuguuucaauuauuuuuuucuguuuucauauuuuuauuucuuuuauuaacuucuuuccuucuuuccuuccuuccuuccuuccuuccuuccuuccuuccuuccuuccacuuauucuagauuugauauauucuucaauuuuuaacacaaaguggaaacuuagguuauugccuuagauuuuuuucccccuaauauauauauuuaaaguuauaaauuucccucuaugcgaggcucuggcugcacucugaaaauuaugauauauuuucaguaacauucaauucaauacauugucuaauuucccuugugauuucuucaugauauaaaccauagauuauauuaauaaguauauuguucguuuuacaaauauguuggacuuuuuaagauaucuuuuuguccucgauuucgaauuuaauguuuuuggucagagagcaugcucuguauuguuuuaauacuuuuaaauuuguugggacuuguuuuauuccucauuuauuccugaacuuucaugaugcauguucaugugcaucagagcaugccuguucugcuguuguuacauagauuaugacgugaaagucauuuugguuaaguugauugauaauuucuguauucucaaugauuuucugucuuuuuugcguaucaacuauggaaaaaagaaugcugaagucuccaauuguaacuggauuuuuaaauuuucuucuuuccguuauaucaguuuuugcuucaugucuucugaaacucugucuuuaggagcaaagacauguaggauuuauuauuucuugauauuuuucuuaaugaaauauuucucuuuuucucugguaauauucuuuguccugaagucuacuuugacugauauuaauauagccaguccauuuuuucuuauaauuggcauuugcaagauuuaucucuuuauauccuuuuauuuuuaaccuguuucuguauauuuaaaguguguuuugguggauagcauauaguuggaucucacccauuuuuacccacucugacaauuaggauaugaaucuuguagauuccagguaauuauugauaugguugcauuuaauucuagugucuuguuauuuguuuuuuauuugucccaucuguucuuuuauuuccuuuauuuuugcuuucuauuagauuuauucaguguuuucuaguaugacacucuaucuucauuauuuuuuucuuuaguauucaaagauuuaaaaaauauguauuuaucagucuguguucaaccaauaauuuaccacuaaauauauaugaauauuauaaaagaguauuuucaauucccucuucuguccuuugugcuauuuuugucauuccugcauuucacuucuacauauguuguaagccccacuaggcauuguuauuauuuuugcucuacauagucagaaaaguaaaagauaagaaaacaaaaaaucccuauaacuuuuuacagaaaaguaaaagauaagaaaacaaaaaaucccuauaacuuaccuaaaaauuuauuauuucugauguuucucauuucuuuauguagaucucaguuuccaucuaguauucuuuuucuuuagucugaagaacuucuuuugucauuaucuucauuggcugucugcuggagaaguauuuuuguuugucagaaaaaggauccucucuucauuuuugaaggcuauuucacugguuauggaaauuuaguuugaaauauuuuucugucacuacuuuaaagcuguuuuuuuugucuuagacuugcauuauuuuucacugagaaguuuucagucauucuaauauuugcugccugguaucuaucuuuuuuugucugcuuaauuuuuuucucuuuauuacugggucuagcauauuaauuauaaugcacuuugguuuaauguucuuuauucauuuuuuaaaauguuuuuugguagagauggggucuugcuguguugcccuggcuaggcuuaaauuucuggccucaguggauccugcaacuuuggcuucuuugucuguacauugaugauguucuucuguucguguuuaucauuucaaucaaauuuggaaaaagaaaucuaccacucuuuauucaguauguuuucuguuacuucucugucugagacuacuaaauacuguccccuaguucauugauacuuuauuucucaucauuucuuuuuugccucuguucuucaugguagguagauuuuauugcuaagcuuucauuuuaagugguauacauuuucauuguauugucugcuuuuaauccuaaccagugaaauuuuaauuuuacauauuguauuuuccuacucuacaaauaguacuugguucuucuuuguagcuucuuucuuuuuuucucagcacggucauguuuucgcuuaaaucauaagucuauucauaauagcuguuuuaaaguuucugccugcuaguucauuucuaucauuucaaggucuguuucuauugauugauuuuucuccugauuacaggucacacuucccugcuucuuuauaugucuaauuuuguuauuuauuauaugcuaggcauuaugauucuuaugguauuguaagucuggauuuugcugucuuccuuuaaacauauuacauuuuguuuuggguagucaguuacacugcuuguaauucagauauugucaaggcuuguuuuuuagcuucauuaggaugagccuaaaguugucuuuacucuagagcuaguacagcccuacuacuaaggcuuuacuccuucugguauaucuacagaaugcccuagguguucacuacagucuuaccacuauggguaaucacaucuuaaaccaucucugcaccuuacacuugugcaguucagaaaaugaugagagauucucuugggucuguugcugucguuuucucuaaugccuucuuuaauacucugcucccacauuucagcugccauuaagccuccccauuucuuuauuuuauuuuauuuuaguauuauuauacuuuaaguuuuaggguacaugugcacaaugugcagguuaguuacauauguauacaugugccaugcuggugugcugcacccauuaacucgucauuuagcauuagguauaucuccuaaugcuaucccuccccccucccccuaccccacaacaguccccagagugugauguuccccuuccuguguccauguguucucauuguucaauucccaccuaugagugagaacaugccguguuugguuuuuuguccuugcgauaguuugcugagaaugaugauuuccaguuucauccaugucccuacaaaggacgugaacucaucauuuuuuauggcugcauaguauuccaugguguauaugugccacauuuucuuaauccagucuaucauuguuggacauuuggguugguuccaagucuuugcuauugugaauagugccgcaauaaacauacgugugcacgugucuuuauauuucuaaucuuuguuuccuuaucucagugagaccaucauucuguccuaguuucucuguuccuguucugcaauguggaaaaugguucuaggucagaacccaggaucauggcaggauucaccuuguuuguguccauucucuuaaggaucaccaucuuaugaugccuuuugucacaugacugaaaacaucauuuuacauauuuugucaaguuuucuauuuguuucauguggcagggcauuucccguaguauuuacuccagcauggccugaaguggaagucuuauaaucuuucaauacguuuuaauaugauguguaaggugcauaauguguaaggugcagagaaguuuaagaugugaucagccauagugguaagaccuuaaguaugauuuuauguuuaauaugauuuuaauauguauguaauauauuaauuuauuuucacuuaaaaaaaucuaagagcaauauaaauaugcagaauaaaagaugauaguuuuuucacccccucaccucuuuucaugucacucagcagaguuaccauuuuuagaaguuugguguauauccuucuauucuuguuuauaugaauuuguauacacauacgaacauauaugcugauauguauauauauaugcacacacacauacacacauuuuguuuauguuuauauauucauaaauuuauuuuuguauacacaaagcuaaucauacuguaagaauaaguauuguuccacaacauacuuuuuaaacuuaguaauauguauuggcaaucuugccuaaaauacauauauaucuuacuuuauucuuuuauaucagccauguauucuauggaaugguugaacuaagauucacuucauaaugucagauuucaucaucauuaaaguuuuccuuuuucuuauaaauuacguauuuuuugaaauuuuuuuguacagcaacucuucagauauugaguuuucuuguugaauaaauucacaaaaaugucaaaugauaugccugcuuauaaauuaccuuuaaauugccuaaagaaccuauuuauauuacuacuaacuauauguaagcaugcucguuuucuuaaaauauugucuuuaauuaauauaaucccuuugguaauuuuuauaguucuagagaguaaaaaguaguuuucuuuucauuugaaguuaucugauuauguuuaauguugagcuuuuaacauuuacauuuaucguucaucuauaauuuuaauuuugugacccacccaccuauguucuaacauguuuuaguucuuuuuuuauugauucauagggaguauuuauauaugugggauacuauaccuuauuaaguacguugcaaacuauuuauucaauuauaugucuagauuuugaacuuuguuuauguuguuaguuguccuaaacugucuuuguuguuguuguuguuguuguuaguucaaaucugacuugcucuuauggcaucuggcucuugaauguuucuagggagguuucaucauuucuagucuauaaauauuggcaugauuuuauuuuauccuauucauuuuuauauuauuuaauuaaacuaguauauguuuguauauuuacauauauaugugcauacacacuuuaaaaaaaagauuuuaguuucuugagaacacuucauuuuucuaaagcaccuuuaguauuacugcaaaauuaagaggaagguacagagauuuccauaaaaccccucgcuucacacaugaauagccucuuccauuauaaacauuccccaccagagagguacauuuguuauaacugaugaaccuacauugacacaucauuaucacccaaagucuaaaauuuauauuagaguucauucucgguguugugcauucuaugguuuugaacaaauguauaaugacauguauccaccauuacaguaucaugcagaguaguuucacuguucuacaaauccuaugggcccugccuguucaucucuccuuucccccaguggcuggcagccacugaucuuuuuacugucucggucauuugaccuuuuccagaaugucagauaguugaaauccuacaguauguaaccuuuucagauuaccuucuuucacuuggucauacgcauucaaguucucucaugucauuucauggcuugguaguucauuucuuuucacugcagaauaauauuccauuauuggaauuaaugaaaacaauauuucauuguuuugauguguagugcaguuuauucuuccguccaccuucugaaggacaucuugguuguuaccaaguucuagcaauuaugaauaaaguuguuauaaacguguuugccuguuuuuguguauacguaaguuuacaacuccuuggguaaacaccagggaacaugauuacuggaucauaugacuagauuauguuuaguguuguuagaaacuaccaacgugccuucccaagugucuaccauuuuccaucccucccaacaaugaaugagaguuucuauauuucucacaucccugcuagcauuuaguauuaucaguguucuggauuuuggccauucuaauucagcauuuuagauuuugguaucuuaugaugggagaauauuugcauauccuuauuugucaucuguauuaaggucuuuggcccuuuuaaaaucagcuuguuuauuuucuuauuguugaguuuuaagagcucuuuguaaauuuuggauaacaauccuuaaucagaucaguauugcaaauauucuuccccaguuuguggcuugucuuuucauuuucuucacagugucuuucaaaguagaaauuuuccauuuaaugaaauccagcuugugaauuauuuguuccaugaauuacaccuuugguguuaugucuaaaaaggcaucaccaaacccaagguuaucuagauuuucuacacauuuuuuuaauaggauuaucaaucuuucucaaaguuuuggaugcucauuugucuucgguuuugcuuauuauauuuuuauccuugcaaacagguuuacaauuuuauuuaaaaguauuuuuaucacuucugaauguuguagugaggaaaauuuuucauaauuccaagucaaaaggaauauauuccuuuuuuauuuuaugucauaauauuucauacuugaaugaucuucaaauuuauucuauauuguuaaguuuaagaagcaagguucagaacaguguguauaaaaugcuuuguuuuuucuuagaaugagguguguauguauucacacgugggcacuucuauacacauucauauacauuugcacguuugucuaaaaagauauagagaaaaagaaaggcaaugaaaggauaaaccuaaacauagugaaaaugguuaccuguugggggugugggggcaguaaguaagauagaagcagcaggggugaaaggagggucaucuguccaaauauauugccuguuuuauaguuuuggcuuuggaaccacauagauauuucauguaaucauaaaacaaaauuaaaucaaaauuaaauacagcaaauccuaaaauuaaaaagaaaauuaaauacaugaauuuaacugcguaucaagcugaugacuuauuuuaagugacuuuauaguaauacaaauuacacaucucuaggggcauauaucuuaagggcagaaaauugaaggaaacaauauuugauaaucaaauauuaguaauaugauauuuuuauuuugaaaccauaaaauuucaugauaaagcaaauaaguaaucauguuaaaaucuccaguaaccaaaauuuguaccauaagagcaaagauggacaaauauauccaagauauauuuaauuuguauauauuuaaaauucaaugaaaaaauuacuaugaauuuaugauauguauuuuuauccuucaaaaaauauguguauuucuagcuugguucaaugaaaagaccuagaaauaugaauagcauccuagcagcaagcauuaaugggucccaauuguagucuuugaauuccauuuuccacuaagaagagccagggcuuuuuugaagaaaugucugauuccagaucuugaguaggaaauaugacauaagccugaagcaucuuguuauaacagaaaguagcagaguuaagaaagauggugggguuaugucauaggaacuaguuagaagaggcuaccauuggccaacaaugggacaauuuuagcaagaaaaaaagauugcuaggauugaaaaucauuaaauauguucaaaagcugagaaucguaaggauacaaacaaaaacaaaauaaaaaaccacaccgaucaccucuggaggguacugggggauaaagucauuuucaguacuguaauauaaaaagaaucauguacuuauccuauuuuucccauaaaaacuuuauuucaaaguaacuaaauaauuaaugagaggaauuuauucuuuauagaaggauuuugcuaauaaaugaagaaagaauaauagaauuagacuaccgcaaguuuacaaccuuuauuauuuaacauaauaucuguaggaaaugaucaucaauggcuacuaauauccucaggcgaaacguggauagggagcaggauacuauuaauagauagacccagguggcaacauaugacuccacuagugaaacuuaacauugcagagggacagccaguuguuauaugucaacugauaugguacaauacuaaguacacaacuuuuaaaaaauugaacuuguucaagccccaacauauaccaguuuauacagcauacaugaaauagaggaacuuauuaaaugacauuucaggaugcuguuuaucagucuagaugccagaaauucuccaagauaaaugacccaguuucuugaauaaguaauaggcgggaaauaaaaaggauaagggaacuuggagauucaaagagaaagaaaauaucaacccaaaugcauuauuauguagaccauguuuggaucuuacuuugaaaaaaccaauacuauagugauuggacucaucagggaaauuuuaacaaugacugaguuuuagaugauguuaaggaauaguuaauguuucauaaaugauauuauuguguuccagcuaaaaacaauuccuaucucuuagaaauacaaaugaaaauauuuaccagugaaaugauauaaucucuggaauuccuuuguuuuuuugagacagaguuuugaucuuguugcccaggcuggagugcaauggcacagucucggcucgcugcaaccucugccuccuggauucaagugauucuccugucucagccucccaagcagcuagaauuacaggcaugcaccaccaugccuggcuaauuuuauauuuuuaguagagacgggguuucaucauguuggucaggagacuggucuugaacuccugaccucaggugauccagcugccuucacuucccaaagugcugggauuacaggggugagccaccgcacccggccuucuggaauuacuuuuaaauaauccugugaagggaauaaacagaaaagauaauuuaucuuggaugacaaguacauaggguuauuacaggauuuuuuacauauuugaguguuugaaauuuucuauuaugaauuguucuuaauuuaaaaaaaucagcuuuuuaaaauuaaauuggaauagaauuucauaagucaccaaaauaagaacuuucuuuuuuuuuuuugagacagaaucucacucugucacccaggcuggagcgcaguggcacaaucuuggcucacugcaaccucugccucccagguucaagcaauucuccugccucagccucccaaguaacugggacuacaggcgcaugccgccacacccagcuuacuuuuuguauuuuaguaaagacgggguuucaccguguugcccaggcuggucuugaacuccugagcucaggcaaucugcccacuuuggccuccuagagugcuaggauuacaggaguaagccaccgugccuggccaagaacuuucauaauuuuaaaccugaacaguugaaaugugucuauacauuuauaccugcagggaaguuacagaauuuauucagcauaaauguugcaguugcucuggaaucaacacaugcuuaucuugaaacuaugacaugaaucuaauaguuuuucuuaucagucuuucucaaauuuaucaauaauaccggauaaaccuuugagauagaucuaaugcucuguauucuuccuaucauaccuaccucuuaccaagguccuaauacuuguuuuucagguacagcagguacagacugugcagcagguacaacaugucuaucccgcucaggugcaguauguggaaggaagcgauacugucuauaccaauggagcaauguaaguuuauauguggaagucuuuuuaauucccccacucagagaaaaauaauguacuuuugaacaccucccacuauucccagauuguuuccuuguuuucaaaguaauuuucuacuagaacaguuauugaaauuaagcugauguuuagagcuuuugucuauauuuauuaagaauaugcacucauuuuccuuucacuuaaccccauaggauauuuuaaauuauuuaaagucuuaugcccuuuaauaguucuuccuauguagagaaaaaauguauauaccccuuguuagugauaucuguauuuuaaugauagcuucuaaacucuaugcuuuuuguuuuauuauacgaggucaauuuuuaugugauguauuugcauguaaaugaauauaaaacuaguauauuaggaguuugggauuuuugaacauuuucagaaugagauauuccacauaaaaaugucugauaauaaauguuacuuuccuaucuaaaccugcccccugcccgaaaccagcuuaucucuuuugcaucaacaauaauauaaauuuguaaauuuauuuuauuugggcuucuuggcuacuuugcaauaagaugcagaauguuguuauaaauaaaggaacuaagaauuauuguaagucgcaaggauuguuuccaaauuggguuuuuuguuugcaaccuguuggcuuccucgguuaacuuaaaaugaauucagguucucucacugacucuucugcccaccucccaucaguguugguauacuccaggaugauaaccucugcugucuuuauucuuacuacaucuacucuuuccuugagugauuucauuuauuuccgugaugucaaccuauaaguuccauggaggcaggacuuuuuuuguuuuuauucacuacuguaauaacucaacaccagaagugugcaugacaugugaguucaguuguuguuaucuauuauuauuauaacuaaaaacagaauucugguuaauuuuguauucguuuuauaauugugaccaauguacuuaaauauucugagcuuuuuguuauuguuaccauggaaggggaaggagaauaauuucacucuuauuggguuuuugcaaggauacaaggaaauauauuuaaaguaccuaauacagagccugguacaauaauagaugauacaaaacuggaagcuuuucauugacucuggcuucuuucuuuucuuacuauauuuggucacugaaucuacccacaucacuacugccuaacacuaccuccauuaccuauaaaauaaaaucuaacuuuccacacuggcauucuccgcauuccuaccuccgccuuauuuucuaccuucuaggcauaaccaauuuugugcauuuuuccccaaauauuccccuuucauacuucuauguuuuuggacaugccguuuucucugcugaaauagcauucucugucuucucuccuuuccucccagucucccuaaacccagucuagugugaucuuuauagacagacaugucacucccuucuuugugacauggacccugacucuccuucucugcaguuagcuuauccuucccuuauaaagggcaacauuauccccugacuuuuacuuacagcauuguacugugaaugcuuguuuauguuucccauaguaggaagaacucucccugaaugcgaacuuggcauuuuguuuuauuuacauuugcuuaggugauuggcacauaauaaagucaguaaauuucuguuaccguauuaaaucuauaccucuuuacauauuuuagacacacugugaauguuuuucacucuacuuauuuguuguauagguccagggcccccuggagcaugauuuuggaaucuucaccauaaacuuaaacuacuguuggcauuuauaccaaaugaaaaagacgccugccacuucgaccuuuaugcucucagggaaaauaaauggcuuuguagacacugcuagaggucacccaguugucaguugucauuucaucuuugucugugacaaguaguaaugggcaccugcaggggaaugugagaaugggaguuuguagcuuucgugucuguugugguagaaugugacaagggaaaagggcaguugaaauggguauugagagaguuaauuguauaguaccuaucacaguuauuucucauuuuguacuggucccagcuaagguggagagauuagucuguuauguaugaaaugaaguaccaguugagccgaaaaucugaaauccgaaauacucccaaaucugaaacuuuuugagcaccaacauaaugcucaagggaaguacucaucaugcauuucagauuuuagauuuucagcuuaaggaugcccaacugguuaaguauauaaugcaaauauuucaaaaugugaaaaaauaaaaaauucgaaacacugcuuguuccaagcauuuuggauauaggauacucaaacuguaaccucaguuuaucaaaagugcuuuauguaucaucuaaagaguaggacacacucaaugaacauuaguuauugcuguaaaauuaugcacucauuauuuguuuacaguuuuugcuacuacuuaaugauucuaaauucugcauauugucuugugcauuuuuaaacugcuuuacugcugauauuagggucuuccacauaauagguaaacaugaguugaaugaauucauucauucauaaaaccuuagaaaaacagcauuuguaagguagguucuuuaaaacuauaggacccauuuaagugcagaaaugauucaaagcaaauauuuagugcuaacauguauuuucuauggcccacuagcucagcugguuagaucaugacuaaugaggucuaggucaugaggucauuugucacaaaguccaauuagcuuugaucuggucuguguggacucaaauuguauccucaacucuagccaauaaugucacaaaugugcacuuuuggucaagagggagaagaugcaucuucaaaaaccuuucauuacuaucaaggauaauuuuugacuaaagguucuguagcaucauuuuuauacuuaauaaggaaaugucauuguguugccaugaaguauacucaaaauuuuagcaacuagcgaccauaaguauuuuuucucaaauaggacuagaaaauuuuuuucagcauaagcuauuuuggucuuucuguaauuuuguagugcugacauuugacuauuauaauuuuugucucuaauguucauuuuagggucuuucuaugacuucuuuuuauuuggcacacuuccauguacguuaggaaagaauauuccauauuauucuguucuaccacacugaauuaacagcaaguuaguguuugaucccugacuuggaucacagucggagucccacuucugugugauaauaaaugcuuuuugcuaaugauacuuccagaagauagggacucugaucuuuaucaugaacuuuugagcacccaguacauggcccuacaaccugugcaugcuuaguaagcucgcuaaugcucuugucaccagcguccccaugucauguagccauaaugcauggggucucacucaagaagugaugacagcucucacagauaugugucgucacuuaugaauauguguaaucauuauaauuugaugauacuaaaauguuuacccgauucucccugugaauauggacaauuacugccagcauaacaggcuuaacaguguggguuagugagugaguguacauuucaauuaaacaacugagacugcuuuacagcacuguguguuggaauagaguaccuuuuugcucaagggagaagguaauuuaauuacuuuugccccuguuuauuuuauccuugcuucuguaggaacccaugcuacaucauuuguguauuuccuugcaguaguuuuuccaagauuucccaaaggcuugaucaucaucuuuauuucuauaaauucuuacuacuuaugauauuuaaucaauuagaauacuaugauuaaaccugcuuggaaacauugcauaccauguagagagaguucauuucaauggaaauuucuugguguagcuaagaaguuuuuuuuuaaaauaaaaugauuuuuuucuucccccacucuuuuuugacucauacuucccccacucgcuccuacaucaugcuagucgaaguggaaacagagacaucaugcuguauuauggucaaauuaagaaaucuuuauuuuaaaggauuuucuuauauaaaccacucuuugaaacuugcccacucuuuagagauaaucaguguuuuaaaaugcaaaaguaugcauuguauggauaucuguucuaguagucuuccuguuuagauuauagauuucucaacuccaguacauaacuucucauaccaugauccauuguacauuagucccuuaagaguucugugguuacacaagcagugaaacacugugugauucaguuucucuugagaacccucaauuccuguuacccuuuuaaaagcucugaaaaguccuauagaaaugcauagaaccagagaauacuuguaccugaguaauaucuaauaaaaucacauguuaugcuuugggaaaugguacacuaauauauauugacauugaauaauuuaaaauccauuuuuaaaguacuauaccuauagucaucucuugaaaaucauguauuaaugcauuuuugaagucaucuaauuauuuucccauacacuuuaaaagauuaauaaggaaccuuaaaaggaauauuucuucaaucucucaaucucuuuucuuccucuauaaguggaaugugaaauuucgauauuugcaggugaaauuaugcuuucuucuuauuauucaaaugcugucuccuuaagagaaaugguuacauggaauucuguaauugagaugcagaggugcuuucuucauuuaugcuucuacguauguacacauucugacugguauaggaguugauuugugaauccacuugccauuuagauuucaguaauuguauaugucugguuacauagaaauuucuuuuggagagaggacugcccuuauguggaaaagaccauggaagggcacccuguucucucucuaauaccuaaaacaauggcccaugaucggugcucaaucuauauuugcugaaugaauuaaauaaaauuggcauuuaaugaugggugaaacaggagccgacuacuugguggcuuuaaguaccagggauaaaaugaaugaaacugaauugagauacugcugaccacaugcuuuucagccccuuccaagcuuacuugcuucuccacauuacaauacaauugcccuuaucaaggucauugaugaccuucaguuguuaaaucuuuuuuuuuuuaauuuuauuauuauuauacuuuaaguuuuaggguacaugugcacaaugugcagguuuguuacauauguauacaugugccaugcuggugugcugcacccauuaacucgucauuuagcauuagguauaucuccuaaugcuaucccucccccaucccccaaccccacaacaguccccagagugugauguuccccuuccuguguccauguguucucauuguucaauucccgccugugagugagaacaugcaguguuugguuuuuugucccugcgauaguuugcugagaaugaugauuuccaguuucauccaugucccuacaaaggacaugaacucaucauuuuuuauggcugcauaguauucuaugguguguaugugccacauuuucuuaauccagucuauuguuguuggacaauuggguugguuccaaguguuugcuauugugaauagugccgcaauaaacauaugugugcaugugucuuuauagcagcaugauuuauaauccuuuggguauguacccaguaaugggauggcugggucaaaugguauuucuaguucuagaucccugaggaaucgccacacugacuuccacaaugguugaacuaguuuacagucucaccaacagaguaaaaguguuucuauuucuccacauccucuccagcaccuguuguuuccugaguuuuuaaggauugccauucuaacuggugugagaugguaucucauugugguuuugauuugcauuucucugauggccagugaugaugagcauuuuuucaugugucuuuuggcuacauaaaugucuucuuucgagaagugucuguucauauccuucgcccacuuuuugaugggguuguuuguuuuuuucuuguaaauuuguuugaguucauugcggauucuggauauuagcccucugucagaugaguagauugcaaagauuuucucccauucuguagguugucuguucacucugaugguaguuucuuuugcugugcagaagcucuuugguuuuauuagaucccauuugucaauuuuggcuuuuguugccauugcuuuugguguuuuagacaugaaguccuugcccaugcuuauguccugaaugguauugcccagguuuucuucuaggguuuuuaugguuuuaggucuaacauuuaagucuuuaauccaucuugaauuaauuuuugcauaagguguaaggaagggauccaguuucagcuuucuacauauggcuagccgguuuucccagcaccauuuauuaaauagggaauccuuuccccauugcuuguuuuugccagguuugucaaagaucagaugguuguagauaugcggcauuauuucugagggcucuguucuguuccguuggucuauaucuuuguuuuggugccaguaccaugcuguuuugguuacuguagccuuguaguauaguuugaagucagguagugugaugccuccagcuuuguucuuuuggcuuaggauugacuugccaaugugggcucuuuuuugguuccauaugaacuuuaaaguaguuuuuuccaauucugugaagaaagucaucgguagcuugauggugauggcauugaaucuauaaauuaccuugggcaguauggccauuuucacgauauugauucuuccuacccaugagcauggaauguucuuccauuuguuuguauccucuuuuauuucauuuuuauuucauucuuaacugaucacuugucucucccccacuagaauguaagcuucaugugggcggggaccugguuuguuugcauccuguucucugucuaauaccuggaacaguggcccaugauaggugcucaaucuauauuuguugaaugaauuaaagauuagcauugaaugaucagugagacaggagcugacuacuugguggcuuuaaguacacagggaaaaaaugaaugaaacugaauugagaugcugauguggcauucacacagcuuucuuauuuguuuuguuguguuuuuuccucuggugaaaaacuuucgagacuuaacguacaugugugugguuacucgguuuuucuuguuuauaaauuuuuaucggugacuucaaaucaaaucuuuuauaaugccauuucugcuaaaauugauuucaguccauauuuauuucccugaccucuguugucagggcaagugacucauauauguacugacuauguauaucuuuuugguaugcuucaaaaaccauuauagcacuggaaauuuugguaauguuaucaugagcaacggccacagaauauaaaauuccuuuuuauaacaguagacuuugggguuuuuuuuuuaaacucaaguaggcuaaaagaauuauuuuauuuuauuuuugaguuggagucuugcucugucgcccaggcuggagugcaguggugcgaucucggcucacugcaaccucugccuuccagguucaagcaauucuccugccucagccuccugaguagcugggacugcagccacacgccaccacgcccggcuaauuuuuguauuuuuuaguagagacaggguuucuucauauuggccacgguggucucgaacuccugaccuugugaucugccugucuuggccucccaaaguguugagauuacaggcgugagccaccgugccuggccuagaauaaauuuuaaaacacuuuuucccuuucguuccugugaaaaucagguuucauaauuguaguaucaacuaguacaaugguucccaaaguguauuccccaggcuagcagcauucacaucaacugagaacuuguuagaaaugccagcuuuuggugcccacuccaguucuacagaauuaagaacuuuaggggugggaccuagcucucuguguugcaacaggcacuccgggugauucugaugcacauuaaaaaugugagaaccacuguucuaccauacagaaauaaagaauuuaaaugcuaaguaaagaugugccgauccuuacaaaauaaucauaggaugguauaaaugauuccaguaugcuguacauugucaacauacauaguaaugaaaauacuacacaugaaggagaaaacucaguaaguuauuacaagaaguauuacugacuuuuaacauuuauucuugcauuuccuccccaguagcuguagcaauggcugaauaaaugcuuuuuguuuuuuacuuuuuguuauagcagaugaaguuagaagaaauaaguaugucuuuugaauauaagugaaagcaaauguuuuauuagugauauucuuuaguguuuauuacuuuauauuuaaccuauucuuuuuuauucuuauguaguaaggggagguuuaauaucaggucacuugaauuccuuucugaaguacuguuuuccuuuuggugucuuccacaaaauagacaugucaucuuucugguguauccucugccuucagucugaugaauauucggauauucagucuugagaauaucuguuuugaaacucauauaaguaaauaaguagugcaugcgguccaggcacagauuuuacauauauauaugcacuuuguugaagauuccaaauaauguagcuacuucuuugcaggguauugguggcccauguaaaaacuccauaauuugaaacuguuuaaggcagagguucuugguuucaagcaacagaaaccaacucuggccuauuuaagacaaagaauuuauugaaagauguuugugacucacagaauuuccaggaagucuggagaaucaagcuggaaacaggcaggcacaagugaugucaggcagcagccagaccaugcacaaaaccguagcacagagauagugcaguacagacaccacaccacugcagccaucccaaagacugucugccauugcuaccccuggguacugaucuuguguccuggcccuacugccacuguaaacaugacaugucucuuacagugugucaccauuuccauugcuuugugccccuagcuccuuguuuagagcaaguccaccugguuauuugaguccuaaguugauuuccuuuagcuuguuuguaagggagguuggaaaagccaguaccuggcuuaaaaauauuugucccugguuuccaaaugcaccucuugugcucucaaacuuuucuaagauauuaaaaaguugcucauucuggcugccuuuaguuauuuccucagucuaguucaaucagacauauaaugcccucacuacacugagcaagcuuccaauaagaucaccucuuauuauuguaucuauuucacagguuccagaaucaucuuacauggcccaucucagucaugggcccugauugcaacuccguuuucucaugguguauuuuuaccucucuggccucaggacuuuguagguugucucucuggcuagaacauugcccuaccuccuccuacccauaaggccuuuaccacuaucccagcccaaaucaaaauccaaacuucuuacaauagucuguaacaguggcuuuuaagcuuuuaaaacuaucauccaccgugagaaaauuaggcguacauuucauacucugguaaguacacacauacauacccaggcauucacacacaaaucauuuauguguauauucucuuacgauaaaaacaaaauuucuaaaaaugauucuuauucucauuaaguguaauaagcacugauguuuucuagucuagucuagucucuuuuuuaaaugcuguugugaccuauuaaaacuaauuucauggcccacuacuggaucauggccugcaguuaagaaaauuguuuacacugcaugcauguuuaguuuuuaccuuccuuaaccucauuucuuucuaacagcuuucucauuuguuauaucuaaaauacuucagacuucuaauuuccuucuaaauaucaggaucuuuccuguguugugugcuauguuaugaguuuuuguacugucuuccuaaaauuuuauucuucuuguuuuccauagggcugacuccuuuucaucuuuuaguuucaaucuaaauaaaaaaucuggcuuucagggauaacauuccuuaacuauccuauuugguaugcucucucuuauuuauucuacuuuuauauuguauuuuuuuuuugcuuucauaggaaugaggaaaacuucuaauuaucuuauuuucuuucuaauuuuugcccacuuucuccuuguguuacguagcccuaauaauaguagaggucaugucuguguuguuccuuuuauucuaggugcuagaauagaugcuuauuaaauauuuguuaaaagaauguaugcagaguagccuaaaagcaauaaaauguuguacccaugugagauaauggucaccauaucuauauucuauccuuauaauacaauuuaugguaugagauuuacaugcuauuuuauuuccuuaauguaucacuuucaugccauugguugauuuuauagugacaagcuuauugguuggaggacauucaacaucuugguaaaauacaaaauaaagaauuuagagauacugaguaucuggaauuguggauaagacaccugaagauaaagaaaacagaaaaaaacugguuauagcuaagauaaauugccauaaucauccuagugaauaaguaaguagggaauauucagggucacccuuagccaagguguaugcuaaggcaugaugggaaacaaauggcacuaaauuacugaauucaaugaaucagaguccugacauuuacauagaaccuuauaauagagucagcuaugaagaagcuucugucggcaaguauacacauaucgauguguucauauucauuacuggauacauaugcagaacaauggaaagauuucucuucugcuauagaaauaauaugacauuauuuucaugacuuagucuaugguaaucaauacagaacaaacaaaaugaacacagcaguaucauuuaaaugugcacagaauugcuuggggauuuaucuauuucaggaauguacaguccagaaauaguuagcugcuuucaaucugauaugccaaaaauugagucguuuucuugaacauauguuuaggaaauuucuggagaaaauagugugcaagcaguaacucauaugaagaauauauucaguauacaauauaaaagaugagcugaucugagauaucagaauuagagagucuauuucuaguaccuaaaaaagaacuguuuauuuuugccguuggugcuucuuuuuuaaaauaaauuuuuaaguauuuauucaggagcuuaaaguauuuagacauggaaaaaaccuuuaggaguuaccuguuacuugugcaugacucuggcuuuggcuccagggacucgaacaaguggguucaugcuugccuucuuaccuuuaagggacaauggcuaagaauauuauuauuauuauuuuauuauuauuauuuuuugagauggaguuucgcucuguugcccaggcuggagugcaguggugugaccucggcucacugcaaccuccaccucccagguucaagcgauucuccugccucagcuucaguagcugggauuacaggugcgugccaccaugccuggcuaauuuuuuguauuuuuuuaguaaagacaaauuucaccguguuugccaggcuggucucgaacuccugaccucaggugauccacccaucucagccucccaaagugcugggauuaugggcaugaaccaccgcgccuggcccagcuaaggauauuauaaucagccuguauuacucaacccaguguuugaaagucucccccauuuccaacugcaaguguauuuuugucaaagccaaauucagacaauuuaucacacuucauuccuuaauauaauucugugcuuuuucucccuaaaaauugcuacucuuuaccccaguguguguuuauagaguagccaaggcuucuccacagucgcacgauggagugauggggauaguuuauggauuaggcacacucuuuagugacuuuaucccuucuccucuucuuuggucauuuuuuagcuuaugaacugacuuugagggcuauauagauauuucauauaucugugaugcauuuuuuugcauuacuguucuuuacugaguauaaugauacaaagagggcaggcccaaaagcugcagugaucccuugggauguuuuucuuaugaugagguagcaacuuccacgaucauagaacaucuaaaauuccaauccgaagugguaaguaucuucugaaauggcccugccuuuuccauggcuucuuuacaauugcaaguacaucaucuacaggccucauucuggguaauaauggagaauaguguagugcuagaaaacaguaaaguaagcuguaaggaaaucucaaauagcaacaggaaguucauauggucccuauuccacuuguuaagcuguuccuuaguaguuguuaacauauaucauugacagauauaaaaaguuauguucuuuuuuuuugacauaaugguugagaauauacauuaaguguagauuccagauccaugauucaucagcucugugcuuuagacuaaguaauucaaccaauccaaacuucaguuauucaccuuguaugcgaaauaggaauuauuaauauaacagcaccuaccucauggaguuuaugaaaauuuaaugagcuaaugccuaaaaagcacauagaauagugucugcugcauaguaaauggucaguaaauauuagcuauauuuagcuauuauuauguuuuauuugagaaaucuacuuacuaguagggggcauccugaaucauccugcuuggaugaugaaaaggaaagggggcaccaugucccgcaucucucaaaguauuuauuguucuauaucuauuuguacagcuuauuugacuauacuuaaauaucaacauuagauugugcuauuuuaagcacaguuaaguggggccacugucauauucgguagacaaaaauuaaaaugaccucauuucucauuuuaucuaaauuugaaaccaacauggcuguuuuauuuuauuaaauaaacauauaaauaaagaaacaaaugagauuuccaguugggaaauauagcagugaugagaagaaugguacguguauuuuaagugacauuuuucuaucuggaaaaaaaaaaaaaaaaacauuuucuaugaauuuguuucuaucaucaccccagacuaaacuuuuuaccuggauuugcuguggcucuuucuggaaagggcucuuuacccaguguggaauacuuucagaacacucuuauuacuuuacuaaaauauauauuguaaauuacaaguauaauuuauaauggauuaaaaguauuuguuuuaaauuaaucaaaaaucuuggaguaguuuagcauaauuucucauguuuuaacaaaauaaaagauuugugauacagaaauuuaugaaacuggcuauuacgucuaccauacuuuuaaauauuuuuauuugcugacugauuagugugccagcuauguaccagcaacuguguuaaguguugagaguacugaugggaguaggaagacuugaggaaauuaacaacacauugagagcuauguuucaggaauucaaaggauguugggaaaguacagaacauaaaacauaacaguccugugaggaguggccauagagggcaaaggaugcagaaaauaauuuugagauaaggugcuuccguugagagcuuaagaaugauuaggacaaaggcagggagguggaauaaaaugaaagggccuuucaggcagaggaauccuuauguagugaagcagaaaggcaagagaaaauggcacuuugucaggaccagaaaaauggucaauaugaugugagugaagagagcauuugauaacauggcuaauaccaagucucgagauuauguaggcacgacccccugaugauuuuuguaaaguggacaagaguuuugaacuuuuucugaaggcaagagagaaucauggaaagguuuuuaagcgguuuuauuuuuauaucugcguuacagaaaauucuccuggcagcaaaguuggagauagauugcaagagcaacugauuagagaagggaaaauccauuagaaggcaauuacagguugaucaucccuaaugcaaaauccaaaaucugaaaugcuccaaaauuugaaaguuuuugagcagcaacauaagauagugacaucuuugcuuucucaugguucaauauauacuaacuuggugucaugcacaaaauuauuuaaaauauuuuauaaaauuaccuucacgcuauguguauaagguguauaugaaacauaauugaauuucauauuuagauauggguccuauccccaagaucucucauuuuauauaugaaaauauuccaaaaucugaaaaaauccaaaauccaaaacacuuguggucccaagcauuguugauaagguauucucagccuguauaauagagaacauuaugaauuaagguaguguguaugauaauggaaaagagaauuggaaaauuauuuagaagauaacauugacaggacucagcaacucaugucagucagagggaagaguaagcaauaauuuccaaagcugaggaugguggugcugcccucuacugagaagcggaaguguggaagaaagaacaagagaggaauggaaucucaucauacguuaaauuuuacacagccucccauauuucaugggaguucugaguagugaugaccacuuggcuguuagaaacccagauuuaauauucuuaaaguauaacuaggaaguaaagagggcagugauaccaacuuauguaagauuguuuacuaagagcauguauaugguaauacaguacuuuaugugguaaaggucuuugaucuaaauaaaaauaagagcucaaaauggaaaacucagaaaaauauuaauauuugaugugcuagaaaaauuggagauuccaaaaggcucuugagagguuaugguaaaaagcaaaaaguggaaaaggagagccauagaaacuaagggacaaaaaagguuaagacauccaggcuuuaagauauauauaagacagaucugaaaacauauacaccaaacucucaggaauggcuagcuuuaggagguggcguugaagauaauagcaaaagaacugggaauuucaauuuuguauuugaauguuuaaaaccuguucuauauauauuauaacuucuugagaacuuaguauuuuaaaauaaaaaguuaaaaagauccucuuaaaauugaaguuauagucaauugaaaauaaaaauagaugaaucaaauaagcuuaaucagaacagaaaagggagggaaggguaacauggaguggccaacagugucauacuauagauaggucacaagagauaaggacugacaggagucuuuuagcuugguauuuagcuguggucacaagugaccuuauuaaaagcaguucuaaugaaaggcuaagggcagaagcuugacuguaguuguuggaaaguggaaagugaggacaugaagaguuagaauagucaucuuauaaaggaggagcuuaagugugaagggaaagagagauauggggagggacuuaggguccagggugaguaaacuauuugcuuaagauccuuauggagguaagaaagagauccaugauagcuccuuuagucauggagguuuauuggaugucacccaggaauguuaaguagucugaguauuagcuaaguaggagcuaagucaacuacucacacuacuccuacuuauuccagguuccagcuuuucuaaaacugggauuuguaguacauuuuauaagcaauugaaguuguucagcaagauuucuuggagggaagagaccugagcuuauuuauaugcuggagauaggcaccaggagagggcaaaaucucuguaguacagaaacuaguugagguacuuauuuaaaugaguggccccuuaauuugaaaaguaaaucgaacuguuucugggaaugaaguuuuguacaaaaugcgaaacuugccauguugcaaaggcuaagccaaccaauauauuucaauuacauucauauuagaaaaaaauuaauaagaugacauaaauaagcuaguaaauuucuuuuuucuucuucuucuaaagccgaacaacaacguauccuuacacagagacacagauguacagccaaaauacuggagggaauuacuuugauacucaagggaguuccgcccaggugacuaccguggucucaucccacaguauggugggcacuggugggauucagaugggcgucacaggaggacaacucaucagcagcucuggaggaaccuaucugaucggcaacucaauggagaauucuggucacucagugacacacacaacucgggccuccccagcgacaguaaguauuugaauuuuuaguaguuuaguuuagcuuuuaauagucucuaaugaacauuuccuuugauagagggaaaagaacaacacagaugggacuggggcaagaauguguuggauaguuuuaguauugagaguuugcagaauguaguauauguaguauuaugcagaauguuacugauacauaugcccucuaaucaggugaauuagaguuuuuaauuuuacuggcaauuagaaaggugaguuuuacucauuaaacugcuggcuuuaauaagcugucuuccaucaguaaaauaucuuaaauuuauauagaaagaacucacuuucauauuaugcuuacuuuaugagauaaaagccaggcaguaauacagagaauaaaauauaauuuagcuuggaauuuucacaucuuucaacaauaauauuuaugcuagcucaugcccagagaaguuauauuauguaagccagcaucccaaaccuuagacauguaaguuuugccauuuucucaugccaccuguauuauuauuaacuuaauauguuuuccaaguugacucacuuuuaaaauagaaaaucguguguaauuuuuuccuaauacauauugaaaucaauauuuaaauaguaaaguuaaaaauguuuacccaugugccauauguaaauucguguugcauuccaccagagagauacuuuagaaagcauuacuauaggugauucagaugaaaaauauuuguguuggcucugaucauagauaugagcaaacaguaucuuaggagcauacauauuuaaguuaaauuuaauagauuauuuuaacacaguggguuauuguuuggugguuuuuuguuuuuuuuuuuuuuuuuuuuugagaugaagucuuacucuguggcccaggcuggagugcaauagugcaaucucagcucacugcaaccucugccuucuggguucaagugauucuccugccucagccucccagguagcugggacuacagccacaugccaccaugccuggcuaauuuuuguauuuuuuaguagagauggaguuucaccauguuggccaggcuggucucgaacuccugaccuucgguaacccacccuccucagccucccaaagugcugggauuacaggcaugugagccacugagcccggccaacacaauguauuuuagcguacugaaaugauguaauagaaauagucauagaaaauuuugcagaauuugauaucaucaaacuuuguagccugaacuucugcuuuucaccucuacuaagcauaugagaauggucauuuagaaccacauagcuaaagcagcaaugaaauagauuuucuagguauuacauauaaaagggugcuggggauuugaauuaaggagauguaucccauuuuaucauuucaucauauaguuuguucuugcaaugaaauagagauagaaauaaauuggggagaaaauaguaauaugagaagcuuuauauuucucauuuuauggauuuucuccaggauauuauaugugcuugguaaguacuuuguauauacuuuguguauuuguaguaauuucauguguuccuacuuucaucauucagugccuuuucccuaauuuauuuuuaaaaaacucuuuauuuuaauucgcuauuuguuacuaacaucagaacagaugacuagcuguucugagcggagaguuccuuuuuguaauuuuuuucuuuguaauuuugaagcauuucuuauguguauuuguugucucuuccuuuuaauaauauuaaauacaguauuuuaaaccuuuuagucacaucaguauauuuauguagauuacaaggggauugcuacuaauaaaccauagcuuuucuggaucucaguuccccuaucaauaaaauaagggguuaguuagacuaaaugauuuccuaguuuccuccuagcuuuagcaccauuagauuuacaaaggaauuauaaaauauucuaaauguaaaaguaacuauagcuucaacauaaaaagaaaagagauagaaaaugguggcaguaguauauagcacuccuccuauaggccaccuagaaaauuauuuucagugaaaggaaaauaccacuuaucaaggccuuaggaaaacugaaaaacggggcaaaauuuaccuuucccacuuucauuucauccacccugucuuauccuaaccuaccauccuucgaaaccccauuccuuuccuaccucaccucuucuagguauuccuacuugccuucaugcugauucugauaccuguuuaacauccucaucaacuggguguggguuuacuaaauuuacuugcucucucacuaaauuaaccaaauuguuuaauccagcucauguaaauacaguugcauugcuaaccuuuauaguuugaggauucuucuucuauuuuuuuuuugauaagguauacacuuucuauguagguauguauguaugaaagguggcauuauuccuuaaguuauccauuauacaaauuugaugugugauuuuuauuauacuaacugguaaauuaaacagauaacugaauuauaaaaacugggaauaguugaaaacuguuacaaaacaccaauuuauaauaucaguuguacauauuaauuuuauacuaaaaauauucauauuugagguuguuuuguuaaggauaaaaauucuaaggugauuuuuuuuuguuuugcguuuuuuuaaauaagaaaauuuuccuuuuuaacaaaaggaguauaaaaauuaaaaaaaaaguaacuuuuguauggaaaaaucacaaagugaucucaccaagcccauauugauugauagugcgguacuugucuaaauauacuucugcuaguguuuauuguauuaccuugaauugauuauugaaaaguauauuuaauuuaaauccccgucucaauuguacugaagaucugcuugacucacagugagguugugauucucaguuuacaguuucacaucuguuacuguaguaaaauuaacaaaguugaagugccgugaaaccuauuuaagauuucauaucaugugccucuugccaaaugugagaaaugcuaaccauagauuuuugauuguuuucacuccuaaaaaucaagauuuuuuuuuuuaggagaugccaugccauuaaaugggauuuaauugaguuuauguauauuuuucuuuuacuguagaaucagagaaaagauuguauaugaacacaaucuuuaaagauuuguuggucaagacucaagccauuucuuuccaaacauugagccuaucuguaccauauaaguucaguuuuucucacuguucuuuaguguucgacauauaaccuauagaaugacugaugcagccuacugugcaauaguagcauauacuguggccgaaauucuugacugagaaauaguccguugggucacuccuuagggggcuaucaguaaguguaaugcauagucaauuaauucaguugauguaaaacuagcuauguuuggguacuuggaaacagcacaaagcaaacacuguuacccaguuccuauggcaaaguuuucugcuccaguccuuagaauaguugccuugaugugauaauugccagugauagacuggauaaagaaaauaugguacauauacaccauggaauacuaugcacccguaacaaagaacgagaucauguccuuugcaggaacauggauggugcuggaggccauuuuccuuagcaaacuaaugcaggaacagaaaaccaaauacugcauguucucacuuguaaguggaagcuaaaugaugagaauacauggacacauagaggggaacagcacacacugggcuuuagaggaggguagaggguggcaggagggagaggaucaggaaaaauaaugaauaauaggcuuaauaccuaggugaugaaauaauugguacaauaaauccccaugccacacauuuacuuauguaacaaaccugcccauccugcacaaauaccccugaacuuaaaauaaaaguuuauaaagucagcauuuguuaauuugguaacaaauuaaauuuuauaugaugaauauauuauaucaacuacuaauacucaaauuuagucaaaauacuauuucuccuuugauuuacuguuuccuuuuauaugguccauguguguauaauuauauauauguauauagauauauacaucuaugcuuuuacuuauauaaauacauacacauacauuuaaaaggcauuuccugcggauaauauuaaauagcaauuuucagaaagauguuauaacauuuuuauugaaucaucacuggauauggguucagcuaaguugcgaccugaauauguuagggaucuguuuauuguuaauauuucaguagcacauggacauuaagguagaagaauuggcuacagucauaauucugaacucauuauacaucugucuucuaacuauaucaacauaauauuucccucugcuuuuauucauuugaaauucuaaguauuuucaugauuauuuuucuauauaaucacaucauuuauagaauuuuagaguuuuggaaccugaacauacuuuucacuugaagauuaaaaauuugugaauguaguuagugauuuuuuuuggugcucaucacaacauaauuuaucuuauaccagaguaugcaauaauuaccaacuugcuuuaaaaagccuuauuuacucacucuuacauaaaauaauauuuuuauucuuauaauuagaugguuauguaugaguuuuuuaaauucuucuuaauacuuaagauuacauuaaucauuuuugagaccgugauaugaaaguuaauuuuuacaccuuuauguauauacauuuaaaugggcuguugcuaacauuagaucccagccaagaggcacaagaaaaauaucuugaaauuaauauuguucauauucccaccucuuuugauuaauguaaaauauuauaauuuauuuaauuauuuggaggaaaauuugaaaguccaucugcugcuauauaaguaaaaguuuggccuaguuuauauaauuaauagaaaguuaagaauucauuuaagaauuaugagugcuuuuauuuauuuauucuugguuuggcauguuuaugaauuugguguaagggaaugcuuuuucuaagaguauaaauauguuuagcucuucaaaauaauuuuaccuucuuauucuuuugcugcuacguuaccaauggccauguguuugauuucaaaauuuuaauuuauuuauacgaauuaguuauacauucuuaaguugcacauucaaaagauauaagaaaguacaugagucucucucacccguuucccaauucucauccuuagaggcaaccaguauuaccaaguucucucuuauuuuuuuauuuauugauuuuugauuuuuuuugagauggagucucacucugccacccaggcuggagugcaguggcgugaucucggcucacugcaaccuccaccucccguguucaagcgauucucccaccucagccuuccuuguagcugggauuacagguguccgccaccaugcuuggcuaauuuuuuguauuuuuaguagagacgguguuucaccauguuugccacacuggucucaaacuccugaccucaggugaucugcccgccucagccucccaaagugcugggauuacaggcaugagccaccacucccugccaccaaguuuuuuaaguauuauucuaacaauauucuagcagaauauucaagcagaauauauauuuuuucacucccucucucuuuuuuuuuuuuuuacacaaaugguaagaaaaaugccgcaucuugcuuuuuuucaccuaacaauaugucuuggagacuuuuuguuucauauuagcacacgaagaacucccuuauauuuaagggaaaugauuauauuagaaggagcugaauugcccaucuaucuuaccagaggaaaaaauguugaaauaauauuggauuauugguuaugacuacaucgagacagaaaagcaauauaguuacaugagaugaacgcuucuguuuaauuaucauauaugaagauaugcuuagaagaaauuuuaaguuagaaguaugcauaaauuaugcauaaaucacaguucuuauuuuaugugacaaaacaguaauuucuauuuaaaauaauuuacuaaguuuuacaguuagccucaauauuuuuuaaaaaaagacucuguccacuuauuuuggcaggaacauguaucaccauuaugaucuuagcuuuuucuguuuuccugugucccuuuuucccuaggccaacucagucccugaaaugaaacuccucagacagauuaccaugaaccgucuguuuccuacacuaaaucauaaauugacugaagguucugggccucauuuucaaagcauuuaauaaaaugggacuuugaaugacuuguagucuccaucacuucaucuguauuccauucagcugucagucaguuccacacugcuccagccucgaagcugauaagaucuagaggcaguaauuuuaccauuagggcuguaagacauuccacuccuagaaaucuugauaaacuagcagguuaagacaaagagaaucacagcauccuucauucucuccugagcauagccagugaauuccucugaauuuuaaagcaaaauauaaugaauuauuuuauuuuuuagcuacuucauauuugaaacagcauuucagaacacagguguauggguaacaugccagaaaaagcuagauucuaugucauacaagaucuagauaagcaaaguuuaaugaugcucauaaauucuacuuauaaauauuaaaguaaccuguaccucaggcaaccucuuauauaucuuuugcuugauccuuccuuagauuuacaagucaaguuucacguuaaguuacuuguuugaaacuaacauaauuuuuaaagaaaaaaacuccaccaacuuaaugcuucacuuauaaaaauuagauaauccagauaaaauaugaaaugcauugcuacagauuaaaauauuaauacauuguagucuaagagugacauaugagucaauauuagacucagaaaguuucaauacugccucuucuacuggcccauguguuuaauuuaaaggggaaaaauacgacacagugccuaugaccaauugucaguucucugagaaagaauuucuccauguuccugugcauauuaguucaucccccaaagcaugugauuugauuaccacuuucucaguacauguaacuccaguuguugucuuuauuugccacagaauuaucugguuuccuuuaaacucuaauuauggcauuugauuguaacuauugguggcaguaaauuucaugacauaggaguuuuguaaucuacggacuuagaaauaauuuuacacauacacuuaaaauuuacuaaguguaaguuugagugacuuuuucaucugucuuauaggaaaggaagaugugauguuuaauugugcuuucaaaauuacaggaaagaugcaguuaggcaaaagaaaggaaauacaaauucaaagggagguaaagaggucagaacuuguagaugaugugauuguguacuugauaaaaaucauagagaaugaaauuaaaaacuauaacaacuaauaagacauuuuaguaagguggcaguacaauuuuuuuuucuuucgagauggagucucacucugucacccaggcuggagugcaguggcacaaucucagcucacuguaaccuccaccuccuggguucaagcgauucuccuaucucagccucccuaguaacugggauuacagguaccugccaccaaacccagcuaaucuuuuguauuuuuaguggagacaggguuucaucauguuggcuggguuggucuugaacuccugaccucaagugauccaccugccucggccucccaaagugcugggauuacaggccugagccaccgcacccagccacaaaauuaauacacaaauaaaucaauagcuuuucuagauaguuagaaaauauaauggaaacaaagaucucauuuauaauaaaaacaaaaaaugccuggcaacaaacuaauaauaagugugcaagauccaauugcugaauaaaaaacaccuaaaguucgccagggauacaaaaggaaacuugaauaacuggaaaggcauaccauauucuuggauaagaaauuucaauauuaaacauuuaaccucccuaaguuaacauaaaauguuucaacauaaucucaaucauaauaccaauaguuuuuuugacaagaaaggcuguucauguaaauaaacuugcaagaauuuauagaaaauuuuguaaaaagaaaaauaaugagggaugggguggagggaaacaaccuaucagauauuaaaauguauauaaaauuauaauaauuaaaacaauuaucuaagcacaugaauagacuaguaaaugaaagacuagagaccaaguaggccaaaugcaugcaggaauauuguauauauuaaaggaggcauugccugugaguugagaagucauggauuaucaguaaaugauauuuggaacaacugaauauuuauauauuuauaaaagaaaauuagauugguucauauauuagucuuuauaucaaaauuaauuucacuuggauagaaaaguguguuuuaucauuagagugggaagcauaauauaaaauccagaagcuauaagaaaaauauugauaaacucaguuauguaaaggugaaaacauccugcugagaaaaccacaauaaacaaaggcaauggugaaacaacaaacuggcauaaaguuuugagguauuauacucaaaggacuaauuuuuuaaauuuauagaccacucuuacaaauucaucagaaaaaauaacaaaaacagagcaaguacaagaacaggcaguccaaugaaaaggaagugaaaaauaaacuacaaagaaauaccaccuuucaucccauacaagcaaugcggaagagguugguaagccuugccaagugugcaaggaaauagguacucucaaucaugauugaugggaaucuaaauuggcacagaauuggagagcaauguggaaauuuuuuaucaaaauuaaaaauacacauauccucugacucagucagugugcuuccgggaauuuaccauacugauaauacuguuauguauaugaaaugcuacauaaaaacuauauuuguuguagacuuauuuguaauagaaaaagauuggggucgggggcgguggcucacguguguaaucccagcaguuugggagccugaggcggguggaucaccugaggucaggaguucgagaccagccugaccaacauggugaaaaccccaucuccacuaaaaauagaaaaauuagcuggguuugguggcacaugccuguaaucucagcuacuugggaggcugaggcaggagaaucgcuuugaaccuaggagguggaguuugcagugggccaagaucacgccauuguacuccagccuaggcaacagagacucugucucaaaaaagaaaaagacuggaaacugccuuauccaucagcagggaaauaugcaaauaaacguuaguacuuuuaucucuuaaguggaauuacauguagccccuagauaaugaggcuauauauauauauauauauauauauauauauauauauauauaugcuauguagcaugcauuauauguauauauaggcacauauguguguguauguauguauauauaugcacacacacauauguacacauuuauaugaaaaaagucuccauguugagcgaaaaagcagaguaguguguguguguguaaauagaaacacauauuacuaugugcuuauauaagauauccuaaaguuuuuuuuuuuguuuuuuuuuauggagggggugggacagucuugcugugucaccuaggcuggaacgcggugguuugaucucggcucacugcaaccucugacucccagguucaagugauucuccugccucauccucccaaguagcugaguacaggcaugcgccaccacacccggcuagcuuuuguaauuuuugguagacaugggguuucccuguuuuggccaggcuggucucaaacuccuggccucaagugauccgccugccucagcuucccaaagugcugggacuacaggcgugagccaccacgcccagccaauccuaaagaugucuuuaggaaggauacaugaagaauaaaaggugggaggcaugugaauauauuaucuauuaaaaaaaagaagucacuuguuauuuuuaaaaauuuuggacaagcucuuaaugauuauacauuauaucuauuuggucauauuccccaaaugcauguagauaaagcaaauccuuuaugugcccaguauuaauauugucugugaggugucacaguucacauuaaacccugauccuagguuucagauaaaguccucauuuauuagacuguugaaaguuuagacagugaaaacuggcauuuaauucauuugaaauuuuuagagccauucuuacuguucaacauuuuggaaugaaaguugauguuuguauuuguauuuauguauugagaaucugaguuuuuuuuuuuuuuucggucacugacuuucucaaacauuuauugagguauuacuguugaccaggcacugugcuucugugaauuugaagacuuaacaguaugggcuaauggagcuaguuccugcacugaaagguaccuaauccuguaaggcaaaaauacaaauucacaaauagccuccagacuucuuuuuaggguuaguuucaacuacuuucuugccacauuauuuuuuaaaucacaaauguucauauguuaucaauugauuaauuuuagauuuaucaaaauugugcuuaccuucugauaauauugcuuauacaaguucaaaauugccuaaagauugggcaggauuggauagcaagagagugaaagagaaucaugaaugcaaauaauacuuaagauugcagaaucacccuuuaauuagaguuaacuggcaccauugugggaauguccguuaccuaccuauuuauauucccuuaaguagucauugcagucugacucuggcaaugaaaaaaaaaaagaucauguuuuagugaaacuguuuucaaacuugagugugcauccucuggagcauugauuaaaacacaucucuggaucucaccccaaugacuuucgauucagucagugugggcaagggccccuugcauuuccaacaagugcccaggggauacugaaaaugcugguccaagaccacacuuuaaaagccuguuuuagugauuacggagacuaacuacaaagugaaaauguucuuauacucagaauaaacugcaaaaugcagagaccauuugaaaauguaagauggaguuuaaauccuauuauuuaauucuaacccagcaaauuucugagggguaauuccaacucccaagugcuuuuguacuugaugucucagaaacuaguuuuaucgucacagacucauaggcuucuagugagggugggggaaucugggcuccacagaauaaucaaagaaguccaaaaagacaaucuugauuucaacccagcaucccaaaauaagccaaauguucucagaacacauucaauuuauaagguuucuuaggcaaccguuuuucuccccgcuaugaaaauguuaagaauaacuucagguuacaacuuugguacaaaauugccaaaauuucagguugaaagcauaauaacuuaauuuuuuucucuagacgucauaaaauuaucagugaauagaaaggaaaagauuucauguauuugaacauuuauaaaaccuuagaaaagauuuugucuuuagcuacuuucugguuaaagaggacaugaaaagccaagcuggcuagauuugcuuucugggcuuuuuuuuuuuuuuaauuuuaauuuuaauuuuuuaauuauuauuuuacuuuaauuucuaggguacaugugcacaacguacauguuucuuacauauguauacaugugccauguuggugugcugcacccguuaacucgucauuuacauuagguauaucuccuaaugcuaucccuccccgcucccuccaccccacagcagugcccggagugugauguuccccuuccuguguccauguguucucauuguucaguucccaccuaugagugagaacaugugguguuuggauuucuguccuugcacuaguuugcucagaaugaugguuucuagcuucauccaugucucuacaaaggacaugaacucauccuuuuuuaugguugcauaguauuccaugguguauaugugccacauuuucuuaauccagucuaucacugauggacauuuggguugguuccaagacuuugcuauugugaauagugcugcaguaaacauacgugugcaugugucuuuauagcagcaugauuuauacuccuuuggguacguacccaguaaugggauggcugggucaaaugguauuucuaguucuagaucccugaggaaucgccacacugucuuucacaaugguuaaacuagcuuacagucccaccaacaguguaaaaguguuccuauuucuccacauccucuccagcaccuguuguuuccugacuuuuuaaugaucgccauucuaacuggugugagaugguuaucucauugugguuaugauuugcauuucucugauggccagugaugaugagcauuuuuucaugugucuauuggcugcauaaaugucuucuuuugagaagugucuguucauauccuuugcccacuuuuugaugggguuguuugauuuugucuuguaaauuuguuuuaaguucuuuguagauucuggauauuagcccuuugucagauggguagauuguaaaaauuuucucccauucuguagguugucuguucacucugaugguaguuucuuuugcugugcagaagcucuuuaguuuuauuagaacccauuugucaauuuuggcuuuuguugccauugcuuuugguguuuuagucaugaaguccuugcccaugccuauguccugaaugguauugccuagguuuucuucuagggcuuuuacaguuuuaggucuaacauuuaagucuuuaauccaucuugaauuaauuuuugcauaagguguaaggaagagauccaguuucagcuuucuacauguggcuagccaguuuucccagcaccauuuauuaaauagggaauccuuuccccauuucuugcuuuugucaaauuugucaaagaucagaugguuauagaugugugguauuauuucugagggcucuauucuguuccauuggucuauaucucuguuuugguuccaguaccaugcuguuuugguuacuguagccuuguaguauaguuugaagucagguagcaugaugccuccagcuuuguucuuuuggcuuaggauugucugggcaaugcgggcucuuuuuugguuccauaugaacuuuaaaguaguuuuuuccaauucugugaagaaagucaguaguaguuugauggggauggcauugaaucuauaaauuaccuugggcaguauggccauuuucacgauauugauucuuccuauccaugguuauggaauauucuuccauuuauuugugucuucuuuuauuucguugagcaguaguuuguaguucuccuugaagagguccuucacaucccuuauaaguuggauuccuagguauuuuauucucuuugaugcaauugugaaugggaguucauucaugauuuggcucucugucauugguguauaggaaugcuugugauuuuugcacauugauuuuguagccugagacuuugcugaaguugcuuaucagcuuaaggagauuuugggcugagacaaugggguuuucuaaauauacaaucaugucaucugcaaacagggacaauuugacuuccucuuuuccuaauugaauacucuuuauuucuuucucuugccugauugccauggccagaacuuccaacacuauguugaauaggagcggugagagaggguaucccugucuugugccaguuuucaaagggaaugauuccaguuuuugcccauucaguaugauauucguuguggguuugucauaaauagcucuuauuauuuugagauacgucccaucaauaccuaguuuauugagauuuuuuagcaugaagggccauugaauuuugucaaaggcguuuucugcaucuauugagauaaucauaugguuuuugucuuugguucuuuuuauaugcuggauuacguuuauugauuugcauauguugaaccagccuugcaucccagggaugaagccaacuugauagugguagauaggguuuuagauguacugcuggauucaguuugccaauauuuuauugaggauuuuugcaucgauguucaucagcgauauugaucuaaaauucuuuuuuuuuauugugucccugccagccuuugguaucaggaugauguuggccucauaaaaugaauuagggaggauucccucuuuuucuauugauuggaauaguuucagaaggaaugguaccagcuccucuuuguaccucuaguagaauucggcugugacucugucugguccuggacuuuuuuugguugguaggcuauuaguuauugccucaauuucggaaccuguuauuggucuauucagggauuuaacuucuuccugauuuagucuugggaggguguauguguccaggaauuuauccauuucuucuagauuuucuaguuuauuugcauagugguguuuauaguauuuucugaugguaguuuguauuucuaugagaucgguggugauauccccuuuaucauuuuuuauugcaucuaucugauucuugucucuuuucuucuuuauuagucuugcuagcagucuaucaauuuuguugaucuuuucaaaaagccagcuccuggauucauugauuuuuugaaggguuuuuuugugugucuaucuccuucaguucugcucugaucuuaguuauuucuugccuucugcuagcuuuugaauguguuuguucuugcuucucuaguucuuuuaauugugauguuagggugucaauuuuagaucuuuccugcuuucucuugugggcauuuagugcuauaaauuucucucuacacacugcuuuaaauguguccuagagguucugguauguugugucuuuguucucauugguuucaaagaauaccuuuauuucugccuucauuucguauguacccaguagucauucaggagcagguuguucaguuuccauguaguugagcaguuuugagugaguuucuuaauccugaguucuaguuugauugcacuguggucugagagacaguuuguuauaauuucuguucuuuuacauuugcugaggagugcuuuacuuccaacuauguggucaauuuuggaauaagugugaugugaugcugagaagaauguauauucuguugauuugggguggagaguucuguagaugucuauuaggucugcuuggugcagagcugaguucaauuccuggauauccuuguuaacuuucugucucguugaucugucuaauguugacaguggggugcuaaagucucccauuauuauuguguggaugucuaagucucuuuguaggucucuaaggacuugcuuuaugaaucugggugcuccuauuuugggugcauauauauuuaggauaguuagcccuucuuguugaauugaucucuuuaccauuauguaauggcccuguuugucucuuuuggucuuugugguuuaaagucuguuuuaucagagacuagaauugcaaccccugcuuuuuuuuuuguuuuccauuugcuugguagaucuuccuucaucccuuuauuuugagccuaugugugucucuguacaugagaugguucuccugaauacagcacgcugaugggucuugagucuuuauccaauuugccagucugugucuuuuaacuggggcauuuggcccauuuacauuuaagguuaauauaguuaugugugaauuugauccugucauuaugauguuagcugguuauuuugcucguuaguugaugcaguuucuuccuagcaucgauggucuuuacaaucuggcauguuuuugcaguggcugguaccaguuauuuguuuccauguucagugcuuccuucagcagcucuuguaaggcaggccugguggugacaaagucucucagcauuugcuugucuguaauggauuuuuuuucucuuucacuuaugaagcuuaguuuggcuggauaugaaauucugguuugaaaauucuuuucuuuaagaauguuaaauauuggcccccacugucuucuggcuuguagaguuucugccaagagauccgcuguuagucugaugggcuucccuuuguggguaacccgaccuuucucucuggcugcccuuaauauuuuuuccuuuguuucaacuuuggugaaucugacaauuaugugucuuggaguuguucuucucgaggaguaucuuuguggcguucucuguauuuccugaauuugaauguuggccugccucguucaauuggggaaguucuccuggauaauauccgaagagugcuuuccaacuugguuccauucuccccaucacuuucagguacaccaaucagacguagauuugcucuuuucacauagucccauauuucuuggaggcuuuguucguuucuuuuuacucuguuuuuucuaaacuucucuucucgcuucacuucauucauuugaucuucagucacugauacccuuucuuccacuuaaucaaaucggcuacugaagcuugugcauccuucacguaguucucaugccaugguuuucagcuccaucaggucauuuaaggauuucucuagacuguuuauucuaguuagccauucgucuaaucuuuuuucaagguuuuuagcuucuuugugauggguucgaacauccuccuuuagcucagagaaguuuguuauugccgaucgucugaagucuucuucucucaacucgucaaaauuauucuccauccagcuuuguuccguugcuggcggggagcugcguuccuuuggaggagaagaagcacuuugauuuuuagaauuuucagcuuuucugcucugguuucuccccaucuuugugguuuuaucuaccuuuggucuuuguugauggugacuuacagauggaguuuugguguggacguccuuucuguuuguuaguuuuccuucuaacagucaggacccucagcugcaggucuguuggaguuugcuggagguccauuccagacccuguuuguuuggguaucaccaguggagucugcagaacagcaaauauugcagaacggcagauguugcugccugauuguuccucuggaagcuucgucucagaggagcaccuggcuguaugaggugucagucggccccuacugggaagugucucucaguuacgcuacuugguggucagggacccacuugaggaggcaaucuguccguucuuagaucuuaaauucugugcugggagaaccacuacucucuucaaagcugucagacagggacauuuaagucugcagaaguuucugcugccuuuuguucagcuaugcccugcccacagaaguggagucuacagaggcaggcaggccuccuugaucugcggugggcuccaccaaguuggagcuuccaggccgcuuuguuuaccuacucaaaccuaagcaauggcggacgccccucucccagccucacugccaccuugcaguucaaucucagacuggugugcuagcagugagcgaggcuccaugggcgugggacccccugagccaggcaugagauauaaucuccuggugugcuguuugcucaguuggaaaugcagaaaucacccgucuucugcguugcucacaaugggagcugcagacuggagcuguuccuauucggccaucuuggaaccucaaucccccugcuuuuuuuuuuuuuuuaauugaggauuaaaagaacaguuuaucccgaaucucucaguuaagcuacuucuugacauugcuguggaaguaauguauuugcauauuguuugaauauacagcuuuuaacaguacauagcuggaaccuuagcuugauugaugguguuucuguauauaucugcugggucugcagagcucaaggaacacucuggagauccuucgaagaagguuuccauugacuagaugggaacugauacuguuucagcugcuuauuacaggguauuugaaguuuuaaagccacaaacuacaaugagaaauaccuuuacauuguggcccaauacucacucauauguacauacauauauucaugagugcacaucuacauacaaacaugugacuauguauauacauguacauguauacauaugacugaaacuaaaguuucaugaagcaauacuuauccauacugugugcaguuaacucugguuauuuucuacucuauucaguuagguuuuuagaaaugcuggucaguaccuacauuauuaauucuguaacccauuaguugcaccuuacauucugaaaaacacugcuuugggcaaaugaaacaggagguuagagcauuuacaauacauguaugaaaggccuggggacagagucuccauuguagagguuuguuuuguuuggcauuucuuuuuugggggaguaggggggugggcagagucuugcucuguugcccaggcuggcuugcaguggugcaaucuuggcucacuggaaccucugccucccagauucaagcgauuguccugccucagccucccgaguagcugggauaacaggcgcccacccacacccagcuaauuuuuuauauuuuuaguagagaugagguuuugccauguuggccaggcuggucuugaacuccuaaccucaggugauccaccugucuuggccucccaaagugcugggauuacaggugagagccaccacgcccggucuuguuuagcauuucuaacagguacccaaaugauuuugauacugcugguucaggaccacauuuugaacaaccgcaauuuuagugauuauagagacuaaaugcaaaagggaaguguucuuucuuuuguuguuccugguugaauggcuuccuauaggauguacccuccucuucacacacaccaggaggcugucauuucacacaggugugagugguggcuacaugcugaugccagccaucacaauucccuuuucuaaacauaagucuccaaguagaaauguucugucuuaccugaucucaagaugcaaaccagguagaaauguuuuugucuuaccugauuucaaauacaaacaaaauuuaaaguccugaagaucagaagagaaauuacccagaaagaaauuccugguuuuaaguguauccucuucauuaaguuucucuaaaaaauuuacaguuuucacaggaaaacagaaaugcuaugucucugagaaaguacucacugaugauguuaacagaguaacuuguauuaacaagaaaaugcaauuguuauacauuagguaacuguuuuuauaauuaaaauuuaacuaucuaguuaaaacuuuuuauugccuaguaacuucaucauuuuacaucauuuuugaguaacguuuaucgaucauauuuaaauuuuuccaguuagaaaguaaauuguuaacaguaaaucauuuagcaaauuuugauuuuauaagccacucacuccucagaagauaacuucauuacaacaauuugaaauauuuccacuuuguuuauauucauuuuauauuuguauaugauggcaaugauguugaauuuaagcaugauaaaucuuggauuucaauuucauaguuaauacccaagaaaguucuacacaucucaagaaaauccaucaaucccacauagucucagguuucuaaucuguuaaaaaggagauaauauuccuuaccuuuacuauuuuacaaaguuguugugaagauaaagugagaauuaauauagaaacccuuuauaauucauaaagcauuguacuauuccauuuucaaaucacuguaacaguucuagaaaagaaaguuucuaccaugaaaccaauuuuaauuacagugauaguugaauauaucaauauugaccuuuacucuuuuaacaaaagauuaaaaagccauuucagagucgagagaacaugccuugaccuauaaagacaauaaauaagaugauauaauuguucuuuuucuuccugccuuauuagcauauaagggaaugacagguuaauauuuacauuaagagagaguucuaauuguccguauauaugauauucuguuugggacauugcauagauguguauguaaccaacauguccaggggagccucuuuugguuccauguaaaucauacaaaagacucaacaccucuucccauuuugcugcauuucaaacugagguuuaccuucuuggcauuaucaacugccccuaaaugaucccugugcuccagccagucucgauuacuuguacuagaagcaucugcaaguggcauagguuuuacugaagauuuugcaggggaaagcacuguucaggaucacacccucuaaaagacggucacacaaagccucuuuuguaccaccuuguucuccccacucuguccuuuuauucugccagugauccuccaccuucagucuuuccaggucugggaucauuccgucuccucuaaaucucagaaucucucaaugcuccagugaacacuuaaaccugagagcaacucugcaaaacaaagggccauccuaugagaaggacucuccuuuagaaggcaauggggacuuaaaauagggaaaaugcauucccuuauaauaggaaaaauauguucccuuauaauagggaaaauguguuuuuucuuuucuauuacauuuuucuuuucacaauauguauugccuuugaaaaaauguaauauugaucccuucuuugaacaugggaagagaacacaagcacaacguuuauuggacaucauuugacccucuccuccccacccccauucucuuuucccccuggcuuagguuaagacuuuucuccaaaaucucuuuuuugaugcugauuuuuggacagauguggcacaagccucaggguggcucuugaaugcuuggagacugucugccuguccuucauuccaacaaggcagcauuagcaucuuggugauuggggaaguuuucagccugaguuuuaggccacggauuuauugcacugucucugucucccaggagauaauaggugcccuguacccuacagguucuuccuagaaggguugcuauaucuuuguuggagcuccacuaaucuuuguguuuuuucucccuggugugaaauacgacaucucccuugcccuuucugaauuccuaauccuaauuccugagaaaucauggaaguucccuucacugcuguagucugucacaaaauaugcaugcuuggcauacucaaaagaaaugacguucucugucguacagaaucuaugcauuuuucuugaaucuaccugacaagaacaaaggccaggugauuguuuguauggucauauuuuuaucacauuugugaccguacuacuuuguacaacggaagcaaauuaauugguauagucucuagcucuccaggcuuaguguggagaucgucuugcccaaaugaaggcaacuccugggauugugucuuucaaggauucaaaguuugguuaguggagcugacucacauauguauuugcuguaauucuccaguuccucucuggugcuccaaauauuuucucauagcaacccauacaccuuccccucuuucuucacucaauugaacucacucacagcaacagucauggcaugggggugggucaucucuacucucugaugaaaucuaauuuacucugaauagguuucauuguaaaccacucucucagcaaguugcuccaaccagguuugauuuuucuauuuauguuccauagcacuuugucguaugacaucuugcaaagagaucuuuucauguuccugcuaauauguggucagaaaucuggcauguaaauuggcauguaauguggaaguuuauuaugugaacuuugacucuugaaccuuugccaggcuuugagaccacauauaauuccuaaggcugggcaacuuuucaucgucuuuuaucacuuuucugccccagagaccagccacucugacauuucagcagucugucuaaaggcagugcugaaucccccucuucaucuucugaaaauauuucuggcuuccaguagcacugaauggaggguucccaucuuuggcugagaaccaacaauggcucaccccaccauuugaucuuacaggaguugccauagagucuuaucugauugugaggcaguaguccaggaccuucaugaaccagucuuaauucccaagcacuauguauccuaacguuagauaaucauagggaggagguguacacuauuagugacucagucccagggugaucauuuaauagauuacauauaggcaguguaucuuaguucagagaauugauuuuuuaaauaauaaacaaggauauuuucauagccuaaagcuuuguaaguuuaaagaaaaaaauggagaauguuuacuauccccauuuuuaauggaaaaaaugaacuuuuuaaucuuaaaagaaaauugguucuguaccauuaaguaaaaaaaggcagaagaagauuuuaaaaaauugaaagaaucuaagagaaaggaaaaagagaggaaggagcaacgcucaagaagagagauaucacugaggcuuugcauuagucuaacuuagguugucacaaggccucuuguuaaugugauuacaguacuuugcacuacaguugaaauuucaauaacaaaaugaucuguauucuuagaauaaagacuaugcggcagagaaaugagcaggaaaaacauuuuagaaucuauucaugucaauguguuugauauguguauuugaaauguucuaaucacauagugaugaaauaaaggccauuguguucauuucaaguaaaaauacagcacuaccaagccuucucccuuagacucccaccuuuagagcugugauuugaaaauauguuuguauucaucccuuucauucucacugcaguguuaucaccaguuucucaccucaauccuggacuauuaugauagcuuccaaguugguuuuccugucuagauucucuccuauccuacauuauaucccaaauuauuaauaauauaugaagugaugucagauuaauucccuuucucaagacuuuuuaacaguggcccacauccuauauaauugaacacuccuagccacaaaguugcagucuguauauauuuaccuaucccuaaaggaaccuuaucauuuggccaauuguauuaguucauuuucaugcugcugaaaaagacauacacgagacugggcaauuuacaaaggaaagcgguuuaauguauagcucacaguucaucguggcuggggaagccucacagucauggcagaaggcaagaaggagcaagucacaucuuauguggaugguggcaggcaaaaagagagcuugggcagagaaacucccguuuuuaaaaccaugaaaucucaugagaucgauucauuaucaggaaaacagcacaggaaagacccgcccccauuaugcagucaucucccaccaggucccucccacaacacaugggaauuaugggaacuacaagauuagauuuguguggggacacagacccaaaccauauuaccaaucuuacccuuccuugaaccuacauugugcaaucuuaucuuguuugcuuugccuaaaauguucacuaaccugcccuuaucagaaugccagguauuauuugucaauuuucuuuuuuuuuuaauuauuauuauacuuuaaguuuuaggguacaugugcacaaccugcagguuuguuacauauguauacaugugccauguuggugugcugcacccauuaauucgucauuuagcauuagguaugucuccuaaugguaucccuccccccuccccccaccccacaacaguccccggugugugauguuccccuuccugugucauauuugucaauuuucuacuaaagaacugccuuacccaugcucugucaaacuguaacagcaagaaguaauuucccuuccuuccaguaauauucaauuauuuaauucauucaguuugccuuuaaucacuuacauauuuaugaaacucugcuaguuuaacgaauuucccacuaucagcagcacacaccauaguugcacugggagaggaauaguguugauuuuauucuuauacuuaaaaaaaaucuugaauuugaaucaguuuuaaauucuagcugacucguaaccuaaucauuuuuguugcaugaagcuauggggauauaauaucuuuguugagguuaggagcauuuccucagaugauauaugagaauaucacauugaacacuugggccaguaaucuuuuggaucaaugagccuacuuuuaagcaaauuuuccaucgguguuaacugaucaucauuuccuaccuuaaauaugacagucaugaguauugugguaaaacaucauuuaguguuacguauauuucuaccuagcagaauuuauaaauuuuuccuaaugaaugaacuuaacuuuuuaagugauccacaauaaacuggaagcaugugaucuuaccaguucacuuugggauuaguguuuuaggugucaaaugcugaugugugccauuuuuuucuugagauugguaaacucucagaagguugaacaaauauuuacuuaaauaucuaaccuacaauaauggaaaauuuaacaaaucaauuuaaucuuugaugagacugguagaaacuuauccuaauucacuaacauuuuaucuagcuaauuugcacacuauuccucugucccucuacccaaccucuccccauaugcauaaaacuacccccuugaaacuaugauaaacccaaaucaugggcuaauucguaggagugacauuaguaauccauuuggaaucaugcaacuaguuaauccuucauaucuuuguaauuucaaaggcucauuauuacucuucuuccccauuucugcauuauuccucuugccucuuccucacccucacuuucccaccguugucaugauauauuccuaugaaugauagugucuuccuuuacuguugucccagagcuucuauucaauccacaagcauuuauugggcacacuuugcuuucaccuauuuuaaccuuacuacuagcauggccccauuauaccuagcaaaacccuucuccuggcuuuaucugaaaauuagcauuuuucauacaucccuacacuuuccucaaaaccuuaaugacauugcuuuuucccugauucccgcauacauuaucuacuuccaaccuauuuuuucagccucacucauaccacucccauauauacaugaaauguauauuuauagcucaugcccuacaaacuagguuucuugccauuucccaaauauggacacagccugugcuuucuugccuccuggcucuauuaagucgauucuuccuagauuucccuuuuacccccugaacacuuccaucuuuuaauacauggguuuugaauucagagagucuguaaacuaagaaaauaaaugugaauuuuguagguguucuuauauauauuuuuuccaaguagagaguucacaguuuucauuacauccucaaaaggguuaaagacuccucaaaaguuaaagacuacuacucuuauuuucuuccaccuuucugaacuaugcuuguauuuuuguuacaaguagucuuguuuggcauauuaguccguucucaugcugcugauaaagacauaucugagacuggguaauuuauaaagaaaaagagguuuaauggacucacaguuccaugugucuggggagaccucacaaucauggcagaaggcaaaagacucaucuuacauggcagcaggcaagagagaaugagagccaagcaaaaggggaaacccuuuauaaagccaucagaucucgugagacuuacucacuaccacaagaacaguauuggggaaaccacccccaugauucaguuaccucccacuggcucccucccacaacauguuagaauugugggagcuacaauucaagaugagauuuggguggggacagagacauauaauuugguaauuaugcauuuauucauauauaugaccauguguauacccugucucucuuacuggauuguaaugucuauuggauuaugaaaaauuuuuguaaucaugaucuuuugcacacaaccuuauauaugacagucacacaguuacuauguacuuaaaaaagaaaagaaacuguuuuuuaaaaaauguaaucagggcuaugauccuuucaugagauuggaauucccuucaauaaauuuuuaaaaugaauauaauaaauacauguuaauuuuuuguaugcuucucggaaguucuuaucagugaggugguaacuaaauggccugguuaucccauuggacuaauuaauaagccuuaaagauuucaugaguauuuaguauuuggaagcccguggguuuccaaguagguuccaacaugcaugcugaggcuggugucuuccuuguagaagaacucagucuuuauuucuugcuuguccuaucauuccauauuucuuccuuuccauuccccgggcuacacaaauucggcacaggccuaagucaguuaggcagaagauuccuaaagccaaaagaaauaccccuuuuguuaucuguguuacaaagugacacaaagaagaaccgaaauucugaagguccaaggcauucuagaaugucaguguaucuguuccuggggaauccauuuucacccacauauuuccuugcaccuuuccaaagcucuuaaaaaacuguccagaaaugagaaggccauuuccuaaaagccuggccuucuagggaaucaucuggaaaucuaggaccacuauaaaauaacagcuucaauaacagaagcagaucucugacuuuuuuuuuuuucccagaaaaagaagugcugguuuauccaacugaaaagugcuuauuaacaaacugagagcauggacuucuccuuuaguguugcucagcaauuauguaucugguaauuuaccuuucauuaaaaauuauaauaucaaaaguuacagaucauuuuauuuauauuuacuagacugaaaucuuaccucaaauucucugcacucaaacuuuaaagaaaauauagguauaauggcaaauuaggguuuugagcaaauucuuccuauaagugaauuguagucauaugaauccuuugacuuguuuucugcucuguuuucucuuugaaaaaaaagcacuuauugaucauguuuuaagagauguuauaccaaaguccuuuauaguuucacaguuuaacauuuugguaaaauguuuguucauucauuacauuuacauuacucuuucuguaauauaucucuuuucauuugugcaguaucacuauuuucaaguauagugguaaacugcauuaacauccauucuggcagagagaauguuguagaagccuauguuucuagaagccuguguuucuuagaagagaaugauuaagaaguuuacuuaauuuuguugucuaaaaaaaguuaacaguaggauaaauuguauuacaucuuccuaugaauuaauuuaauaucuauuuuaagaauuuuuuuaugauuucuuaaccuaacauacucuuuucaguauuauguuuuauuaacuccagggaagaauuagcaacgugggaaaauaauguaaaauaaaauuaaagcuauuaacuucuaaguuguuuagaagaaaauuagauuuaauguugguauaauugauacugaguauuuuguguauaaaguguuuuaccauaaagaaauuggaaacuugggagaaaauuaagacuuugcuauagauauuacugcauuauuuuucuuugggagggggcaguauguuaaaauuugaaggcauuaucaauuuccauagucaaaguauaagaaaguuaaauauguuuuaaagcucuaaauauuuuuauaacugcuuauacugaauuguugauguaaucagacuguuaagaauaaugaaaucaauuuucucucuuaaauugcauggugugauuuuuuucuuuugaauuuagcuaauauuguuaauauagcucaguauccaaauacaugguguucaguaccuguuuuuaaugcaacaugcaauacuaccaggaguugaaagauagauaacuuuaaauaugagguuauuaagaguguaucacauuuaucacuaacaccugguacuuaauuaauaaucguacaugguaugcugagauuucacagauuagagcuguuucugugauugucccuucucuuuguugucucugaauuauuuucucuucuucauuccauuucugcugucauuucuaauauuucugccuuaacaccacaucguaaaauauaauguagggaccaucauuuuacuucuucauauuuguucauacugaugacccccuacuuccauauuuuaauacaggauuaauggagggauguauggauuuaguaacuuuuggacauuaaugaaagaaucuuuguucauuugcauuaaaauauuaaugcauauuaaacucaaaaucugcgguaugauuuuccuuucgugagagaauagcacuaauauuaaauacucuuuaggugggagacgauuuagaaagagaauaguuacuaucccauauccugaacuaugaaagucaagaauguuuauucauaagaagaaaaauccaccagggucccugcucuucaggucuccauucugauuauaauuauggaauguucaaaaaagguuuacuuugugaaugggcuuauuauuagugugcauauuuuuauuuuguucucuggaggguggggaagaaggggagaaaacacauuaaguggcaacuguucauuaacgaccguugaggaagaaguuggacuuuaaagaaucuaucagaaauucucuggucagccuuuuauuacuaucuugucuugagcccuuuuuuuaaugacaucuauuaucagauugaaauggcgauugagacgcugcaaaagucugacggucuguccacucacagaagcucucuucucaacagccauguaaguugccucuucuucauguacacuaaucucuugcuuguucugcauguguugcuugccucuaaaugcuuguuuuauuuauuuacuuauuuauuuugcuucuuaaccuucccuucucagccccuuaugaucucugugucauuuaauggcuauuuuguacagugaaauauccaaaaaauagagucuccaguauaauuuauuagguuucuguacucuuuggguacagauauaauauuuucgaguuaguaacaaguugccauguauuuguacaaaguaauaauagugauuuucaauauuuaaaauguuccaguuugauauuuauuuacuaugaagcaaauacuuguaaucugcaucucugucaaacagccaugucuacuugcgugaccaguaauguucuuuaaguagaaaaaggaugauuaaugugaaauccaaugauaaacuguuugaaaaugauuuguuuaccaguaagacuauguaaggugggcaguaaacaaccccauaguugaauucagguccuaagaccuaaagagaaguaaaagugaaccaaaagaaaaagugagacugucuacaagccauaaauugcuaauaauugagauaaaacuaccauuacuaugcccugaagcuguuuccuguuaucagaugcagauaucacuaugacacugguaaguguaagaagggugaugauaguuuugugaaauuauaaacauuuuuaucagcuguucucaugugggaaaccaaugaaaaugcugaauaaaaauuuguuuuguuaagaugauuucugaauauauggaaaaaaguaaauagacccaugguguaaauucauuuuagauauaucuucugcuaacuuaacauuagugacauuuuaguuuagaauuuucucccacaacugacaauuuguucuuaaauuuagggauaaaguauuaugacuucuuauuucuuuuucauauuuuauaacugaaaagcucgauauuggaucacccaaauaagaccauuuuuuucaauaaaccuaaaacuuuuacucauagaaaauguuuuaacuguguuuuuuuuaaguauuugaucuuugaaaaauuuuaauuuuauaucuuaaaauagcacuaauuaccuccuuauguucuuacacuuuguuuuuagaugggguauuuugucuuguuucuuuuuucaaaggaaaguaucauggaaaacaaaaccagguuagccaacuuggagaaugccuauaaauuuggugacaaauuauacauacaaacuuaaacaugauaguauauauucuggcccuuccuuuugaaagaguuuaagaaauauaaguuuuuucauuucugaaaauugguauuuaguaugucacucuuuuauguuucguaaguauauuccugcuauguuggcauguaucugugauugcauuaaaggcugauuuccuguauacuacuaggcuguguguguccggggggugaugauuaacuuauauuuaugcuuugaaaaugggaagugaaauuguucuuccuuuuagucacaaaugugcaaggacauaagaaaaaaaaaaaccugaaguuuccaguuaccuguuucagcuuucagacuuccaaguugugcuuucauauucaacucaggguucauuuuuacuugacaugaauaacuuaguaaaauauguuauauguuuaauuuuaaauuuaacuucaguuauucaucuuaguauuuuuaugaacaauaauggaaguauaagaacauguuucuuauauauuuuaaaaauguauuuguugauuuguuugaagcuuuucaacuguuagagauuuuuaacaauuauuuuucuuuauagaauucaugaaagaauguuuaagauuaauaaauguuugaauuaagcugcauaaacaaugacaaauauuuauuacuucauggcuucauuuuuuuuauuacauaauaugucugaucuuccauacugcuaacaacucccagagacacuucaguauguggaaagagugggcgcaaauguugauugugcagugguaaucuuucuccaacuauccugauucauuuuuauuacaccuugaggcacagugaaguucauucaaaaauauauuuauagucaaauauuuagaaacaaaaaugauucuacggaugguuuauaaacaguggagaaaggaucagugcuucuacugacugaucagugagguuaguuucuuccuaaacacagaaaaagauccuguugucuuuuuccucccuggaaaguugaugaugcuuuuaauguuucugagauuuaucaaaaacaacuggaauuugcuagugcaugcauucugguugauaacuauuugcuaaaaguauuuuacauucugugaauuuaacugguguuuuuauguuguguagaauuuuuucaguggagagauggaguuuuuuaaaaaaauuguuguuaauauuuuaaauguuaguaaacuauguuaccuuuauuucucacuauauggggcauaauauagaauuauuugagguuugugggauucuuuaaggugaacaugaauuccgcuuuaugaugauuaguucccugauuuaucacugucuccaaaggaucaauuuuauuauguaaaaacauugggagaaauuauugauaauaauuugcaucccguauuuuaccuguuucuaaggagagguguuaaucaugacuuuugggugaaaagucuauucucauucuauuuuggaauauggauaagcaaagacuuccuauuuucuguuucuguauuugcuuauucacaguaauuuuaaaaacucuuauuaggacuaaauaagauaaauaauccccucagcagaauccaacuugauugcuuugcuuuacaccuuuccacacuuuagaagauggggugagguauugaauuuucuaccccauuuucaacauauucuuaagagaauuaacauggugggaguuauuuuaguaccagcaucucuaauaggcauuuaguaaguauuuauugcaagugguaguuccaagaaaguaaggauuuuuguauguuuuguucaccagugcaucccuagugccuagaacagugccugguacauaguagauacucacuaaauauuugcugaaugaauaaaaagaaacaauagaagggaucaggccuuauguuaccuucauuauuuaggaauucuaggaugccuuugccaaucauguguacauuuauuguauuguuucuuuucaaguuugcuucaaguagauauauaugugaacaucguugguaaaggguggucuucuucugguauaccaucugaguaaagaauguauggucacucaauuauuucucuauaugcagccuucaguuuaagaguaaauaacucuuuuuuuccucuaaacaaucucaucuuuuaaaaagaucuugccaagagugacuuuguuuuucuccugguauuuuagaaugguacuuuagauuugguuuuacagaauucuauuagucuaauaauuuuuuauuuaaauauuuuuguuucuaauuuuuuuauauaugaagaugcuacaguaugagauguauagucugccuaaaugaaauuaaaauauuuaauucuuuucauugcagacaagauuauuuuauacuuuuucuugguguuaauuaauaugaauuaguauuuaaugguugugguguguucacuuauuuacaaacuacuuauuuuacauuguaaauuugaauucagaaauguuguuaauuguucccaauaaucgcaugaaauuuaagguuguacauuucuuuaaaauuccauuuaaaguuuaugaaaagcucuagccgucuauuuuauguacuucucacaaucuagcaaauaauuauuuccuguuguuugcugguuuuagcuaccaaaauacauuuagcucaaagcaaaaccuuguuuuuuacucacuuuuccuugacuuugcuguauuguaaauauaaguuauuacagaaauaaggccugucaaaaugcauaucguuaguaaacugaacuuaaaaugaauccugauggguaauaauccaucugggaaaaaaugacaaauguuacauuuagauguuaauugggcaaugcaauauuuauuucuuuuuauuugucaaucaggauuucccuuugggaaaaacaggaaccauucaucuuuagucuaucuugauuaauacagauuaaaugcaaagguugaaagaugcaauuaucuucguuuccaccauuaaaugaguguauauuaguucauaaguagaguaaucaaguuuuaaagauaaagguuaaaaguuccuauguuauuuuaugggcuuuugaaaucauuccuaugguauuuuaugggcuuuugaagucagcauacauuuuacaagacauuuuauaaaagagcaaaagauauaauaauuguuucguucuaaauuauugaauguuaagauuggggaauacuaauguccaaauacauuguauuaaagacaaaacccaagaaaacgauauuuaacaggcauuaacuucccuuggguagcucauggagccugugccuuuagguugcacuuaaacuuacacaaaaacuuaacugccaaguuucucuuacagucaaaguaaugcuuccuaauacuauguuuuagacacaaaugucugauuuauaauuccaucacugugucaaaacguaaaaguuaaauacuggcguauaggauggagauuauaauccccagccacaucucaaagucuugucugguggauccuuuuaaaucaauuucuguuaauacagugaauuucuaggcgaucuagcccgagguggguuaguuuuuggcagucuuccuagcugggaccugcagggcuacagcaaagccaucuccauccuuucagggcuuuuaccuccacuugacuuccuuauucucucucaaccugcucuccaggcaucuggcaaggaauacaguuccuccuucugcauacaacggguagggaacaaaacguagcuuugcuagugucaaagugauagucaucaaaauaccuguucuuguaccauuuuucaaacuaacuagugauuuauauaaauauauauguauaugcauauauacauauaaacaaacugauuuuuugaacuaguuuagaaaugaagaauuuaaacagaauuucuucaguuuaagaauauaaacuauauaagaagaacaaucaguuuauaaaacggugcagauuuuuugacuuaccuagccauuucaguggccugcauagccaaucgaguaaaagcuucacuucuuguaaauuauucaauugggauauaaguaauaucauuuaggcuucuaaguaguuugugccaacguuugcuguaauuaucucacuauuucuaugaaaaguuuucuuuaugaagaguggucugauuaacccauauauauauauaaaaauguaaauauaccauuggacucaaaauauuuuauauuaaacuuuaauauuuguacuagcuuuuacuuuuauaaaagguaauuuacaguauccuucaaauauucuauuauuggauuuucuuuuucaaauuuuguaguaaaaauuuuaaucuacaagauaauuccuaugaucaugaaaaauaaguaagcucucauuuuuacauguuugucuuauuuuuaaguaauuuaauguugcaagaagacuaguacacaaguagggcaguuuuuuaaauguuuuauuuguuucugguuaauuaaaauuuuuuuaauuugcuuuuaucagacuaaaauuacaucagaucuguuuuuauuauuuguauacuuuugguuguaaaguucauauuauaagauugacuaauuccauuucuuuaaaaaaaugcccuuuaaaugaagauuuuucuauaugauaugucuucuguucauuagcaaaggaagcaauauugaguucuuuacucagaacaaaucaugcuauuauaccuuugacaauaugcauuauuuuaugaggauauguagauguacuuacaaacauaucuuuggcauuuuuaacuuacacauauuguguguuccaugcuuguggauguggaaacuucauuaguuuaguugaaaaauacuacucuguuucaaaaaguauuuacauuuuuuaugucugccuuuccagaauuuuuuucuuucgugucuucuuuauaguccuugauaucaagaaccuauaugcccuucuuuaauauauuaagacugccacuagaagguggucaacccuugcucugucuaguauauguacacaaaacaagaaccagcacuguuguacaauacagcucacuagggcugccauaacaucacucaagugcuucccaaucucaaucauuuuaccaaagcauguggauaaaauauaugaaucaggauuuuauugcugcauuuuauguguagucucccucagcuauacuuaaaacuaauaaagucuuaaaaaaaaaacacuaaagagacaugcugucccccuguuguaggcaaaauacuaauuugaaccucaguaacuuaauuucccaaucagacugccuuaucucuuuuauacuaaaugaauauguguagcaaaccuauucugugugucacuuagaauacucagaaaucauguuuaagcgccccuggaaaacuuguuuacugacaaucaaguuauagaugauucauaacaaaagaauuauuuuggccuguaauacuuuuaugucauuguaaaaacaaauguuuauuuuguguaaucuuuuuaaacuucuauaggucagccuuguauauguuaagagguauuaugcauguuuaaaugugcauauucauucguauauguguccugugaaggacuucaagucuuucugaucaaaaucugaauuuuauuuuuaaaaguacucugguuugucuuguagauuugguggcuauguuuucaaagccaacuaucaauauggguuuaaugacauaaguuuaauuacauaaacaucauguaggaauauuugacauuaaaaugguuuuuggaaauucaguugucaugacuaaagucaguaauucugaaaauauuuuuaaugaauuuuuaaauuaaaagucugaaaauucagguucuaaguuugauugcaaaucuuaaaauauguaaguaaaauggagaaauuuuuuauuuauuuaaauguccauauuauuuuuagcauuucauuggaaauuccuagaggacaaggaugagaucacauucauuuuugcaucacuagaugccuggcacauuacuuggcucaugguuggugcucaauaaaugaauucuuuggcuucuauaauuuauaauaacuugaauugcaaguuaaaugucagcucuuuauuacaccugucuuacauauggcaugaaaauuuuuguugacacaaguaaugugaaauauuuacugcuuuugugaaacauuggucuggaguaaucaggaaaugugaauuggaaaccagacucaggcauggagacaauaugugacuuugagaaaguuauuuaagucuauuucaguucugcuuuuauaaauaaauaaaugaacaaaagauuuaauuuuguuaauguuaaaauucaauaauauagacuuggauucaauuuucuaaaauuuucuuguacauucagugcuuuaaagauuuuuuuguaauguacacaggauaacauaaaacuuuagaaugugaacauagacugaaaaaguauuguguuaccaacuaucauugcagugugccuuccagaauaaugaauaaacacaguuuugagguagaaaaauuaaaaugguuguaauaaaugauuccuuuucauuacauguaaacucuuugccaaugucuugucaguuuauuuucauuuggggaagaaacgacugaauuuugucuuuucugcuuucagaaucugucgcaguagacaauauuguuauuaucuagugguaauuugagauaaauuaaaauucuauaaaaaggaauguaacuuuaauauaaacacucauaccaggcagccugcuguucauauguuauaauaagccaacacuaaagacauacuguuuaccaugcuaccaggcuugguaacauauuuuguucuguggcaaucauauuucugauauuuaugaccaguuaacgggauuauuugaacuccuugaaguggugucuauuuucaaaauuggaaucaauacagggaaaauuaguaugucucuacgugugcuugaauauuugaagaaauggauauugucugagauccuuagugauguucagcuauuuacaguguuucugagcguuuucaaaggcagauuaccaccuucugaauuauagcaguuuacucuaucauaagacuugaugaagaacuucuaaguauuucuguauguugcauuugcagugucuuguagaaauuuuggcaaauuaugugauuugucuguguuuauugugucuuauuucccuagcuccaguggcuguuggacaauuaugagacagcagaaggagugagccuucccagaagcacucuguacaaccacuaccuucgacacugucaggaacacaaacuggacccagucaaugcugccucuuuuggaaaauuaauaagaucaauuuuuauggggcuacgaaccaggagauugggcacuagguuaguauugaaaaauaagaucauaaacuaaucucucuuuuucaaacuagggcaauucaauauauuguuuaaacaaaaguacuugauuacagacaauauauaaggaaauacauagaaugagcucaguuuauaacauccccaggaaaaggaaaggacauuauucagugacuucuuuccaagccacaauuauauguugucuaaaacaugaacugagcaaagcuuugagaagagcugauucucaaacuacauagaaauuagcagaccaaccuguuaaugcaagauuugcauauggugcuuuaaaacacacacaaacacauacacacacacacgcacauaaaaauguauucucuuauugaaagaaaucauacuaaugaugaugaguuaagugacauaguaaauggaaaacuauguaucacuugacucuugaaaaauuacauuugucuuuauaaauaacuguugggauagaguaagaaacuaaagcaguuuuuucauuucauuucuggaggccaguuaaaaaucauuugguaaacuugcaaaauauuguuuaaauuccucagugaugagauagcucuauuuuaccucuuauuagccccuacuuuuuuuucugcucuuaauaugaaaccauguguauguggaaggaaaaacauaguauaguucaauugaauugaaacaaugugaagaaguuguuucugguuuuucuuccuuuggaaauaaauaugaguguuuucacuaaccaaaauaucaugaaaagaauacuuagaacucuggggcuucauuuuugucuuuccauauuucuauaaauuaucauaagauaaauauuuuaaguagcuggacagaaggauauggauguuuuuaauuuccuaaaucuuauagaaaucacauaaaaaguuaaaauagagauacuguacuauacaacauuaggugauauacccuuaauuagcuauaaagcacaacuucagaguauuuucguaaagaguuuuuuuuuuuuuuuuuuuuuuuuuuuuuuuuuuuuuuugagauggagucucacucuguuucuguugccaggcuggagugcaguggcacgaucucagcucacugcaaccucugccucgcagguucaaaugauucuccugccuuagccucccaaguagcugagacuacaggugugugccaccacguccagcuaauuauuguauuuuuaguagagaugggguuucaccauguuaguccagauggucuccaucucuuuugugauccaccugccucggccucccaaagugaagaguuuuuaaucuuaauaaaauaaacacagccuuccuuaguaauugacuucauuaaaaauguauaccaaaaagaggagugaguguuguaggaagaaaagauugaucuuuuucucaccaccacaagacucauggcuaggaccccuauaacgaaagauuaacaacagaaaaggauacaaauuuguuuaauauaaguuuuacaugacugggagcuuucaaaaaugauggcccaaagaaacagagagaacuguauguauuuuaugcagucugaugaaguggauaguucuggagaaacaugauuggacagaaagggguaugaucuaaugguucuagggguaugaucuaaugguucuaaucugggggaaacucagcaaggucuguuuuguuuuguuuuguuuuguuuuguuuuguuuuguuuuguuuuuguuuuuguuuuguuuuuugagaaggauucucgcucuguugcccaggcuggagugcagugccccaaucucagcucacugcaaccucugccccccggguucaagugauucuuccugccucagccucccgaguaacccggauuacaggcaccaccccacuccaccacgcccagauaauuuuuguguuuuuaguagagaugggguuucgccauguuggccaggcuggucucaaacuccugaccuuaggugaucugcccgccucagccucccagagugcugguguuauaggcgugagccaccgcacccagcccagcaaggccuguuuguucagauuuuucugcaucccugugucuucaaaaauaagaacguucuuuucugcaagguauaggaggaccccucuggaaugagggucucaugaccuauuuucaggagaaaguaagcuagguuuuauggccugcuucagaggagaaggagugaggggaauuuuuucugguuucuguggcccgcuucuguuguuucuucaaaugccaaggugccauaguuugggauagcauguccuaaaccccuucacugugucaguuuuaugagauuuacaaggccuguauguauuagcaugaauuauugcuuuucuguagcauuuuaagugauuauacagcuuuuggauugcugaagguuuagcucucucauaaauauguuuccuucuuucuguacuucaaaagauaguauauuuuaaacugaagaaugugauugucuauucacacuaaaggaauaguuuucauucccuugagaaaacuuuuuguuucuauaguacuuuuuuucaaaaccacaaaaaucauuauuuggggaccuaaccuacuaucuccucgcugguggcucuguaguuaugcauaccgugccaauauuuugaaacucugggcuuuauucaacauucuaauagcuguauuguuguccuucuuuuguuacugaaaggaauuucaauggguccuauuuugaggcuccauucaaacguugaaacaagucuuuaaaauagaaagggacaaaauugggguuguuugguuuugugaaugaguagaauccauacucuguaaguacguauugcaauauugccgcuuuuacuuucugauguucuggguuccucccacccccaacuagguaacaauuaugaauuaugucuccuguuuuuuuuuuuuuaauuguauguaguguuuacaguuauguuugugaagcaaacccuagaaaaauaaggagaaaauaaguacuauggagggaguuuaaagaaaugaagugcuaugaagacagaauucuaauguaaaaaaacugacaauuguaggagugagguacuagacauucuuucuaccauagaaacuguuuagcauuuacuuucuacuccuaauccaaggaacagauggaaaauuaauauaaaucaugaggcaaauuaaauacuuuuuuuuaaaaugaacuauauguagaacuauuauuaauauuaucuaucaauaaaauaaucuggugaaaccacucaaaccagaaccagaucuuuucuaaaguuuuuggaccuaaguaaacaaaaaguaaaucaaaucacuguuuuaaacaaaggcaaauaaaaagguaccuuuuauuagaucccaucuccaaguuaaauuugaguaaagaagaccauggauaugcuucucucccccaaccauucccaaugaaauaaaaagaaccucucccucccaacccaauuaaaauguuaauuuguaggaaaccaaaaagaaacucagcacuccaucuauuugaggucucacaagagagacaucauuuuccucuguaguuuuguccuguaaguaaugucuccugcuuccuaccguaccucuacucccuacuguccuccagcuuguacaggagaacgccacaaauuggguauguggaauuuuuugguuuugcuuauugcaccauucugcaguggauuuuugagacaagaucuaaucucugcaaguagaagaccuuucuuuacgggcguuaaguuucucuaucugcuuuauugugcugaaagcauguagguauuuggaugcccugcauuuuuuaaaaacuggcaauauaauuuauauaguauaauuuuaaugucuucaaauauauauaagguucauuuaauauauguuuuuaaaucuuggaagugcaauucugcucuauuuuuauaaaaaauauuuaauccacacucuucuugcauuucuuuuuguaaauggaagaaaaaauuggaaaaagugcugauguauugcuauauauggacuugugaaaaacuacuauuuucucuuugcaauaauuuacauauuuaaaaugauauuuugcaagaauuugcaaauuccauucagagcaaaacuuugucauuucuaauagcaaacauggucuuucucaugaacauggggaaauugugacauuuuuauuccagguggaaauuugccauuuucauagagaaauuuccccaucucuucugugacaaauccuguuuagccugcaaaacuaacacaaauccauaaaaacagaaacuaauaaaauguguuucaaaaucaacagauuaaaggcuuacuuucuuuuuagguuucaaaauauuaaguaagucuuuaccacaacauuuuguaacagacaauuaaguuaucuuacuucaucaucacugaaguaaagagaaaaaugucaaacuuauccaggaaaguagaauuaagauuuuuucuuuguucuauauacaugcuuuacaauaaauacguauuccauugacuaauuuuuauuggccuguuaacuaauuuuuacuggccaaaaacuuuuuuccuaucauuacccuucuuaacuaaauuuaaaauagaaauuugaaaauggaauguaauuuguauggaacaaauggacuguuugacuaauauuuaaguggaaguuuauaaacaaauauuuuuagcagggccuuuagcugauugauuuggaaucuuauuuugauucuucaaauuuuaucaccauaaaaacauaaaaguauucagaacagguuaaucauaaauauguaacauuaacuuacuguuuuuaccaaauuuuuccaagugugaaguuuaauggacaucccaugugauuaauauuaguuugacugacuuuuguuucuaauguuucuuguucauuaaugaagaggaaacuccaaauaccacuacuaugggauucgugucaagccagauuccccucuuaaucgucugcaagaagacaugcaguauauggcuaugagacaacaacccaugcaacagaaacaaagguagacucugaaguuaucauugauguguccaagcuauguauuucuuaguuguucgggucuccuuuuuucugaacaaauaccuaaguauaaaagaacguucuuauuguuggcaugcuuucacuacagauaguucuuaaauaugauuuagaauuucagugaucucgccuguuuuccaaauuuuuaaaaaguacuuaucagucagccguuuggccccuuuuaagugugacaucccaaacuguucagacagggaaaugaaacacaaaacauaaggagcauacccaagcaaauaccaacuggagaaauuuguuucaguauucaugagcuucugacuugcuauucugcacaucucucaagucauucuuuuugacacaguaugaauucuugcagaauguuugggaugccuuacauuugcuuugaauccaacuuucauagauacagaauugcugauauuagaguuguaagagaucucaagcauucaugaauggauggaugaaugauggauggauggacguauggacggauggauggacggaugaauagaaucauagaucuuagauuugaaaaauaugucagucuagucuggcuuuaaaaccuuaugacaaucaaagcauuaauaguuucuguuuuuucagaugagucccagagagguuaaaugauuugcacaagcacaaaauaaaguugcauagcuaagggccuucuagucccaugugacuuaugucacaauuuagaguaaacaaaaugaaaaaauccuuuccucuuuaccagcauagcucaaccaagacagaaguuaugauuuuucuuuucaagugagcaugcagaauuagguaggagaaaggaggccucugcauaggucccaguguaaugaucuguagugauuaguugccuuggccacaucucccuauccaugcuaguuuagucagaagcauuaacucuaagauaaugucugagaaaagaauauaucacacaguaauuuuauacuauuuagucagccaauacugauguuaagcccugcaugcagagauaagacacaguucuuauguuugaagaguuaaaaaauuagaaggggaggcacauggagaauggaaaaaaaauggaauacagucugggaagugcuaaaauaaaacuuugaucaaggaacuaucacaauacagaggaguuuucggcaauaucugggagaaagggagauugggaaguuucuagagaaagugcucuuugaguaggaacuuagaggagucauaaaaagagaaauauugaagcagaaggaaaauucaccuagcggugaaguccaugaugucugugguaaaugguccaugacauauuuauugaggcugguauuacagaaggagaaucaaggaggugguugaguaguuuagugggagaugagaucuuaaaaguaguuuggaucauauauuaagggauuugcuuguauguaaagcuaauaaguuuguucuuugugcagaacauagcuuugaagcuauguaaggcuuugaagcaaaacaaugaaacuuugauuuuuucuagagagaugacuuuuugauuuugggcaagacauauuuaauggaaagagacuggagguaaggauccuuguucaguggcuuuuuacacagucauaauuuccaguguaagugcaccagacugaagacucaguucaagguuggcuauuauauaaaagauaucuuaaagguuuuagauuuuuuauuacagauucucaaucuuauuuuuuuauugcugauucuuauuuuuugauguguagccagugaaaaauaagaagggcucugaaaaaaauaauaaaauaaauuauagaauaguaccucauagaguuggauaguaccucauagaguuugugugaguugcaauaaauuguuacuauuuuggguuaugauugcuuuuugcaucuguuaauggcagcacuuguagccuuuacuuuuuggugugauuucugcacucaugcauagcaccacuacacaguggagaugauggugaaaucaagaaaaagaaaguuugcuucagaaauaacauauacucaaacuuaaguaugaauaaaaacuuaauaaauuauaccuaagacaguugaagcccauuauuugacugcaaggaauuuccugugauuuaacugccaggaauucuagcaagcuuucauagaaauagaagccuucaagggacauucuuuauaaaaaaaaccugaguuacauaaguaaggcccaguacuuucuguggucuccucaugaaacagauucuauaaagauuagcaagccauaaaaaccucugcauucucaggauagugguacuugaguuuggaaacagauaaaauauggagacauuucagaaaugauauaagaaucucaguaguauuaauaaauugaauuugauucuuauuucuuacgaaacaggaaugugaaagaaccaaagaaguacugaaacuuccuuuaauuuguuguguuuuuuuaaugauacaaguuuaggauuauagacaguugcucuuaaaaugaugucuugcuaacugauugcaguguuacuguugccaauugcaugggccucucuuauagggcagcaggagucuucuguggucucucugaaggaaucuguccacugacaacauugauaagccuuaacugaaaccaguuacccuguugugcagaaauauuuagacaggaaagaaggaguuucuuuucauggguguggacauaaacuaauuuaagaauauuuguugaaaacagugggaaaagaacuucuuaaaaauauauuuuauggcuuaaaaaaauuuucaauuucaaaauucaaaugauucuacugaauacaguaaaaauuauauaaagagacugccagucucuuguaaaaauacaaaugacaugugaaagguuuaaaguauaaaauagaagauauuucaaaauauucacguuguuugaauacuugaagguuuauuaaaugcauccaugugugcuuaucuuucauaauguaaauuuguuuuauauguucuuauagugaagaaaugcaagucuaugcagugauuauuuuguuaauuaaauauaacuuuuggagcucaauuguacauuuuucucaugaauuuggaauuauagucauuguagggauaagaaugauuauuguuuuuauauagcucacaauuucuugagcuccuuuauacaaggugucacuugaagguuugauggggugguagaggaaaucuccauuuaucuauaaauccaauucccagcaauaccacuguauggaacauagccaugagucggaaaauaaauguaaacagcuucugauuggaaagcagaugucauagagccugcaguuucaguuaguugaaaagauaaagccauucucaagccauuuuaccuaaaauaaaggagauuagagcccacuugauucacaggcagucaugaacuaugacagcugccaagaagaaauacaaguagacagggucuucuguuuaaaauuauucaguacaacaguuuguggacacuccguggaggggcaaauggaccuaggcacuccaguaaauauuucaaauaucacucuaaugacuaaaaucuagccuaacacaauauaacaacugcuuugcauauugauggcauuauggguaaucaaggggagguaaaauaccaugguuaaggaggcaggagacuguguaacaguuuuuuuaaaaaaaacuucuauugaaaauacuucauaugaaaauaauuuuuuugcacuaaaaugaaguaaucuucaguuuuugacgaaaugcacucauagacuaauuuguuuacccuaauuuagauaauaaguaaguuagauuauuauagagcaaaaaggacaucaguaauuuccaccucuucaaacuaaguaacaguauuugcugcaguuuauuuuugauaaugaaaagaaguacacagagaguauuggcauguauauuuuagauauuuuuccaaauuccaguaguaaaagccaaaugcuuuuguuaauaugcuuggcuguguuugaucccaguagccauucucaaaauauuaaaugucauuuaucauuucuucaacaaauacuuaucaguuguuauuugcauacacaaucugucaaucacaucuaaaagacauaacacagaaucauagaauguuagagaaggaaggaagaaaucaccuaguccaacuuauccuguugaugagaaaaccgaaguccauaaagguuaaauaacuuauccacagucauauagcaaccagguuaagaacucuugucuuuauucucaugagaauuccacccucaaagagguaagauaacccaaacagaaauacacguaauaaaauuuuugcauaugaaauaaagggagaaaucacauuuuaaugaguauguuucaaguaacugaggaaaugugccaccuccugccucuuugcauggucucuucacagcaauuggauucugugaaagaauaaaccuuucuuucacaggaugugaaguaagaaugucacuuaagaagagagaagaagaggucauuuggaaagaugguacagcaagccuacuuuuguuuuggcuguagauagauguaaaagcaugcacguucuuuuagaagugagagaggaaauuuaagaacuuuuaucauuagauggccuuucuuaauauaggguucauagacuaguuaaacgaacccuauauuuagaauuggaaaauggggaauugaguacaggcuacauaggcacuucugcagaguguaugacuuaacuucacugagccucaguuucuucaucugcaaaauagaaauucauaauagacuaucucacagauuguuuugaaguucaaguggaauaacguaucugaaaauuuuuuuaauaacuggaaguguuaaaguguuagauaauuauuauuaggaucauuauuauaugaugagcacuacagaaaaauaucuuucuuaugggauauuuaguguuuuggaggagaaugaagccuggcaauuggucagauugggcuuccauuucucuauaccucuaggcuagugguuucuaacuuugauugauguuaauaguuuaucauuccuuuccuagacauuaauucccuggugauguaaugauaaucuuuucuauugaagagaggagaaacauaaauaaucacaacucaauaacuaccaaacuauaguaauuuauguaguuuguuaauaauaacagucaccacuuaugcuccugaguaguauuuguggaacauuuaaaauauuuuucaguaaacacauuacaugcaagaucucauuggcaauuauauuguuacuuacugauaaggaaacugaggaccacuuaauuuugcuguauucaagaagcucacuaauuuauuucuuccuagauagaaccucaguugccuuuuuuguuguuguuauuguuuaucucuuggcaucagauggagccagauugucauucuucaaauaaagaaggugggaaaggguaagagauaaaagaagugucaugcauacuuguagcaagaauauaucaguucuauacagcuaaccauaaaccaccuaugcuuagaggacucaaugaagaaauucaugagaucagagaaucaugucugccucuuucagcacugcauccucagcaccugggagagcucuaagcacauugucggugcucucuaaauauuuguuaaaugaaugaaugacccacaacucugauuuucgccagcagcuucaaccuccuccuuuaccugcugcaguuaacauauagcccauuucaauuuaauuuuuuccaccucuucuugcccgauuauagauguaaagcuaaugaagagacaaauacucagagagccaccaacaagaauggaagagauggaauaccuaucauuaaccagcaugguugauguuagaagucauuugcauauauuaucaguauauucaguguaacaucaaaauuagcuacuauucuaaaagaguggaacucuucauauuuacuauuuucuucugauccauuagcguuuauaucacuugguucauuucagacaugaagucaucuaaagacuuucugggacaguuuuuuccaaagagauuacaagauuccaguagaaaauucuagccuccugcccuuguucugagcucaguauuucaauuuauucaugcaaauaaaaugauuguguaauuucuggaauuacaaaacauaaugaugucuccuuuugccuauacaguuuauauuuuguguuugcaugugcauuuuucagccacuuugaaaggauuuuccaaauguuucauuuaaucuguagaaaauccuuccaccuggugcuguuaguugaauguaaugguaaauauauaccauucuuugccuuccauuggacuguuuuaguacccaugugugugggauugacagaauauuacuuuuacaguagaguuacaacuguccaaguccuaaauagcagcugugacuaaccccauggaggaagauuccuaauuauuuucuaaguuuucuguguuagugacagguuuuaugcauacagucagcuauuaaagcaugagaguuucuuuuauuucuuaaucauuaacaacuuuagcacugauuacccauugaguugcaagcuguuaaaauuaucauuugccucuuacuaauuuugaaaccaagugcuguuucauuauuugauaaagcacaggucuuucucagagcacacucaaugaaagaguacuaagaguuuacucugggaaaaccaaaucuaaaaauaauuaauucauaaaguaaauggaaguaaagggaggaaaauacucuuaaauauuaaaaaguucaguauuuuuaaaggauucaacaggaagguuuuuguuugacuuuuuuuuuuucaauggaaaucuuaccuguuuuuuaaaauuuauuauucuccugauaugguagauuugauaaaguuuauggugauuauuuuaugaagaguauagagaaucagaaaaucuacaagucauguuucaaugcuauaaugucaguugaaauucaaccaagguuaacauaauguagaauuacuauguaagccaauagaauauaaaagacaucuuggaaaaauuauauuuauacccagcauuuuaaaaaccaugugccuauaguggccuacccauaauacaguaugugcucaauaaauauuuguuaaauugauuugauauauauacaaaaucaguugaugauaugauaaaaucaagcauguuaccuuaaacauuuauucauucaaauauauuuauuguacauuccaaauauaguuuauugagaaaaguuaaaaauuaaugacuuauuuuguuuaaaaugauguuuuucuaauauuaauugauguauuucuacaacauugggcugaaggaaucuauuugggaccaacaggcuccuguggauuaggcuguacuaccuacuuaagaaauaccucagaaacuuguuagaauaaccaguuccuaagcuccauucucaaauauuuugggaguggaucuagggugagccuaggcaccugaauuuuuugaaaaacuaccuagauauugauaugcacuuagauuucaaaagcagugauauauaaucuacaaccacuguuuccaagaagaaucaguugcuacugguauuuguuuagccuguuuuuaaugugauuguucuugacuuccuguuaaacucccuccuucuuugggaagacacaaacuucagaggugaggguagggguaggauauuuuccuuaguuaggguaccuugaaaaugaggaucuaggcuuucucaguccaguauuucugauuucuggggauuuuuucuaaguuccaauccauugccagacaauacauugucgauauaccaugacaugauucauuacuuaaagcaagaaaagcaaaaguuaucacuaccuggaagcucucucauacuuacaggcccacauuagcccucuuguacaugagcuguauuccauauuaccaucuugaugucauucuuuauggcacaaacccauccuaaacuuugucccuagaccuuuucccaggaggcauaacauaugcuucuggcuugcagagguccuguagccaagcaaccaagaaugaaugcacauagugugucuuugcucaaucucuguccaucuuucaauccacuauucaccgugcuacccuuacucuugugguuagaaugaaaaaacacucauuuccaaguucugauauauuuucuguguuuuucuuuauuucaacuguguauuauaaaaucuuuuccuaaguacugaccugcauaguuucuccagaauuuaccaacuuaccuccuucuuugcccuaaaaguugaucuugaugcauuuuucaucucccacauaauauaguuuaucucuaauuaguguuucccacucaguaucauuaaguauaaucauauguuaauuauaaugcaucaugauuuugauuccuuauuaaaaauauaaucucuccuuucauuaggaacuuucauuugcaauacuaacagcugucuccaucuuccuaaggaagcagacaauuuugcuuguaggcuauaguauuccuaagcauugugcgcaguuagauugugauguaacaucugucuuuugaaaacuuacagucuaaguggaauauaagucauuuucuuuuaugguuaaauuccauuugcccuugauauuugugccuauuaagcaccuguaguauguuaaaugcuuuguaggacaaagaaauguggcagagcauaacugggcaaagucuuguaauaauuuugcaauccuguauuaaaaauuaauguaauugaagucuauuggaauuauuuucauuuuuuccuccuccaggguaaauauuaauaacucaaauuccuuuaaccacuuuuauucaagcucugugaaucccaaacuccauuaacuuaaaugaagaaacaugguuaaacaauuuuaggcuauuuuauuaaugagacacaauuccauagcugaaaaggggaagcuaaaaucaguugaaacuuggaaugaaucaauaaggaaaagaaacuuuccugaacaaaauaagguuaaaaucauucaagucugcuacaacagaauggcuagcaacugcucugccgcacauguacacaaagugcuuuuuugccucaugaaguuucuuugcuucucaaagaugauucuuuaaggaggaaaaaaaaaucagaaaaacauuaaauuuuuaauaaacaaggcaucuagcacaucacaacacuaacucuucuguuauauuuggauauggccccaguugaaaaguaccucccagaagguuuuuccauuaaguaaaagauuagaucugaguucuuuucucucauuagaaaacagcaaucaauuuuuuuguaaugaggagucaucacuaaaauuauauucaugaggaugaagagugcuguacugauuuccaaucucuucccccucugacuuuauuuuuuguuuuucauaguuguuuguaagauacugucacauaagaaauaaauguaaaugucauuaugagagauuuggcaauuauuuggaaaauuucauuuaucugaguugcaauugauaacauccaagauugauucauuuccuaaggcaagcugagcauuaguuuguaugauguucuaccagguucggugacuucauauuuguugucagcaugcaggcaucuuugaguauguccuguucacauauuagggucauuguuauucauaguaacuucauauuaaugaugcaguugaauuuuaguaucaauguaggggucaagugucuggauggugagaauacuaguuuguuuguaaauauaauuagaaauagggaaaaaaaagaaugggaggccagacagcauagugugaauguuaucucuagauaguauguuuauuguagauuuuaauuuuuucuuacgcuuuucuguuguuuccaaauuuauaaaaugaagaaaaauaaguggaaucagagaaaaagaagaaauuacaguugcugcuuacuuauuuuguuuugcuuauccuaggauacuuggccaggcuuuuuuauguuuuguuuuuuuauaugauauuucuuuuucaagacaucuuccuucuuccccaugccacugaagcacauuuuuuucuaucuuagcuguauggaaaauacauaaguuuguaugacuaggaccugaagauacauaacuuuaacugacuuugauucuuuauuuuaauuugauaaacucuguuuguagauugauucuugcauauauuuugcuacaaaaugaugcuuauggccuuuguauuugaggauguugauaauugucauggagauaaauguguugagaugcacgaaagguucuaggagauaugaaaaacaauaugauaggauuuguaggcugaucauguuuuagagauauuaacuaauugaaagccauucaucaacauuucucaggccugagcuccuagaucauuguucagauuaaaguuccaauauauccauugaccauuaaaaguuacuuucaagcuguguauuaaaacuuaaucauggacaucuuugcuccugcuguccaaagaaauaccuuauaauucuuucauucuuagguaaauuucuggauuuccaaaaauggguccccuucaugcaucccuucuccccuuuuuucuuuucacaauugaaaaaaauauugccuucuaacuuuaugagacuaucaaggaaaaaaauccuacaacuaucaugagacguuaaagaagauagaauaaaacugaaugcuuugggaguuucggguaguacaaaaaagcaaggaauaauuugguuuauuuguuuuuuuccaucuaauauuuuuagguacaagccuaugcagaaaguggaugggguugcagaugguuucacaggaaguggucaacagacaggcacaucuguugagcaaacuguaauugcccaaagccaacaucaucaacaguuuuuagguauguuaagguguaaugcauauuaguugcuacuaggauuuugaaaaguuagucuuuucuccaagugcaaugucuauuauagaugucaaugacauagaaagauuuuuuuuggugccaaaauuaugcacaucauauguauaacaguccuaguucaugucugccuuucguguuuauuagagcuuauuuuuaaaaaucucgagcuauauaggacuuuuaugcguaugaauuaaagacucauugcuaugaaauuguuuuccagaauuuguauuauucggcuuuugugaucaaaauuaugcuguuuacuuucaguaguaacuucaagugccaaaaagaauucucauuuccuauguauaaaguuauauaugcacaggcucagauuagaaaaaaaauuuuuauaaacuuuuuuaaaguaauuuauucauuuaaauuaaucacaguacuuucuauuuuuguaauuuauagauggaauacauguuucuuguuauugaaagaguuaggaagaaaaacuugcauauuuuucauauuuuugccauagccaaaggggcaaaaaaguggcacuuuaauuugauugacaacucuucuagagaugaacaugcauauuuuccauauaacaggucaagauaaguagaagguaucagagagugacuguguguaugugucuguguguguguauaugugucuaugugcacuuucugacaaagacaacuaaaauagacucucagguuggaaucauuacugaaguugaaaacauggcagcguuucucagacugaaguccuaggguuauauucuuguggaccuuuggucauucaacaagaauuuuauuuugugauuucacuucgauuaucaucuuaaaaacuaagcauauucuggauuaccuagaaaacuagaacuaaauacuguucugcaauuuuaguuuccauauuuguaccuggauuuaugguaagacaggcaccaaaaugucuuacauuaauuguccagagcuaauaagaaaagaacacagagagacuuacuauguaaauuacgccucccucacaagggaagccuagaucaugucccuguauucugugugaaggaaaguuucacagucauuuguacauagaagaguaauaggagaagcagccaccacaaagcacauguugguauagaucugucagacccaaaagauccugugcugcggcagucaauacugauccuuguugcaagagauaacuuaguuacaggacaagagcaucauccaucacaucaaauuaauguuguuaaauuguauguuauuuuuguaguuuucuuuguaucugcuuuguagcucuuuagguuuaugacucuauaacaguuaagaacauaaugaguuuaaaauucguuuuuuuauguaauuaaacaacauaauaaaaauaucuaaaauagguacuagcaagcucgagauauuuuucuuuuaauaggggccuuguguugagagacacugugauaugcaguauacuauuugcaguauaauuguauugcaaauuuuguuucuagaaaauucuuaagaauguucccuuuaguuuuauauuuugugcugaugauguugcuuaguuuuacuuguaaaauauuaauauaaaauguccuugcucucuggaccccugaccuuuaaaauuuguuuuucuuuuuggucuucuuaaauuuucccucauuaaucuguaauuggcaccauccacaauagcuuuuuucuguucuguugucacgguaacagaugcaucucgagcacuuccagaguuuggagaaguugaaaucucuucucugccagaugguacuaccuuugaggauaucaagucacugcagagucuuuauagagagcacugugagguaagucuuuucaaauguaguaugaacacaugcuagguuuugccagauaacuugcuaauauaaaauaaucaagcuuauuccuaaaggacaggugaacuuagcacuaauucuuuugagcguaucuuuuagcacuaacaaauucauuuuucuucuuucuggucucagaguggagagaugaggaaugcagaaaagugagaauaaguuuuauucucuauuucuuaagccuauccuaauaugaauccuuuggcguagcaauuccaccucuagguauuuguccuacaaaaauauuuauaucugggugacaagagaaguguacaagggcauuuguugcauuauuauuuuuaaugcaaaagauugguuauaauuucuuuaucuaguagggagcugcauaaauaaaauaugguauuaauacaaucuuuagaguagaauacuauacagccaucaaaagaauaggcaacucuauacacauaccaaaauggaucacuucgagauuuaaaguuaaaagaaaaagcaaaugcaaaaaauuauguauacauauuuucacuugagugaaaaauaacauguguguuuauguauguguauauauguauguuucuuccuuuuccuucauauauauauccauauguauggauauacauaucuauauauggauauauauauauccagaaggagaaagaacaagaaaauguuaacagugguugccuuugugaaggaaacugggugacugggaguuagaggggagagacucaacuuuucaacagaccuguuuuaucuuuugaauuuuauaucauaaguguauauuucuauuaaaauaauuucuggaaauguuuaauaaaccaccuuagguguucuuuccagggaucacugagguuccaguuuuguuuguuucacuuuugugguuaauuaggguuccuuuugguguuuucuagcccuacuccuacucucguucugaguaucccacaucagaauuugcuucauugucugggaggugagcucucugcaugccagcacauuaauguaccacagcucaccuggcaaaaaggggauaauggauuauaguaagaguuuucuugagugcuucuuuugaaagaagagucuauuuagaauuuaaguagcuuuauuccagggauauuugugaucuacuuaggaguaaaagauaauccuuuggauuuccugggcaguccuccugacugcugacaaugcaguaugcaguaagagguucuuagcucauagcauuaauagacauuuuccccgacaccagaaauaagaauugcuagcgcaaaucugagugcuugucaaggguacuagauuauuaaccaccaagggcagguucucuccuuauuaacacaacaugugccagaaguguucuucaacguguccuaccaguucccaacauuccuuggaaugaugaaagcacuuaauauucauuuuccuuugacuacuaugcuuuuacccauauuagagaauuucuggauuuuccuuauguauauagagaaaauuauuucuuucuacauuuaucaucuuauucaauaaagauuuguguaaagauucucuaaacaauuucucauucccauguguucaagugaaccuuacuuuaagcaaaccagccuauauggauuuuuuuuuuuuuuuuuugagacagagucucacucugucacccaggcuggagugcaguagugcgaucucggcucacugcaaccaccgccuccuggguucaagcgauucuccugccucagccuccccaguagcuggaauuacaggcaugcaccaccacgccccacuaacuuuuuguauuuucaguaaagaugggguuucacuguguuggccaggcugguuuugaacuccugaccugaagugauccacccgcuucagccucccaaagugcugggauuacaggcaugagccacugugcccacccuauaauggauuuuuaaaaaauuucuccuauuuauuaagaauguaaguuggagcauaauuauuuacauugcuacaaaacauacaguaagauuauucuaagugacaaacuccccugaauaagguugaaauagucuuugaauuauaagauuuguauuaacauaccauuuucaaaaauauacuuuuuaugaagaaauagggacauauauuauaaucuguguggaaaauggcaguccacagaaugauccccauuuauuucagaauuaccaguguuccuaccaucucucucauagggcugagcugcauauauaaaaaagaaaaauucuaauuauuuuuuccuguuaauaaauauucauuuugaauaaauaugaaaaacuuuugaaauacagcugccugaaucucauauuuagucccguagucauuugcccuaagccaguagaauauggauuauuuuaauuuauauuugccuauauauuuuagucugaacauauuugaaaguagguggacaaaugauaaaauguuuuauucauguguaaaacugccucaaaugaagcugauaugaaugucuuuuuugaaagaguuauuugagauuauuuaauuugaagagauacugaauuuaagauacacugaaauucuuuacuugccuaauuauauuucacauuuccuacaguacauauuuuuaaagaaagauuaauauaccuacuuugccuguuauugggaauucucacaauuuguuuaucaaagauauuuuuguaucacuaguuuguuauguaaggagcaaguguaacuuuuuauacaaguugcugaaauauuuuuuuuaauguagguuaaaagaaguguucuuacagcaaucucauauauagaacuauauaagguauuauguauaagguauuaauaguugcuccacacuuuuagagaugucucuuggaaugugccuaagcuacaauugagaaagcaguuacaaaaauuugcugcuggagaagauuuugaucuuugcugggaugagggacaucuacaugcccuuuauuuucagagcuugcauuuugcauuuuuauuguuacugaggacugucuaaauuaauuugucucccuaucuucauuuucaauauuuaacuacuugcaacauuuuauacuuuuagaauauauuucauaccaguuauuguguguaucauacauugggccagcucuauacagguggcccaaacucaacaaauaugaaguuaugguuuguuguuuuugccuacaauacucuuauagacacucuagauuguccccugauuucuuuuaucuuccacgaauuuuauagaucuuuguggggcuguuuuaccuuugccucaaaggugaugacaucaaucacauuauacugacuacuucugucuuuuaaugcccaaaauaaucacaaaaucauguguucuuggcacaaacagguuauucuuuaguuuuaugccugcuuuuaccugaaggcuuauuuacaaacuaauugcaaugacaggguaaaauuaucaucauugacaguuaacggaaagugguacauuuaagcaccauaaaaaaaagucuuagaugcaucugggaaauaguucuaggagauaaaaaaggagaaagaggaggugaggcccccgagauuugaaaaggagauagucuuaagguuguuccguaaaggagguaugcagagguaggauuggauucucuuuaauguugaaugcuaugcccagagaggcaguauccacugaaggccugcugacuccaugguuucugccccagccucuguuuggcugggaacacaguggaaccuguggucagcugccuuagacaaagcuaauucagcccuaacuccaucugccacacaaaagcaacuccacacccuucacuuccaccugcugugauggccagugguuaccuagcccaaagaggacugcugguaauugaaucuauguuuuguacccuuccaggucuuagaauagguagggugacaguaacuauagaggcagaaagaagcaguagguaaaggaaagaaagaaagaaagagagagagaaagagagaaagagaaagagagaaagaaagaagggagggagggaaggaaggaaggaaggggaagggaagggaaggaaggaaagaaaggaggaaggaaggaagggagggagggagggaaggaaagaagagaggaaugaaagcaaaaaugaaaaauggaagaaaaaagagguagaagugaggguggcaugaauacauuaugaaaagaauguuauccugcuuaaucuuccaagaauuuuccccucuuuaucuucuuccuagcuaguuucuuuuuuuuuuuucuuccacuuccuuugguaaaauuuaguguaguuucaccauguuaacuuaugaccccaagggagaacuugaccauauaaaaucuugucauguuagacuguccucacacagucccguaaauaauauuguaagguaauacugguaccauuuuguuuuuuaggcaauauuggacguuguugugaaucuucaauuuagccugauagaaaaauuguggcaaacauucuggcgcuauucucccucuacuccaacugauggcacuaccauuaccgaaucgaggucagaaucaacaucuuuuccaauucauuuucauggcugaguagaugucacaacuaauaaauuagagauauguauaccaguugugaaccuuaccugaugacauuaauugaauagauugauguuuuggccauccuagaaauaaaccaugaacugcucucuugagguuucaguguguguauauagcucccauuuguacugauuugggggacugugguaguuauuucauccucauggaauuacuaucauaucugccuuucauaccgucagaaaauacaaaugugcauagacagcucugggggaguguuuuauauaucugucugucucucucgguauauauagccagcuguauggcaccagugcaauggugguauaguucuaaccucaguaauauuugguaaacuuaaacuauuuuuaaaguccauuuucuuuuuuauccucauuugccaucuauucauuugcuacauuuauucacaccagcaaucugagugaaauagaaagucgacuuccgaaagcaaagcugauaacucugugcaaacaugagucuauccugaaauggauguguaacugugaccaugggauguaccaggcuuugguggagauucucauccccgacguccuuagaccuauuccuaguaaguuaaaugcagacgaguacggaugcuuuuguucucauacauuccacccaggaaguuuugagaagugacauugcaaucuagaaugauucuaauuucauuuagauuugccagauagaaaacaugcaacacagaauauugcgugaaagcagccuagagcaaaacuguaguaaaagggaacagaugaucuauuuuucagucuuucuuuucuuuuucuuucuuucuccuuuucuuucuuucuuuccuuucuuucuuucuuucuuucuuucuuucuuucuuucuuucuuuccuucuuucucuuucuuucuuuuuucuuuuuuuugauagaaaagccaaccuguagauauaacagccccaguaaacuacuuguaagaacacuagcaggccagucaaccguauaaaaauuauucuacccaaggacacagucuccuucauaaagccaaaaauuauggaaaucuguaauugcuaggccaaccuccuucacgguugcuuuugacuugaagugaaucuaucuugauuuccacugaaguugaauuccauuauaaaagcauuuacuuugucaccuacaucauguuaggaacuacagaugcgguuuccauuagcaguaaugguuaacuggcauuuugagagaaaaaucuuuguaacuacacaagcauuguaaucccacuaugaagaaaaugggaauuacauagauagguuagauuaccuuuuuaagugauggugcuuuuuaaacuacuuuguagcaaacaaagcuauuuucucaaguaucgauauaaacgcuaccacagauacuguuagaggcagcugaaacuauuuuaugccuauaucuauaugaguacacaguagugaccuuaacuuuuuaagaaaugagacaguuacuacucuacauugacaucaauaaaguaaaagcaagcauauagcuugugaaguuggcuacuguguacuucaaguauacuauucacagaugauuuguguuaaauuauucuagaaaauaugaaaauaggaauuuaguagaacaaaaggggaagauauuaacauuuguaugcuuauacuuucuuuuuuucuaaauaacaauagacaacaguagaagguaugagaucuuuaauauguucccggccaccuugaaauguaugcuuaaacauauuuccauauaauauuaaugaacacacguaaauuuauauaggaauaaguaaaaaaaaaauuagcugacauuaucucacaauuuuguaaauugguaauauauucuacucuaccuacagcaaguuuccuggcuaaagguugauuaaaagugauguuuuagaaaguuucacuagcuaaauucucuacugauuuauguuccagaaucggauuuuccuuguuuuucucuugcucccugugcucugagugauaaucucuagagauguuuauaagaaguugcauaggguagcucauuagccuaugacaucuuacuaccaacauaaaauuuuucucaugagauaaaagaagggaugucagcaaguacuuucuuuuuugaggcaaaucaacaacaucaguauucauuaaacaguucuaaaaucuuuugcuucuguaacagcaccauaagacuuuaacuugugaguuuaacaguucucuguuuuaaaucuuguaucaauuuuaguuuaauucaagcccauaauuuuaaguacacaauacacuggccuuugucuuuugcaaauuuugauuugaaaaccaguuuauucugucaaauagcuugucucuacauuaagcagacacccgaauaguuuuguagucucucugaaauuauaagaugcauugauauaccacccugccaagaaaauuuggaaauuuaauucccauucuacaaugagguguagcaaaguaaagcuuaaaauacaauuuagauagcuaucuucugcuuguaugcauuuuaguauuaaucuugagcagguugagacaagucagcuuuggaauagaguuuaaauuccaaaccauccauucaugaggcuuugaaaguugucagagucaaucugcacaauuuuguacauacaugaaucccuguagagagagcaaacuuaauuuuauuuuuaaaaauuguauuuuccuggcuacuagcacuucacucuaccauuuucuguccagaugggauuucuuuuuuuagcuaaaaaaauucugcacaucacacuaauuuaaugucagcuugaagcuacuauauucuaaaaugcaguuaucugaaaaugaaaaaaacguuaauuguaugagcacucaauggguaacacuuaaauguacaauuggaaguauaaccagagguggcccagaauaucauuuaguagaaaaaguaaaaauucacaauuauuuaaaaugcaaaauauaucuuuucucaccuaauugcccuugcauuaaauuuaucuagauaaaacaaggcccguaauaaauauuuuuaaaguaauauuuauagauuuggggguuauuuuucagauuaaauaauuaauguacacuaauuguaggaaaaauggaaaaugcagauugccaaaaugaaccuugaacaaaauuuuacuguuucaaaagggauuauuaauuuuuuuucacucuuuuucauuuccauucaugccugcccuccaugguucuagcacauaauacaacagaaaaauauuuuucuuuccuuuuucuuuuuuugacuaacaugggaagcuuugaagguuucaaaagauuaguucucaagaaauuuccaauucaguguuuccaguagaugauccucgugguuaaggaucugcacugcuugaguguuuuuccuaaccaaaauuuagcccguuccaaucucgucucuccaguuuugaacaguuaaacaaaucucuuaaaaacacauuuaguugucuuuauuauuggaaugggaaaauuuauauuguuugcaaauaacuugaguaagugaaauuauuuauaaaaccugguuuuaacagaagcauagagaaucaugucagacucauuugagcacagaaagaaaaaccaaggaauuuaagcccauccguaauauuaauauuccuggggaccucggcccaaaauauaacuguguuucuuauaguagcauauguugauaccuaccccauuauagagaaccuacaaagguuacuuuuauguugugggugcuucaggcacuugucuacuaaaugucucuaauuuuccucuacauuacuauggagccuugggcacagaggaaguaaaauacuauuaacuggauuacuuguugaacaaggaaaguauucugucuccuacuauauagcaaucucaguaagcagauuuuuucuuauaaaauagucauagucaucacugauaacugaagaugcuucucauuauuuuaugaccaccguaaaaucuucugucaugggaccuaucccuauuucagguuuuaacagauaugucaaggauacagaaugagcuauuuuaggaguaucuuaagaauacggguuuccguaacagcaauuuuaucauacugaucguuuaccucuaccugccaaaugaaauggaaaauaauugcccaaaaauuucaauucagacaauuuuaauuuuuaccuuuucaacaaggaugagagagaauuacucuaauucacagauucuaaguaaauagaugcauagagaaacagagcaagcuuugcauuauuuuucuuuuuaauaaaagaaaugaaaauagauuaagagcuugaaagaacaagaugaagaauuuuaaagaaaauacauagccuuuagcacaaaacuguuaaugaaaggaguguuuuuuuccaagcaagaaaauucuuuaaguauauucacaacugguauauguugcuguaagcaaaaauguuugaauccuuuuuuuucccaaaaaagcgucauaaguaucugggaacaaaauaacuuuaaaagaaaaagcccaaaauauaauucuuggaugcuuuaaaaaguuaggaauaauguuaaauaaaguuucaucaaugaggacaauaugaguucugugcuguaucagauauuguguacgagcauuuucuuuuauucuagcacaaacauuaauauucuuucauacuuuuuuuuauccugcuuuuauucuuuaauguuuaggugccuugacccaagccauucgaaauuuugcaaaaagccuugaagguuggcuuuccaaugccaugaacaauauuccacagagaaugauacaaaccaagguauacuuuauguccuugcuuuuucuuuuguguugaggaaauuauucugaauugugaacuuuacaucuauccuaucaaaugguauuauguaaaauguugagguuauaacauacaucaucuuuuaaaacugauuuuuauauuuguauuuuauaaccauguaguaaagaacuugcacaagagauguuugacaauguuccuuucaaagagaauagggaagcauuuuaaguguggugcauuuauaagcucuuucuaaacaauauaguagauauauauauucuaaauuauaucugugagaaagauauaaacuauaaauguuuaauuucaaauauuaaaauaauagccuagaauguucaaauaguuuucauuugaaggaauuuucuauuucuaaaauuuccugcuauacuuaucauauccugaaaaguucauagaaauuaauauuguuuugcuuuuucaggauguuuugguguuuuucuaaacacuggagaaugcuuuugugaauaaagugaacaauuaacucauaauuaaucaauauaucucaggaauguggauuauuuagcuagagauacaaauuuuagucucuacuuugucuccuacuagccaugcugcuuccaguuaaucugugaacauauccucauagcaagauuggacuauuucuaaauuuuauuuaaauguugguaacagaaaucacauuugugacuucuugucaaugacuguauuuacugucagacuccagcaauauacuuugccuuugaaucggggggcagaguugagcaauugaaguuauuuuagcugauaaaccucugugggaacauaaguagccuccaguucguuugcuugggcuuaaaguuugcaauaaaacuuucucucucuaaaacauauagaaggcaacauuucauugaugugcccauauuagauuguuccucuagaaaugugcuuucacaguagggccagccacguguggcuauuuaaauuagaauuuuaaauuaagugaaaugaaaaaacuagcuccucagucauacucgcuacauuuugagugcucaguagccuccucuggcugcuggcuaccauguuaggcagcauauguguagagcauguccaucauggcagagaguucucuuuggcauauguagagcauguccaucauggcagagaguucucuuuggcagugcuguuguauaccacauggaggugugcaagaaagaagguggccuuugauuauggucaaggaauccuuuucaacuuucagucagucacauuuguaacaauaccucaaacagcuaaaagcacuucccuucccaguguugucaaagugaaugugguaacaauccaauugcaacguuggccaucucauugaccuccagaguuugguugaaugauucaccacaguagaggguaccgucuguucuucugguuucacugauaugcagucuuuuuuccucuccacauucaauuaacagagacaauuuacccugacagaggaaacagcauuccaacuacuguggcuuuuggaaucaaaaugcccaggucaauucccaucaguaaugaaguuucuuugcagccuugagcaagcuacuuaucuucuuuaaaucauaauaugugucuaauaagauaguuaugagacuugaauaagauaauauauguaaggcacuuaacccagagccuggcacauaguauauacuggauuaauguaaaccacaaaaauggaauaagguucuuuuuugaggacguaugagcuuccccccaaguuccaaauaguccucaaacaucucaugucaagauagagcauccuguucccugugaacacccucuaccgcucccaauugaucauucaacugcucguaccuuauauacccauauagugauugagugcaauacuauacauuccuguagaugugucuauuuuuaaaauauauuuuuaaaagauuaaaaucauuagaucuauauugugcacauaacaaauuuccaugagauuaugagauuuagauuucauguagacauuuugcauuaucuuugcugucuuucaaaauaaacugcuucauucagggucugaacaggcaacaaaucgugcauccaacgguggggauaaacagaguuuaagaagaguuuauuuccaaagguaugaacagaguugaaaaaaacaaagaggaauaguaaagcaucccagggcuagcaauagugggaauucuaaccaucccuaggaaugaaggggugagaggugaaaguuauggcauuaggaaauccacucuuucccucaggacugugguaacauuagaaaaggaaagcagguuccgcucuaacaggcagcaagcagagguugcagugaauaaguacccugguaaccgcucuuucuucccauccuuccaucuccugccagugccuguuauuggucaaacccagguggaagccagagaacaagaggggagguuaaugugguccauucggaucaaucuuccugggcacagaacaagaugaagaaaaauggaaaguagauuuugagaggcaaauagaaauuucccgcauagcccuuuuaaagaaacucuaauucugaaaaaagguuauucuaguugguugccucugauaaucucgccucaaaauuacucguuucuauaaaauaaagguaguaagaauaaaucugaaugguaaugcucucacaugcauuuuuaaauacaauguaaagaguaggaauguccagaucucuuuuuauuugaaagggcaaacugcacaucccuacuuuuaaaauuugccuaguuucuacuugacuguccaaagaacaguaaaaaaaagaaaugaaaaccaacauuuuucuugcuucccuacucaaagucauuucuuacuguggaugaguagucacuugcaagacuaguuuaauuaaugcuacgcucagaugucgaagaaugugggaguuuguuuuagucuugaccucaaccuacucagaaggaaaauaauacuugguuuagagauuuaaaugcuguaauuuacaaguaaacucucucaccaaaugaauuuuaaauaagugucagaggcaagcauuuaaaauuugugaagggaaagaagauuugaaaauugcagugguuucuuuuacuggaggaaacagaaucccaacuuaauuggauugcguuacagguugccgcuguaagugccuuugcccagacucugcgaagauacacgucgcuuaaucaccuggcccaggcagcucgugcagugcuucagaacacuucccaaaucaaccagaugcuuagugaccucaaccgugucgacuuugccaauguccagguauucuauuuccuugcaaagcaugucucuuaaggaaagauacccaauuuguucuucuuaauugggaucaucaaauuucuuuucaaagucucaucuauauauggcagcaucuauauucacaguguucugaaagagaggaguuugacccagauacagcuguagugcucccauguuugugguuaaaguaagcucacauuuacaguccuaaaagacaacguaauauaucaccagcauuugcugaauaguuaguagaguaauaaaggucacagucauugaaguuagacaggcaagaaauuaagcugucucauauaccagcugugggaucuugggcaauugcguuacuuaacugcucuaggcuucacuuuccccaccuuacaacaccugucuuagauuauuguuuauauauuuaauaauuuguaccaugacaugcagagauauuucuauuuuguugccccuccuugaaagaacuaagaacaauucuauuucagaguuuacuauagcugccuaguaaauauuuauucacuugaaaagaauuauaugcaauaaguucaacuauugugguaguucaaaugaaaaaauauuuuuuaaccuugugaucacauuacccacuuguacuuuaaaguauauuuuaaaagcuaaguuagaaacauuauuauagaguuucaauaucaauaaauacuuuauuuuugauucuaaaguaaugaaucuaaauguuaccaaauaaaaacaauagcauugcccaccaaaagcauaagcaacaagaggaaaaauacauaaacuguacguaaucaaaauuuaaaacuuugggguuucaaaagagaccaucaagaaugugaaauggcaaaccacagaaugugagaagauuuuugcaaauuauauaucugauaaaggacuuguuuauagaauauauaaagaaccauuacaacccaguaauaaagaaaaccugauuaaauauggacaaacaucugaguagacauuuccgcaaagaaaacauacaaauggccaauaaucacauuaaaagaugcuuaaugucauuagccaccagggaaauacaagucaaaaccacagcgagguaccauuucguauacucuaaaaugggucuaagcaaaaagacauauaauaacauacccuauuggcgaggaugugaaaacauuggaaccucauacacugcuggucagaauauaaaaugcuguagccacuuuggaaaacaguguggcaguuugucaaaaagauaaacauauaguuaccguaugacucagcaguucaacuccuuguuguauacccaagagaaaugaaaucauguccacacaaaacuuauacauagagguucauaacagcacuauuuauauuagccacauaaaagcagaaacaacccaaauguccgucaacugauuaauagauaaacaaaaugugaucuauccauacaauggaauauuauugggcaauaaaaagaaaugaaguucugauucauucugcaguauagaugaaccuuggaaacaugaugcuaagugaaagaagccagguacaaaggaucacacgugacaugauuccauucguaugaaauuccagaauagauacaucuauacagacagaagguagauugguaguuaccuaggccugggggauugagaagacugggagguaacaaauaagagucaugggguuuauuuuuaggaaaauuaaaaaggucuaaaauugauuguggucagugauguacaacuuugugaauauccuaaaagaaaccuuugaacgguauucuuuagaugaaugaauuguauaauaugugaauuacauuucaguaaagcuguuaaaaaacauuacuguuguuuuaaaaauaagcuaauuaguaauuauuuuauuuucuagaaauuuuaauuucuacuucuugccuaguuuugucauuuaaaauauaccaaaaaguaacauuugggcuugauccauuuuagaguacgauaaaaauuaguuguucauugagacuuucauggacuggguucaaacuucugagauauauauauauauagagagagagaucuauaucuaucuaauauuuuauauuagauauuuauaucuauuuauaucuaauuuaaaacuauauauaugaaguuuuaaaaaauaucaucuauccaucuagaaaaacacauacacacauacaaguacauaaucuuuacaagaacaaaguuucucagcuuuacaaaaccauuuacuuuacauauuuccgugggauguauuaacugaauaagcaagaguauuaaaaguuaauauugccuuaaaaucuauacuguaauauuuauuucaaaucuuuuuucagaaaagauuuguuuaaaagucucuuaagaagaguugaagaaguaaggcagcuucuaguuucagaaaguaauuuaaacucaguaacagaaaacauuuuaaagaauuauuuauaauaauauccgaaaaaguuuuucaguguucuguuagcauuauuauauguauaaauacauauauauauauuuguguaucugcauuccaaugaaguauuucuacaaaugaguucuucccugguuauaagcauuaaccuugggaacauuuuugcauauuaaugaucagugauaugucuacuguacgacuuauccucuaccugccaacuuuaagaauacccuuucuuuuccucuauuuuugacuaucauguuuuucuggguccaccaugauagccauuacuccugaaacccauaugauucggcaucugcccuccaaaaccuucuuccuuucuucagaguaccaugacacaguagugagcccuucauuucccccuacauuuuacuuuucacagcucuguacauauuaaugaguaaucucuuucucaagguagcacuuuuccucuuuaacacccuuauuucuuuccuuuucuuuuccuaguuuugccagauuuucccagagucccuugccucccauuuuaccuuuauccccaucuccaguucauuuggaagucgucccagcuucuauaacaugaaccucaauaaucugacaauauaagaaugaugcucuuguaauaaggagacuucuauuuaaaacaaugaaauuacaugugugucaauauuauaauacacuuaagagcuugaaagugcuaaaaaguuccuuucaggauauccauauaucacuuuucacuacuucauucuccucuaauuaaauuuucuuuucuuuaugcauuuaagauaauuuuucuauugcaguauaacugguuuccuguuucauuuaauugauaguauuacgauggcauaauucucuaauuuuuuguguaaauggugguuuuugagaucuacauuaugggcuaaauagcuuucggugggcugaccugauaacuuagcuauugcauauaguuguguuucuguauuuaaaaggcauucugauuuugaaguuccugacuacuuuucauuuuggauauuuuuuuuuucuaauuuaagaacaucucuaaguguccuuagcuuuuuuaauuauagacuugaaauaucuacauucguuucacaagggaauauuuacaaugcgcucuauuguuaguauauuuucacuuuagagaguaguaaaaugaaguauaauauaaaguaguuugaaaagccagaauaaugugcugugguuuuauuucucuaaguuagguuuuagauuaucaucuuuucuuggcaaaaacuaacugccaaguaaauagugaguuugaauuuaugguaagaaaugaaauuaaauuccuucauggauacuaguaaguuucuccuuccaauuaucaacgugcaaacaaacaaaaaaaaccucuccugcuaauuucagcuuuauuuguaauacuaaaauguuggaacaaacaaaugucuaacuaugugggauugguuauguaaauaauaguauaugaugcaauaaaacaaauucauucaguggacaaugaagauaggucuaauuugccuacauggaaagaugguuauuaaauauuucuaagugaaacuaagcagaauaucuaauagaaaauauaauaugauccucuuuuauuuuaaacauuuaaguauguauaagcauauaauaauauaaaauguauguguagauauauguguuuuauaauacaaauauauauuuaaaauauaaauguaugcauaaauaauauaguguauauauaugaugauauaugcauaaauuauuucuauaugcaugugaaaaguuugaaagguacauacaucaauaugcuguaauuucuuacuguugccauuuuaaguauucuuaauguuuuguuccuuuuuugcuuauuuguauucacaguuuuuucuauaaugauauuuuaguauacuuaaaauauuuaaaagugguauucagaagguaacaucugaauggauuuaugauuaauuagauaagaggaaaaaagacagugaauaguaucaucagcugagauauagaagaaacaguagguuucccugggaaaauaaaauaaguugaguuuggggcauuuugcauuugaagugccuucagguugaaaugucccuugaauagguaaagucuguaggaucaggagagauacuggaacuagaagauggagauaauggauuuauucaguugaaguuguuaauuugaaugaacuuguuuuuugagagcauauagaaaaagaagcuauagacacucuuuugagaaaaauacauauguauucacaagguuuuauuaggagccucacagacacuucuccaaagaaaucuaucuugacaaaauuaucuggacacaaugaacccagcuuaaaauuuuucauuaaauuucauuucuuuaauuuuaugcuuagggaaacugaggcccacauaaauuaauugcuugagguuaguuuuguuuauucaggaccuaacaccuaugucuucucauucccagucaaauauuacguuaccaaagaauuauguuuugccuugagugaauagguuuuuuuaaaucuuaaaauacaacauagcacuggaaacaucacaguacuuauggcaaucacugaaaaguagccuuaaaaguuccuauuuucauugcuguuaccaaacauuucccaaccagaaccagaaggaaaauugcaauaaucacauuuuuuggcaggaagcacgucuacauuuucucaagaguuuuuguuguuguuguuauugugguuuucauuucucugaauuaauuugcauucauagccuugccuugauagcccuugagauuucuguucccaauccauauaacucacagcagcauaugcuucuaccuaguaucauuuaguguuuguuucuguuuuaaucuugaggggaccucuuuuggccaauuuuaucuauuuaucugucugacuuacccuaaaucuucucaaauaaauugguuuuaaaguuuuaucugauggggaacaaaaagacaacuucugaaagcaguaugaaagcugaauaggaugaaagacccugccuacuguagguucagacuucuauuuuuugaagucaucauguauuuuagucuuuuacacagacuaguuaauguagaaaaaccaaaugauacuuacaugugucaucacuuuucuguguaccagagugagcaacgagaaauacucaucccuuaaaacugauaaagauuguguuacccuaacaauugacaaguaguuuuuuauuuucuggauucauuuaacugugugaagcuuuuauuauaauuuucuguucuugcaucuagugugugugcuggcauucaaugaaaggaugcugaauugaacuuuuccuuuucuuucuguguuacugucucaggagcaggcuuccugggugugccagugugaugacaacaugguucagagacuagaaacagacuucaagaugacucuucagcagcagagcacccuggagcagugggcugcguggcuugacaaugugaugaugcaagcacugaaacccuaugaaggaagacccaguuuuccuaaagccgccaggcaguuucugcuaaaauggucuuucuacagguaucaucuagguuuuuccuaggcuuucuucuucauauucugcaaauauguguguguauguguuuguauaugcuucugugacaaaagaaaagaaaguaauaaagacuuuaguuuguggaaacucccuguuacaacuaccuucaacccaacucagugauuacaacaccauggaaauguaccaggaaacuuagagaaauaaacuuucugcuaggaaaagaaaucucuugcucaaagcccuacauguccucagaugggaacgucugagauuccagucuagauaauguguucagcaguaaucagaaaagggcaacuguccucccucuugcaacauacauuauuuaggcuucuuucuugaggccuaacacuagucuccuuuuuguucucuguuuagugauguucagaauguggucccuaaaccaguagcaccacuaucaauuggaaacauguuagaaaugcaaauucuuagcaccuccuccaaaucuaccuguaucagaaccuguagagguaaggcccagcaauuuauguuuuaaaaaguacuuaaguugauucugaugcauacccagaaccaucuauuuaacuucuuaauuuuaucaauuauaacuguuuucaaaccuggcugcacaucagaauuaauguaaaaaaaaaaaaaaagaaacaaauccuaggugccucccaagaccuacuaaaucaaaaucuugguggucaagagauagugauuaguggcugggcacgguggcuuacgccuguaaucccagcacuuugggaggcugaggugggcggaucacgaggucaggagaucgagaccauccucgcuaacacgguaaaaccccgucucuacuaaaaauacaaaaacaaaauuagcggggcaugguugggguugccuguagucccagcuacucuggaagcuaagccaggagaauggcgugaacccggaaggcggagcuugcagugagccgagaucaugccacugcacuccagccuaggcgacagagcgagacuccgucucagaaaaaaaaaaagagagagauaaugauuaggaaugaggauaaucaggauuuuuuucacaaagcucuccuggugauucuaaugaucaucaguaaucucguagacaguaacauagcuuauuaauaauauaaaucacuuuuugacuaaaauaguauagauagaaacguguauuuuuguagacauagaagcacccagaagaaaagggcuuucugauuacaugacauauaucaaaugaugggaugagcuguugaccauaacucggccacaaagauuaaaaacagcauuuaugaccuuuguaggucagugucucuaccauauauguaggauggaauuggcagagggaauucuuccauaaguuggguaaauuauauuuuuaacucuggcauuuguucuuauggugagaguucauuuuuuagcuucuuuagauaaagcuggccccacugauuuggcccuaagauuaauaucugcuguaaaguauaggcagucucuacuguagauucugugcagccaugcacauaucagaaagugguggccacaggacauacaccugacuguagcuguggcuacacuauggucauccucuggacaucaguggugaguccaaagcuaguugugaggagggaaagacuaugaaugaguaauagaauguaggaacuaauaguacuugugaacucaguagacccagacuauaggauuuccauauugcuuugaccaccuuugguuauaaugauggaaucagaggucuuuuaauuaugaugguaguuccuuugguuuuauuauaagugacuuuuuucuuucucaacugauuugguccauauucuuauuucuuaaacugaaguagacguauagauccacauuauauguuucauaagaguuaaauuauccuuacguccugaaaauagcugucuagugucuagcccagggucaaaugcaaugaaagaaagccaaccaguuuuuugcuguuguuuuguuuuuguuuuugcagugguacaauuccacaguccugccucucauauauuuaacaccuuuagcccacauaauucaagaagcacauuauuaagguguugucuggcucugugacccacuaguaugcaucagugaagccagugcuagguuuggaucuggguguuuaugagaaauguguugaugagaaauuaaguuuucccuugauacagcaggaggauuugaaaugcguuaucacaguguucucaagguagaugcagcaacaguuguaguaaugguagaauuagaaaauuuaauuugggaauauuuuuuaagauuucagccaggcacgauggcucacgccuguaaucccagcuacucgggaggcugagguaggagaauggugugaaccugggagguggagcuugcagugagcagagaucacgccacugcacuccagccugggcgacagagcaagacuccaucuuaaaaaaaaaaaaaagauuucagauauuuucccaguugcccaacaguuucuuuuuauucaucaaguuuuuucccagauaacaacguaagugguauaugugcuccaugaauaauugaugaaacagcaguacacugacuggcuguuccaaaacuuauaugaccaaaggcagaguccauccucuacauccaaaaaagcaaggugcuuuuuuucuuccuacugcuuucuuauguuauuagugucagacuugcccuuacgucuaccugugguugguuuuuuuuuuuuuccuauauuuaguugaugucauuuuagaaauacaucccuggagccuucaucuccacagagaucuguugcagguaucuugaagggagagaaaauuacuuacuuguauuucuuguucucugcagauauacaaacccaguagaucaucacuugccugcccucuguccucccugaguugaggauaauuggcuuguuauuauuagauacuauuauaguuauuauuuucguuucaaaaagacuugaaggccuacaguucagggccccagaaggaaaggcacauucagacagaugcauaccuccugcugguaggcaaagucaauagcugagaaacuuaagccuuuaauaucugaacuguuuuuuacugagacauaagaacauauugaguaaugaaaauuacauucacaaacuaucagagaagcagaauuagaauauuuuuuaauguuuuuggcauuacagaugccaaaaauuuguaaauuuguaaaugccauuauaaauuuggcagucacauacacaggcccuucauguucugaaaucagaugcuuaaucuaauuucuaaaauuuuuuguauauauuuacaugcauggaaauauagaaaugaacuugccgagaaucauaauagcaguugauacagcgcuacaaagagguucugcucugaaugggggcucucuccuugccuaaccuggcugucagugacuaauugugguucccugggaggcagaaaaaaaaaaucacugccuuucuugggcagaauuggagaaguuauaugggccauuucucagcuuguguguuuuggauaacagaagagagcauucuucagggccacccugaaggucauucagauaucccauuuuuaaagaguggaauguauagcuuugauauuuggcgugaaaguaggcacagggugccuaguuugccuacaacuggacaauauaugaaucuuccaaaaaguaauacucuuuuuugaaucaacuguaagcacuuuucaaagagugaguucacauaaggaucacaggcgugauguucucaccugaagggugugauacaucuucaaacacucagaagaggcagguuggcuaucgcauguuagggcauauauuucaauuuccacgccaugaguuauaaagauaaauacacaaagauauuucuuguccauuauaaaauaauuaacguuuacaacucugaucuuaaaaagaguugaauucaugguaacuuagcaacaauucaguggagucaauuuuacaacauuucuuacggaagucugaaucggacaauaggauuccaauuaaacuguuaauugugucauuuaauacuuggcauguaaagcggaggccugacacagagagaauaaaguagacauagcguuaaugauacaauucaacugauucuuuucuaaacauaugacaauaauuucaugacauacaugucaguauuuuuuaaauaacuagguauuauaauugaggaucaauaaauuuuuuuuuaaacuuccaacagaauuuaguauuacgugugcauuuuaugcugaaaucaggugauugccuaaccauccaaaaguuuccaaaacacucagaaugaaauccaaaggccuuaucauggccuacuagacccuacacaguccagccacuagagucauccagacccuaucagguauucuucucuuugcucacugccuuccuaccacauuagccuccuggcuacucuuugaaaacagcaagcaguucugucucaagcucuuucauuugcucuccuuucugccaggaagacucuucaccuguguucguuuccucacuucaauccaguuucugcucagauaucaccuccucagaaagaauuuucuagauaccccaacuuaaaaugccugcccucaucacucuccaaucucuggcccugauuuauaggaucucuuacucccuaacuuuauauuuuuuuaucuacuuguguauuuaccaacugucucaccuaacagaacgugaacuuuuuugaaaccaaauuuugucugucuugucugaaccaagacccugccgcagaguaggaacacaauaaauaucugcuaaauaaaugugaauuuuauuggaaaaaguugaauuugcauuucuaaaaugauaucagaaacuacuuguuaugaacauucuccuuaguuguucacaugauuucaggguuauuauauuuuaacagaaggccgaggugggcggaucaccugaggucgggaguucgacaccagucugaccaacauggagaaaccccgucucuacuaaaaauacaaaauuagccaggcgugguggcgcauguuuguaaucccagcuacucgggaggcugaggcaggagaaucgcuugaacccgggaggcagagguugcggugagcugagauuaugccauugcacuccagccugggcaacaagagcgagacuccaucucaaaaacaaaaaaaagagaaagagaaauagaaaggccuaaaauuugaacuuagaaauauauaaagaaagacucauucuguaucugugauauuuauuccugaaaagauuuauuaacauucaccugacucaguauuguuuuucuguauuauuauauaaugaaugacaucuuuuaaaauaaauauuuuuauuaugcaguuaauauaugcucacauuagaaaaugugguaaauacaggccaggcaugguggcuugcaccuguaaucccagcuauuugggggaggcugaggcaggaggaucaguugaguccaggaguucgagaccagccugggcaacauagugagaccccaucucuaacaaaauaaaauaauuagcugagcaugguagcaagugccuaugggaggugaggagcguaagaucacuggaacccaggaguucaaugcugcagugaacuauaauggcaucaccacaccccagccuggacaauacagcaagaccccugucucuaaaaaaaaaaaauaauuaauuuuuuaaaaagauaaucuaggaaauacaaaaacuucuacccggaaauuaccacugguuaaauguuucuuuuuggguuaaauaaaauugggauccaguuguuuaccauaggcuauuuaacuauauuuuucucuuaacauuuuuuauuugcaauuauaucuuaagcauuucuugccauuaaauaucuucagaaacauaauguuuaacguccucauacuauuucauuauguuuaugccucauacauuauuuaaacauucccuuauucuugaacauuaagauggguuuugguguuuugauagaguuuuuaaaaaugcuguuaugauuaucuucauauacgauuguacguauaucuuuggauaaguucaaguaaaaggauauaaacauuuaaaguaacuaauacuaguuuaaugaagugugugaucucaaugcuaauaaaguauuagauauuccaauucacuuggggguaggaauuuuuugauguauggaguguuuuuauguaaaugagcucauguaucuugcuucaacuuaacgauuauauuauaaacaucuuuguauguuacuacuuaugucuacuucauuuuuuuaaugauugcauaaaauuuuauaucuggaugagccauaacuuguuuaaucagcauccuacuagauuaucuuuuuaaugauauuuacuuucuuuuccuaguuucucauuaguagaaauauugugcugcaguugugacuaucuuuggucaauuguguaaauuucuagaauuagauugcugggucaaagguuuugaccuuuuaaauuuugacaaauacugccaaauuucccucuacaaaaguuuuaugaauuuauauucauagggacaguaaaggagaguuuuuccaaaccagcuauaacauugggucuuuuaaccucugacagcuuuauagauuauauaggguaucuuacuuuaauuuucauuucuuuaauuccaaguaaaauuagucauguuuuuguauguuuguuaggcauuugucuuauacuuuaaauuuuuaaaauuugaaaauuuuaaauacuugcuaucuuucuucagcaagauaaaugcaauuaggagcaaauauucuguucaugcuuuacuuuaaaaaucauuuauuucaagucuuuguuaguauggguaaaaacguuauguaacauuuucuuuuuauuuuuguguuguuuuugcuuuuuuaguaagugauucacugcuuuaaaauuuuuuuuaccauaggaauagaaauauuuauuuucauauaacucuuauauuguaaucuuauaaauuauuuuuacaaauuggugauaugucacugaauuuuaggaaagacguggauagaguuauauauagaauuuugucauauauguuggcaugcaaaugaaaguauucauuuauuuuuaauaauuauuuauagagcuguaaacuuaaggaauucguuaaaguagucaacucuaagauaucauucacuagaccuacuauuuaugauaaugaauauauuauuaacacuaauguagguaacaguauaguuacauuggcaguuuucuuaagauuucacauacauuaugucauuugacucuuaggcuaaacuuugaaccuuacaaaaaauuauaugaucacaauugaaaucacauagugguaacccgggucuguguaacuucaaacccgugcuuauucuuauuauuauuauuuuaguaaauagauccacagaauugagagguccucugccaucaucauauaauaauugcuauucuugccaccauaaauaaaugagaaugagaaagucagcuucuccuauucuguguauuauaaucacaaucacuuauauuugaauagcguucuagucauccauaaguugauuucacauccuuuaacuuauuuuauccuugaaauaagcauguaaguuagauaagacuaaaggcaauguuuuguuuucaugcaagaggaaaaacaucucggggaaaugauguuuuugagaucaacagucaaugaagagacagaaucagaauucaaggcuucuguguuucagauggacaaugaugaucugucacuugccaaguugaaugcauacaauuugauguauuaguagccucuauuuaaacaagguugaaaaaugaaacagaaaacaaaaguacagucuuuuguuuuuccauuugccugaugucuuauaauucuuuacuguaaaacgaggcauaggugaguuuuuaccucuuucuccugagaauacaaugguuguuuuaguguucaucugccaaaaaucuuuagaaaaaggucaguaaaugaaagugauaagaaacacacacauacacacacucacacacacacaucacucugauucuaaauuaugacuauuuuaagauuugaagugcaugaacaagcuuaaugauuggcauguugaagccaagauuuuauuuuggacucauuuccauuuuaaauauaauagaguuuauuauaaguauuuuauaaauauugcuuauauuuucguauuauauacuuuaaauguuugcauuuucaaaaauaacgcauuucuuaauugauuuuauugugcuuauuucuaauguaaaugugccuuaauuuaaguggaaaucauuaagaaacuggaaacacuuaauacguuugccuuccaaggaaacuugcuggaaucccuguacguacuugccuauacucuguauugccacaucugggaacauugcuuauuauauuuugugagcuuugucuggcagaaaugcaucuuuuuucuaaggccuaccccagagaucguuaucacugagaggggacagacugccaaccuucaucaauaggauuuucacucaaguuguuuuucuuaggguaguaaugaguggucaaucuuucagacauuuuuguguucaauucugauuuauuugugaguuugguagaagcagcagacuugcccaugauaguagaaugacuuuuuccauuaagacuaucuaucuugaauaaggaucaagucuccgugaggauuaccucuuuaucauucuauuuaaaugaguugcaacugcguucaauaaugaaaugcuuucauggcagguuuuauacuauaccaaccauauagacucccagcuugacuuuuuuuuaagaggaaaaauagguagaaugcuaauucuugucacuaauguuagcugcauauuugucuuuucucuuggaacagcucaaugguuauucgggacuuaaccuuacgcagugcugcuagcuuuggcuccuuccaccugauccgucuacucuacgacgaauauauguuuuacuuaguagaacaucguguugcucaggcaacaggagagacuccuauagcagucaugggcgagguaagagaggcugaaagagcugugacccacuggguuauuaaaaauaagccagaauuacacuucagucuaaauacauuauugauuaaaaccaugguuccuaaccaagucagccucagagccaggagggacuguggaguuauugcaagaguuccuuaaauuccucuguucuuaugugcuuaaucaaaagauucuaaaauuguggauuauaucaugugaaaguucauggaaugugucucuauauuauacagguaccuauguaaaagaaaaacuugagaaccacuggaauaugaaaaauauuuuaagugggaaaaagauuggugcuccugauaaagcaaagggcugggaauacaauggaaaggauuaaauauguauuuuguagacucuuucccggucuccaagaacaaaguaaaugauucuauuuuagaaggauaaaaaugguaaugaugauaacuaacauuuuuuggacacuuacuaugugcgaggcacaguucuauguuuuuuacauguaauaaagcacuuaaugcaagucuuugagauacguucuacuuuauucuguuuuacaauaagcauccgagguuuaugcagaaagcuaaggcacagaaagguuaaaugauuacucagcuaaaaaaugguagagauuuuuuuuucaaacacagucugauuuucaaacccauaugcuucuaaccacuaaugauguaagggggaaaauucucuucuucagaauuucugaauagucaucaaaauggcuuaucaaaaagcuuaaacucugaauauaacaagggcugguuaauauaaugaggaauagaugcaaaugcucagaugguucagcacuggcuuauuuuguuauauugaaugcaggaggcggggguaguuuauaccuugucgaaucauaccagauuauuaaaugugacaaauuacccaaggcgguaaaaaagacauguucacuuuuaagcuauguguaugugcuuauauaaauaaaaaagagugaaaacagauauuauucaaugcuuuuccuaguuuaauauaauaagguauaaauaaaaauacauuaaaauacuucaaggaccucccuaauauucuaguauaaauaaaaugcaugucaaacuugccuagaaggucaguugaaauauucaucuuuuccacuucuuuaaaaccccuugcuguauauccaucuaaaugucuuuguaugauguucccuguugaugauaaagcuuaaaugaugccaaauauaugugugagauuaagcaggaaucacuguggcuuuucauuguaagcaggaccucaugugaccaaaacaaucuggacuuuucuuauauuugacuuccccucauugccucuuucuuuacuuguuuuauagaugccuuguuggaaaaugcccagguagcacguggacucaguacucuaaaauuucuuaacucaggguucaagacuucagaaauggaccuugccuuuuaguauacuuaacacauuugccacuaccucauaugcucaaggacuucuuuaacaagauaaauaggauaaugauggcggggauucucauuaacaccauguggcuaaucuugaugcauggccuuugcuuuccuugcaucucuagggaacaaaggcaguggaugugagccagucacacagugugaaggcuuagcaaccuccugguaugcuugcacaggcggcaccagaauuaaaaugggcuacauaaucuauagugccaacuccauucuaauaguuauucuuuuuuuuuuuacuacauguaaacgaucuaaaugaauaugacagauuuuacaugaggcaaagauauauacguaaaaucuaaauuuaaaaaauggucaaagaucuaaucauacuucuugauuucuuugcuuacucaguuuauaggaaagcccuuugaccugccuaugcucauccauuauuuaccccaaaaggcaaauucagacuaauuuuauagguuugaucuccucauacaacacugaugccucauacaccuguuugcucucauagaucuauuggccauggucauacuaucauaucuaaaauuucuugauuuggggaaaaggagaaggaaauucaaaaaauaaaaaguuuguuuucucauguucuccucacauuauccuaagccuaccuucucuuggucccuugggugacuuccuuuuccaaucaccaaauccagacgugccuguguacauagugggaguaacacaucaggccaaaauccauugaaauccauacaaaucaccauaacucccagucacagcaaaugguuuggaauaaugaguaauaauagcaaccacaaagacaauaacaauugucacuauuuacugagagcauauuauauacuuaaugaagauaauagucuugcuguaucaacuaauggcucuuucucaguaaauggcgccacgauccucccaguugauuauaccagacacgugagcauucuuuuuuuauguccuucuaucuugacucccaucuacaaccaauuaccaaguucuguuucucaaaucccucagagugcagucaguaucgucuugugaaaaugcaaagcugacugugucaucccccacuugaaacccuucagugacuuucccuuguguuacuaacaugagcucuugcaugaucuggcccugccccucugaucaacaucagccucccacuuccuacucuuucuguugcaaucacaguggccuuuucucuguucucauucacuaagguuuucucauccuuggacuacugcauaaaugguucuuucuaccuggaagccucugcccaucuccccaugcccauucuaacuccuacuucauguuguaaaaaucaguuucucagggagacucaguuacuccagaauaccuuaaacaguucaagucuuucugauauguacuuuuacuugucauucuagaagcuccacaauacuaauugcacaguucucuguuugauuuguauagucaaagauguaauaccuggaaacaauaaaggacuuugagucagaagugaauucuacuucuagcucugucauggcuauuaguauaaucuugggcaaaucauguugacuuguguugaacucuagacuucugaucuccgaaacugauuuaucauuuauuaacaaguuuuuauugugcagauacucuaugccaaagcuaucaugauuggaauauaaugaugaaaaaaauggauuuuuacccagccuucgaggagcuuagauuucaagugggggauacauauuuacauagucacauaacuauagcuacaaacuuuguuaagugcuuugaaggaaaauuaaagggauauaagaaugcuuaaagcuugaggcccuaaaucuagccugggaggaccagggaagucuuucccaaggaagugauguuugagguaagaacuaaaggacaaaagauguuaacucugugaagagagaaucugaagguaaggggugaaaaacaccccaggcacaggggaaugugcacaggcccugacagaggugggugagagcacagccaaggggaaguuuuccugagaaaccuaacguucaagcaccagggagaccaaauaaacacugucaaaugcaacagacaagaggaaaaauugaauuaggauaaaaagucaaaauuucaagugaagcuaacaccuacauagcaguugugugccagguacaguucgaagugccauauauauauguuaauaacucaccacagaucuauaaguggauacuauuauuacaccuguguuacaaaugaugaaauaagaggccgggcuugguggcucacaccuguaaucccagcacuuugggaggacaaggcggguggaucaccugaggucaggaguuugagaccagccuaaccaauauggugaaacccugucucuacuaaaaauacaaaaaaaauuaggcgggcgugguggcaugugccuguagucccagcuacucgggaggcugagaccaggagaauugcuugaacccaggagguggagguugcagugagacaaggucacgccacugcacuccagccugggcgacaaagcgggacuccaucucaaaaaaaaaaaauaauaaaaauagaaaaaaagaagaagaaaugagacacagaaccaaaaaguaacuugcccaaggucacacaaccacuaaauugugaaaucagguucugaaaccacgcagucuggcaccaaaguccuugcuguuaaucugccaugcuuaugaccugcuacagauuggaguaggauuggaguaggaacaauuucaagggcaaaccugcaaaauagucacaaacuuugcuggguauuuguuuugccuuuacaggugcuugcuuuggaaaaggugucaguuaaauaguuucauaagcaagcaaaaagacuuuccuuuuaaggugacuuaagaacaaugaauguaucuuuucaauaaugugaacucaguuuuacugaguuuuaaaauuaacauuacuuacauuauuugagcaggcaggcaggaaagaacaacccguuuuacauauaaacaagauauauacaagcauacaaacuauuacuuuuaaauugacuuuaaugcugucauuucaauguuauaaauguuguugguguuuugaaauaaagacugcuauacaauggacuccccuaagcuggaaacagcuucacagucccaagaaguuuuccuguaaaugucaguaugcuacuacauuaauacugccuaguaaauuauuuaaagcauaugcaauucuagaguuuuuuuuuuuugccuaaaugauaaaaaggaaacaauuuauuuauugcuaaaauuuauauaauuuuuaaauuuucauuuaaauauuauaaauuuguccacaagcuuucuggcaguggugaaauuuuaagaguaagaauaaaauaaaauaaaugaguugcaucuguuuacauaccuguuaaauaaacaauuuuaaaaaucauaaagcuuuccauacaacucugaccagacaaauugagcagaaaaauguccuuuuauucaaauguuauggcuguuuagaaucuuucugcuuuaucucuuuaaaacauacauaguccauuaauauauucacugaaucuuugaaauuuugauugcuucauaaaaugauuuuguuacaaaccuuuuaauaaucuauuaaauauaucaauucuuuuaaucauaauuuaauuauacuuaauauuaugucuaagccaccucuuuagccauuuucaaauaaagagaaaccaguagagucuuuaaguguucaauugcgaauaucaauauagaaaagauaauauuucaguaauagagaaaaauuuaaccuguaacaauuuaacaucaaaagaaaaaugucuuggauucaucaaaauugauauacucaguuaauuuuuuuggaaggaaaaaaaucuucaaaaccuagaaacugaagaagagcaauaauaauugaacauguaagcuuuugggauaaaagcucagugaaagaauuccauuugguggaaguagaauuacauucauaguaaacaaauauuggugcuuaaaguaaaaucaaaccaaagaaaaacaaauuuuagcaagcauugugcuagugugacuagggaauacacuuuaaaugugccuguugaacaauagacuuguuacaacaguauuuuaaaagcaaagaauauuaucacaagucgagauaguuugcaggaaaaaaaaaaacaaucauggaagaguaguggcuuagaaaauguaaggaauacuugucaaaaauuauacuguugauuguuauuuagagugaagcuuauuauuuacuauauuaguauuuuuccaauugagggcaggccuugugccaaucccuauucuagaugucuuacauucuuauuugauacugauugaaaccuugcaaaagaugucucaguaucccuauuucaccagugaggaaaagagaaauugaaaguugccccaaaucaaaacuagcaagugguagaacuaacuuuagaaaguaggacugccucacuucaaauagucaaaugggaugggcuuaaucuaucuuucaguuuuucaccauauaaauuauuauaguuucaaaauagggauuaugugcaacucccccaaacacacaaacacauagacacacauuuucucucugacaaucacaagccaggugccuagcuuaaaaguuuuuauuacuuuguuucagaguuuuuuuuccucugccuuacaggaugccucuuaauacgcuugccaucuuuuccccuugcacuuuuuguuaguagauauuuagaauaugaaaacuaaauggaauauuagucuaagcaaauugcauuuggaaaacuaaaucugccggaaaagaacaaauuacacccuacagcuccuguacacccauccugagaccagaccuaaaucaaacauuuuuuuaaagaagucguaguuugguuuuaguuguaaaucugcucaucuacauuagcacaauuucugacaacuugaaaauaaauuauagaagugaccccaaaguuccagagaauuggcuccgugucccauuuuuucuuccuuguuccugguuugucauucuguucauuucucuucuuggauuugagaaaggaaucuguugacucagcagcccagggcugcgguucuuucucucugggaucccugcucauuagcuuccuaugcguggcuuucuucccugcuggcucugggcuauaaccucuccucucauccucuucagggaauggagaaaauuugcuuauaacugugaucuaaacauaaucaugcaauagguacccuaaaaauacucaaggaaggaaguacaaaggacagacuaccaauugauaggacgucuucuuggauuucaugauugauacauuagauuucuuuacucugggcaaaaaaaaaaaaaacaaaaaacuccuagaccaaaaaguguaccuucuccuuagaaagugccugucaauacuauuucagagaaauacuaugaaguuggacuuuugugggugcuuacgacagcaauuucccuaaagagcuuagaaguggggaaauaaaccaaaauagaaguugaagacuuuuuaaaauauuucaaggacuaaaauggucacuguagacaucaggaaagaaaucucagcacacaguccucuucagcaaaguccaccgcuaaguuauuuguuuaguaaagaguuugucagguagcacugcagcuauuugggcagacccaaccagagaaaaagauucccuggcauagaguaagcaugacggugccaccuacuggccacuuugccacacucugucauccugugccuagcccaaguggcucuuggcuuugacacugucuuuauggugguuuugcucucaaccacaggugaagauagugguugcuggccccccugauaaauaaauaacucuuguuugggauaggcaaauuccuaaacucacaggaauuguuuucuuucuuuauaccauccuuguauaaaauauacuaccauaaaaugucauaaaaauuagagauucucugcaagaauaugggccuuaugugaugauaauacaagcacuucaaaccugauugaugcuuguugugaagguuuucuuaguacaaagggaacauguuucuacacugccacucugauugucucuccaguuaaugauuuccagaaaagagaagugguauaaucaaaauuaagauauaguccucugauagaauaaauuaaugcuaugcuuuccuauuaaauaauauagguguuuucaaggggagccaguguuaaauuaggagcaagguucguucuauuuccccaauaguuuuacuugcauaaaggauaugcugccuggcccaacccugcaauuuacagggcccaggauaccaugugucuaaauauuuuaaaaguuaugaaucagacuauaaauaaaaucuguucuauccaccuaccuugacaaauaugucuugauaacaacuuggaaggcugaguuuggauuugaaauucugucuccccugaguuccauaccagaaaauauugacauagacauagccagcccgugucgccagccucuggcccuagacugcuucaucacuccccaucuuauauuaugaacagcuuugugcucagauuuguggacaccucagcccagucuucaaguuuugucuaccuuuugcaaacagcugccccuuuuuggcugucucuucaugccucugaaugguagaguuggagaagagaacugccagggccuggaagggaacucagagccacggggcagggaauucuagggucucagauaagaagaggugguaugggaggagggagggaagcacaggcuccaagaagucacauccagcuggcucuguggacuccuuacacuguaggaaagggacuggcaauggaaaacacaaagcagaguucuccauagugugggucuugggccaaaggccccucuugcuuuggccuuaauggugguguuaaaugcuccuguuuuugaggcuacuuuucucuucaaaggcaacuaaggccaauauuguaaucugaacacuucaccgccugcacacucacuuguaagugugucuuagacauuuaaacacaauuagguacaccuguugcuauguccccaaggcaggcagaaaagccggaacaguuagaaucaugcugcccuguuuacagauuggccaguagcacacauugccaggauagcugucuagcccacaacagcaagaccaacagccacugcgggcaggauuugcccacguguggagcaaacugccagagaucuuggccuucuuagcagguuucaauaaaaacuauuuaaagauacauagaaaaguacacauacacauacaaagaaaaguaaccaaggaacacaagguuuuaccaaauggaauguuguuaauccuugcaaauauuauaaaacuagaaauuaaagucagcaaccuuuuccucgcuugcaaaaccauguaucagugcuaaaugcagaaugcuuugauuuauuugguucuuguuugggagacauuuaaggaaaauaauaaugcucuggacuccuuauauugaaauuucaagauguuucuuuucaccaucaaaaacauccagaauagcugccauuaccuaccuuuuuugaaucaguuuuauuaucucuguuuuuuuuuuuuuucuuugagauggaauuuugcucuuguugcccaggcuggagugcaauggugaucucggcucacuaugacacagccucugccucccggguucaagcgauucuccugccucagccucccgaguagcugggauuauaggcaugcgcaaccacgcccagcuaauuuuguauuuguauuuuuaguagagacgggguuucuccaugucggucaggcuggugucaaacucccgaccucacgugauccgccugccucggacugaucacuuuuauuaaguaacguuaauagaauugaaaucacaggaaauugcagagcuauauauuauuuguaaaauucagaauguugcaaaguucaaguuaaguauggaaugcugaaaagagaagcauugagucaggaaguuccaaaucugcgugugaacaaucuuccugauucucuaaaaagggcuuuaaagggccuauuucuucauugacuucuuugaagaacagagagaaacacucggguuaggccaagguuuacaugcugauaacucaucuaaguucaucagcuauuuccaguuguguaaucacccccauuccagcaaacacaugcacacacaagcacuucaucccuucucaggccagcccuucucaugguauuugcuggcuugaaucauaaauggcuugaucagugcauaaaccgacuuccagcuccaguccuaguuugaguuuacagugucaaccugacgucaaagcccacuuuacccuuccauucuuagacugugcuuccuggaaucccacuuagcuagaggcauuuauuucauuuuaaaaucaccaucuuaugaccuuauuauuaaauggaauuuuacuguuuuaucgauaguauuugaaaauugaguuuuaaagauaaugugacacgguagaagcacuguucuaggucccucugcaaacacgaacaaauucaguccucacguugugaacugucuguucauauauugggaagucuaaggcucaaagaguuuaacuugucugggagcacacaauuuuuuuuuuuuuuuuuugagacagggucuugcucugucacccaagcuggagugcaguggcacaaucacagcucacugcagccuugaccucaugggcucaggcgugggauagugguagaguugugauucaaacccaggucaggcuggcuccacuucuuauguuguuccgcccaugcugugcuccacuccuguauuuaaauucuauauuucccauuuaauaucuuugcacccugggaaaguuauauauaauauccuugcuugagucuuaguuuucuccucaacaaaauaagcauaaggacauuuuuucauagggcuuuugugaagauuaauuuagguagguaaguagaguagauaggcaggcagacaggcacauaguagguuccugaucuuuguuaguuccaucuccuuccccuuuccauaaauauguaaauaucugauaaguauuugauugccuucuacucuggauuagauuuuuaaauaccaauucugcauugacuauccaaguaauaauguauauaauuagaucaucauuuuuuggaccauacaaagauaaaguugaaauugauaaaacagauaaaaaaagacauaugaaggcauugauaauacuguacugcuacuggaagaauacucugcaaacaauuuuugaauguugagucaaaugauucauggaauuacaaagaauccaacagcauucuuugguauguagccaaagugguaaucaaaggcaaacuaauucaaugcuuugaaaaacacaaacaacaaaauagagugggaaaacaagucaauuagaaaagaaaaugggaacauuagagaagaagcauaaacauaauuaguucuaacuagacagucauagcuagacuugaauuaaaucuuaaauaguagaaaugaaugaaagguuuuguaaguacuugugaaguggagagaaaggauaauguauagaauuuaagcaaguuaaaagguugcuucccaaagagauaucuuauuccagccacaagauagaaacuauuucagaaaaguuuauaaucauuuguucuuugggccugugacagcuuaaaaaucuucuuuccuagagcaaaugauucauucacagaaacuggcaaaauguauacauauacaaauacauauuuucuccccuacauuuguuuaucuaaaguuaccauuugcuggcagaacuggucuccaagguaccugaugacccucaagugaguagucuuuucugguuaacauuuucacauauguggacuaucuguugcugauuaucauguucccaggucagcaggaaugcuucuagcaauguggugucugcuuuguguguccugcuguguccacugccuguggucacuuccgccaucugauaacaugccagcaccuuggccucugacugcccaccucugcacagcauggauccucauggaaccauugagaagugcugacacagagggcuuuccaaggucuuuggggcugcuuguggugcagcugguagcauggguuggugcucaugaaacuguccagaggaccaggauauauccucuuccuuaguguguacuuuaacauauucuuuuggauauggagcuuaggacugcucugucccuccuaucccucaguauauuuugguuuccucaauuuugguuuccacuucuuucucugaaugacuuccuugucaacuuccuugacaacguucagcucugugaaccucauagacuuuuuagaugcauguauggugucaacagccuaggccuugaaaugcaugcuguaaacacuuucagaccgguaggaacuuguauguaaaauuaaaagucuguaaaugaaaaauaaaguacaaauguacuaguggcaaauauaucauaaaagauuaauugauuccuauauaccacuguacccuauccuuagugaggaacauaaacaaaauugaggaaaaaauugcuaugucccaaauagcuuaaucggguuggauguguuuccuccaauacuagaaaaaaaaagucauaugguuucacucaagcaaaugugauaauuuaaaaaaauaacuuauguaugugugauaagcaguagaaugggcauuaaaaugucuacaucuuaaucccuggaaccugugaauauauuaaguuauaaguggaacuaagguugcuaauugguugaauuuaaauggggagauuauccuggauuauccaggugugcccaauguaguuacaagaguaacuacauuguuaguauguagaauacuacauacuaacaugaagagagagguggaagaaucugugucagagugacgcaaugugugagacucaaccugacaucacuggcuuugaaaauggaaggaggccagaaaccaaggaauggugacaaccucuagaagcugaaaaagagguaaaaaaaauucuuuucuagacacuucagaaagaaccacaacucugccaacaccuugauuuuagugacugcaaacccauuuagaacuucugaccuccagaaugacaaaauaauaaguuugucuuguuuuuagccacuaacuguggugauuuguugcagcagcaauagguauguuacaguaugaaagcuauauuccucugaaugaauauugcucauugaagacuuacggauuauagguucuuccuccaguauauuauuuuuuccugcuuccuccucuccuugccacacaucguacuguccuuucuccauugaugacccacgcugaaagccgucaucaucuggaacacucccuauuugcuuuuaccuauggaaaacuucuauauuagacucucucuuuacgucuucaccugccacccaaauuggagcaaaugucccguuagggaagcuugccccaccugaauaacacauguaaacuuuucccuaaucucuugucuugcaaacuuuaaugaaaucuuuucugucauucucgacuucuuccgucuucauccacgaaugcguacaauuaaacaccagcuuuggucugucucucuuugccuguauaugcaaguacccagcgaaaguggaggaagaugauuuuucucacucauuucugucuuuaaaagcugacucuuacuuuucccuugugaccuucaucaguugaugcccauaugcaugagcuguccucucuugaaggcucugguucuguauccuuccugugacccaaguccuuauauaccuuucugaaagauaaaaaucuucuguucccuucacuguuaaugagcuggagcaggucuuccagggucuuacaagcuguuccucuagucaggugucagcaaacagugguccacaggcccuauccagcucaucaucuguuuuuguaaaugaagugguuugauuuugggguggggugcuuuuggguuuuuuuguuuguuuguuuguuuguuuugagacugggucuugcucugucacccaggcuggaguacaguggcacgaucacaguucacugcagccucgaccaccuuggacggugauucuccuaccuuagccucccgacuagcugggacuacaggcgugugccaccacacccagcuaacuuuuuuguauuuuuuguagagaugggguuuugccauguugcccaggcuagccucaaacuccugggcuuaagcaauacgcacaccugugcuucccaaagugcuaguauuacaagcguaagccacugugcccagccuuguuuuuguaaaguuuuauuagagcuauguuacacacauucauauaccuguuaucuauggcuauuuuugcacuacacugguaggguugaauaacugugacagaguccuaauggacuauaaagcguaaaauauuuaccaucuggucccuuacugaaaaagugugccagccccucuucuagaccauacacuuucauauuuugcugguaucaguuuuguuuuauuuuguuuccugggugauaguuaacauagugauauuagacuuggacauauaaauagagaaagagacagagaggaaggaugaaaaugugccuacccguaaaucuguaaucuggauauacuaacagggagauuuucuguaagaugcaauuuuucuaugcagcuuuugguauccuuucagaguacugggauaguagagucggacugauucugcaugucugguuuacaguucuugggagauaaugaugauauuuauacauaauaacaauauugauaauggugaucauuuguuaagugcuuccuuaugugccaggcacuaugcgaaguacuuuaucuugguucuuuggaaagauccaaauuaacacuauuggggaacuuguuacagauuugcuuaaacaauuagcaagcgauggcugugcuuacaaagaauuaaugauacguauaacauaaaugugauuaugauuacucacuaauucuuucuccucagggugggguaaacucuuccagcagggaaggugucccuaagggugaggucuucaucccaauccccugagcucuuuccuucucuccuacuucuguuccagucucuguuucuuggcccccaccauggauccccaccuguuugcugucuaggcacccuaacuuccucugcguuguuucagugcccaaacauuacagaacaaggcuugccugccucacuaugaaaagucagcuguugcugaauugaauguacaguggucucuuuaaugcaccugugggcugcauucucccacgcugagccagguuccucucaguaugcucagguauagauacuaggccucaaaauccuguaaugaacaauccagcugccuggccacaacccagggucucucagggauccugccgaucauugcccuggcugugcuaagcuguugcccacuuauacuucauggacauugcuagucuuacacgaauauuugugcuaauagacucucacuggcugccuggagcaugcauuucccagccugcuguuguccagugagguguucguuauuuugacccuagucaggacccagaggaaauagucuauaggauaggaaguauuucuucucucaaacaauagacaugcuuucucuacugucuguucuaguuucucuucggaacguuuccuauuuaucucucugacugauggaaugugaauucauacauugaaggccauauacuuucuaacuccagaguacuuuuaaaaucccuuaauuuauauuucuuccuccauguguggguguuucucucugucugucucucucuguucccuuccccucccuccccucccucucucaccccacaucccaucccauuucucucucucucucucucucucucucucucagauucuaaaccaaggagaauaucuggucucaaaucuaacaacaccauauuuacuacaugacauuagacuaaucaacucauuguuuucaauagcuguaagaugaaaucuaaacacuuaacuugccaaauuccuaaguuguuuuggugaggcugaaaugaggaaguaaauucauucaucugguaaguauuuauucagccuuuaauguguaucaggcacuauaccaggugggauacauuuaugaagagaacaaaugaacuuucuuacccauggcaguaacauuuugguugggaagacauauauuaggugaggaaacaaaauaaguucggcagguuguggugggugcuuuguaggaagugagcaugaugcggugacugagagugacagggauggugauacucaagauagggcugccaggaaagcuucagggaagcaauauugacugugugacacucgcagucuguuugagagaaagccuacuguauacugaaccacagacacaccuuauaagugguaagaugucacgucagugaagaguagcccccucuaauccuuugugcaagaggagaaauuacaaaacaguaaguuuucccaauuugugaugcugcaacuucauaauaaucccuauaguuucuugugagcuuccuuuuuuuuucaucuaaaucuuuuacugcuuccuccucuucuguuuuuuguuuguuugcuugcuugcuugcuugcuugcuugcuugcuuguuuuugagacagaguuucgcuccuguugcccaggcuggagugcaguggcacgaucucagcccacugcaaccuucgccucccagguucaagugauucuccugccuccgccaccaugcccagcuaauuuuuauauuuuuaguggagaugggguuucacuauguuggacaggcugaucucgaacuccugaccucaggugauccacccgccucagccucccaaagugcugggauuauagguuugagccaccaugccugaccucucuucuguuuuugauuugugcuggccuaaucuugucaucuggccccuaucuaugguacuauuuuucuucugccugcucucaaucuucccugccacuguucauacccuuccuuccugcugcuugacuuguugcaugccauaaacccaugcaauugguuuccauuucuaagacuugaacccuauacuucuaaaaccuucccugagguuuccuaagcgcucauuuuucugcuaaccuaccuacccuucagaauauagggaaugucugcuacuuaccuccugaagacaggaauauuuccaaauugaucugacuagaauuggcuggcauagugccuggcaaguaguaaauccucaauaaauauguauugacuaaaugaguaagugaacugauuuugcggaucucaugcagccuaucuauaggguuaaaguguuuuuuccucuguaacuuuacaucuguuguccccucacauguaaaaugcauauaaaagccuuuaccuucagcucuauaggauaguaaaaucuuaucucuucuucacaggauuuuuaaaauuuuuaaucuacucucucuauuugcuguacaugugaaacuuugucguugaucccagagacaccuagagguauugacagugucucugacauucuuuguacauugucccccauagugcauaaugacaagccucggaauuuaguauguaacuggauuuuuguuaaugauaauaacaaucacugagauuucagcuguuuugguuucuguuuucagccucugaauuaucaaauguauuauucguauuaaguagaaacaucuaaggaaaaucuuuguauuaaggaaguugucauguuuucggaguuaaguagcaacuaaaugcaauguuucuuuugaagauaauuuucaaauauguccagaguuugguuuuagacacuuugugugauauuauugaucagcaauagcaauaauaacuuaacuacaaacaacuugcagagacuuuucaacagcaaauagaauacucacuuuuuaucaguauaaagguguguuuagaaucaucacuaccaacuccuuucaagaacuuaaguguuaaguauucccuuaaaucuguaucuucuuguguuaugucaguuaguaauaacuguuaaaugauccuucaguuuugaacauucucuguuuauaguucuaaaauauuuaaauaauaccaaaaauugaugaagaaucccucuggguuuuuguuguuuagauuauauucuuuaauucaagaaaauccacauaauuuacacugaauuuuuauuuagacuuauaaaagaccugaccuaugugaucaagaacaacugcaaaacuucaguauuuaugauuuauauuuguugccccgugggauguauuagguugguacaaaaguaauagugguuuuuuccauuacuuuuaauaacucuaaaaaauagcucuaaaacaguggggcagacuuucaaauaaacauacuaauaauuacaugucuaggaggccccugucuccuucaaagcagucaccuaggaaggcuacacauuuguuccaguaaugcuucuauggcuuaaauauguuguggaaugccucugaaaugcuaagaaauaaaggugaaaugacauuauuuuaaguaaccugaauuguggcagaggugaauuuaauuuuguugaguagucaaaucaucccaggaccaaguguaguaaauaaaaucuggaguguuguuuggagccauaguuggauguaaaauaacaagaugggcuuuccuaaugaugcauaaacuaacucuugaaauugucaaagagggauuccagaacccuggaccuuggaauaaauguauaagcucccaagguagcuacugugaagaacaguacuugucuagguaaggaaaaaaauauguguauguuugcaaaauaagaucaguuuuauuacuuuauagacaaaccuuguagaugaaaaaaauacuccuaucauggaacucuuuauaagcaaacuucugaauguaaguagaauuucugccucauccuuucuaagccuguugagaaaucugaauuucuaauaaugacuuauuaccuuaaaaaaguaauguuuacuguuuuaaaaguagaugcuuugcaguuucucuucaccuuuuuuugauuagcuuuguuacucuauucaauuuuuauuucaguguauccaucuuuguucacccugagauucucaaaauguguuuucucauuggaaaauuaucaaacuauugaacuaaaaguuagaaaauaaugucuaagccgaaggcuauuaauuguucuauauuguuucaagcucucuuuguuggcauuaguaaugaucagaugcuuuucuuuuuaaagugagacccuauuaucugagagaagucucaaagauuuuguaaaaacaaauacacucaauuuuggaguuucuauuuuccuuuuuuacuaauaaaagcuuuaaaaauagaguucagccaaacugcuggauauuguuucucuaauguagagacuuccagguggacucaucugccaaguauaggggguggagcugauguguccugcuugauuggggcuuuuccaaauucguuuugccacaucagucuucauccaagucauccaggcuccuauuucuucauugcugaguugaaauaauaaaagguaaaauggagcaaggaaagcagagaaaauuguuauccuucugcgaagaggcuaagacagcuaaauugugacauaauuuaaacuguucaaauuugacaaguuugauuggaaaauuaugugauccauguaauuagagaucaaaauggccacuaguuuacaguuuuaaagagucauagauuggcauuuuuacuacagacugauagaguauuauuuuauucugcccuauauuaacuauugcacaaaugacuauuguuuugcaguuuggugauuuaaaugccgugucuccuggaaaucuggauaaagguaagaaucgaaaauaauguacauuuuaagaacuuuuauuuauuaauaaguucuuacagaggaaaauacgguauauguuuacaacacucugauuuuguggaaguggcauacaaauccuagauaaauaggaaacuccugucuuuucauuauuucuccauuuuuccccaucccuaugccuucuacauaugagguauauuaaaugcagauaacugaauuuaaauguaguuauaaaauucuuuauacuuuuuuccugaaguucauuacaagcaacaagaaauuauuucugaccauggcuagaguccuggagauaagugauaaaauuggaugagacauuuuuauucaaggcccaccaggcaagaaaaaagauuccucggcucaccuaccucaccaguuccuacuuguguguagaaaaagaacucagagauagcagugagguuuacuguaaaugcaagauuaguagugguauagaugaaaaagguaacauauguacuucugaaauuuuaauaucagcauugccacucuaauauacaguauaauaugauaacaugauauauauuucugaagaaccucaagaucaacaaaaucacacaauaaaaaaagcaagguggacuuagggggagauagaaugcggauagagcacacaaaucuuacccaccuuuauaagcagagcagaagcaaaacaauacugauaaauauaccagugcaauuuuuaaaaacaaguaaauuaucuauuaaccacugcaggaaacagagcccuuucuuuuaaaagguggcggagggugggaggucucuugagguguuaaagaauuguuacgguuauugacuaucggcgacagguacaaaaugcacaaaaacuggggagaacuaugcacuuagcccuuccaggccagagccacugggcaaaaugaggugaaaagaaguacguggggagucuguaaagagguucggcgcuauucgccaaagugugcaauauuaagguacucaguacacuagcagcgcagggaaaugagaaaauuauagccaaaaaaauuguugcuacaaauauauacucuauaggauuaaccaaauaacccuuagaaaaauaagucaaugaugauauuaauuaguaauuuuagagcaagaaaggugguaauugauauccgugucccacauaaagcaacacugaugauauacucacaccaaagccucauaacccaaauuuagggauuucaucccaggguguccagaaggacaguagaguuuuacugcucagucagagacugaauuccagccaggcuucuucacacggugcugaaccacagucuucuguaaacuccuguagcgccuaauuuuaguuuuuaugcaccaaauuuccauaaccugaaguagauuucuagaaagugucuucgaguuuuuauagaagcauaaaaugucuacagaauuacauuccuuuguccuuaggaccuggagaaugggcuugcuuuuauaaguugcuuuguaaguucuccaaaggaaaccugucacccagagauagaccuaagcaaaaccuaccuggaacacuuaaaucguccaguccauuuucucacuacccuuuccauccacaacaaaauagacagaggaacuuuccucacuuugucuccacugcccucccugccugaaaaugagcuuuugucuuuucagugcucccuuuuuuauuauuuugacacuaauuucuuagguacagggaagucuguggacagggagcagagaagcagugugacuuguccucaccugcuggauguggccacgcuggucccauuuacccccagaccucuugauggcucuugaguuagagccagaugggcauacucaggaccuaaagacugaaugugaaauccuaggagguuuugagggcuucucccacaaaaugagaauucuuauucuugauaauauaagggauauuugcuccguagaaaaauuucaaauaauacagagaauuagaaacuauagaaagugaagcuuuauuaucacaaccauaagagacugccaccaugaagaguuuguguuaagauccuuacagacauuguuguuuuauguauaaaaacaugaaaaaccaaaacauaucaugcaaacauguuucaaguauacccucuugaugaaguaaaugucuacaaaagguaucccucucccuguagcccuccaacccuuugaauguacuuguucugacacacucaaauauuaucauuaaguucauuuaccagaggcaaauagguaacuugauaaagucggugggccgagaugucuuuugccucaucuaagagcacuucuuuguuuuauuggucacuaaugcgugacacacauuucuagguaaugcauguuaaucuccagcuguuuaaucacaaauugccauuucucagaccuugcucaugguggcuguacacuguacagccauauauggaagcccuuuuaccucucacugcuuuuuucuagaacaaacuuugcccuagucauaaugaaauaagaaaagucaaggggccuuguuuauagagacagcugcauuagcagagauuuuugcugugggugucugccaagugguaaaguuaaaaucuuacugcuugcaaagaauccagcuuaaucugacuaaagagauacuuguugcacauucauuguaugugauaugccauagaacaguagagaauggagaccugacucuguuuauacaagccacuguaauuaucccucaugaagagguauucugaggagacucucacacaauaguaaagcuguauaugugcauuuucucucucuaauguacuuuugaauuuuaacagugcauacuggaaaaaauuaaauggcauucuauuauaaugaugcuuuaguuaauauaaaacguauuacaauuuggggguaacagugacuauauaaugcauuuaauuuccagaaaugaauaccagcuauuaacaguaucaguugccaagaauggaaauccauugcacauuuuuaaucugauacuacugccucaaccuuaauaauuuuuauaauaaaaauuaaggguuuauuuaauacugugacauugaugagugccagaaagucuuacagcagccucuguuuauacauggaauaauaauguuaagaaucaacauaggucuuauacauuaacgcuagcauagauaaaauuuauauuuaguguagauuuuuggaggaaacaacacuuuuuuuguguuugcguuuucagcucaguacauuccccaaaagccagcauaacauaccaaagugacuauuuuauuaugacacaaauuaugccauuauuuaauauaacacuuagggaaauuccaaaggccuuuuuuuuuaaaaaaguuaacaaaguaucaaucacaaguugccaaaaguaaauuaaucucacuauguuugaaagaauuauagaugcaucaguacagcauugauaugaauaaaaucugaugaaaagaaaaccucuaagcuuuguuuccugagaagagcuaagcuguugcuuucguaauguccuauauuaaaguguuucuaaagcaccuguugauugcuauuuucuaauuugucuucgaugauagucuugguauuauuuguuugugcagaugaaggcagugaaguagaaagugaaauggaugaagaacuggaugacucuucagagccucaagccaaaagagagaaaacagagcugagccaggcauuuccagugggcugcaugcagccuguucucgagacuggcgugcaaccaagccuccugaauccaauucacagcgagcacauugucacaaguacucagacuaucagacagugcagcgcuacaggaaauaccuacacugcagucuaaagaauauuaaagcguauuuuuccagcuuacauuaacccuguugauauugggcuuaaguugaaaauuuaauaagccugaaggucgacuguugucaaauucuaucugugcugaacauuaacuuuuuggaguugugaaauggaauggguguauguauuuugccagaucuuuuuuuuuaacguaaacaaauuauuugcuucuuaauaaugaauuuuuucccuuaguuucaggugucaagaaggauuuuuacaacacuuaaugucaauguuuuguuuucuuauaauuaaaaaguaauuuacauuuuuuguagcuuaaaauauuuuauuguugauuguuagucuugguguaugauuucauguguaaguuuuuuaauuagaugcacuucugugaaauaucaaaagaaaugauuuuuuugauuuacacuggaggcaugcccauuuggcagcagaugcaucaaauuugcuuuugaaaggugcuuuucauuggacagaaccauaagacacuauuuugauaacauuuugaguauggagagagaauacagagcauuuuuauuauagugcuagaggguuuggaaggucaucuauuuuucucugaggaaaaaaugagcuguacauuuaucaguucagaguaaaugacagaauugcaagagauuaugcuaauauguacauaauuuguguacauaauuauuaaaccauguuaacaaugcaagcuuccguuaaacauugaauuuuaacuauuauuugcauaccaauuccucuguuuaaagacuacugauucuguauuugggaccacugcacagaugcauucugcuguuaagugggggcuguuauaguuagauacugaagcagaaaaaaaagacuugacuuuuuuuuuuuaaguguacaugcuacuuaugcugagcuggacauacaggaaaccauuccauuuggaugacuuucuuuuauuccaggucuuuuuccuaauaguaguucaauaugcugcuauuauaaacgagaauuuauagaaugcaaggaauguagcaaccuacauaacguuauuuccuucaaaacuauuuccugguuucuaaaguauguggauuuaaauuguaaacagaaccugaaggcaguguaacuggcacaccucacuguuacuuauccccaauucuguaggauuuggauagguggcuggauggaccauugccauugaagaauguacaucagggaucaucguaccucggcuauuacauggugccuuaaaacagaacugaagcuaagguuuaguaagguuuauuuuguucaugugacuaacucuucaauccauuugacaaagugugccugucauuuucagauuccugaaguaaggacaggugacauguucuucaaaggaaauuuagggaaaacaaaggaaaacaaaaagacaaaaaucaguuucccucuuugagugaccguggaucuauuuuuuauucuuagagcugaauauuacuugauuacaaaucagauugcuuaaggguguggaauagcaggcuaguuuuaauaccaacuuguuaacauaaaaucauauauguuuuagaccauucuuauuuaguuacaauuuuagaaaguuaacaaaguaagcagguacuuaucgaagugcaucuuuucagucuaaauguuugucugugugucuaggugcuggugaguccacauggacacaugagugcccauggggcaggagucugcuauaaagucagaaggugagauccuagagaguuacacccagccccauuuuaauuugcaugaaaagccaagguucuuuuaagcacucaaauuauuuaaugauuaaaacacaagaaaggcacaucuguucauuuaaauaguuguaaaaaacuaaucagcaaaaauaaauagauaauaaagccaaaaaaaaggaaagcacaaaaugauugacagauuaucaaaugaggccuauauuaaacccaagauguuuaucuuuccagugguauugggguaaggggggugggggguuggaaagacgaggugagccagucuguaaaguuagaaauaccaaauggcuuaucggguaauacacaguguauuuaagcuguuguugcuuaauugccucagacuacucaaauaacaucaacaacauuucuuaaguaaaauuuaaauauuuuagauguaauuuuaaaaacugauccaaauuuuuuauuauacaacucacucauauauuugaaagucuucacuagcauaguagcaucaccuucaucuaaaugucauuuaaauuacugucccccuuuuuccucccaaaaagacaauggauuuguaccaaaacacacacaaaaaaggcaaacaaaacaugauaaucugcaaaaguucauguaucuacuucauugugcauaggaaguguuuacagguaaaauuaaaaucaaaaauugaaaaaacacucuucauuuuggcucuccuuucugaauuuuuucaguuuccugucucuacccgccauccuuugagugauacuauaucuguauuggaccaaauguauuuacugguuucauuuuguuuauugaaugacuuuaaauguauuuauuaucauuguuuaauuuaauguuggauauauuuguaucauuacaggaaucugguaauaaugggcaaauuuagauugaugaggcuuagggaucggggaugcuccaggauucaacauuucuuccaauuguucaugguuuguucuaaauuaggacagauuaagaacuaauaaaacauuauuacauuugaacuugacucaauaaaaauauucugaucuccuuuaugaauauuaggaauauucuuugugauuaguguaaguaguuuggaucaaaacauaaaaagaagaccuaugguuuaugcuacuucuaguuauuuguaguucacaguaaaacaugcacagacauacacacaaacauuuucaucaauuucgaauuugaauugugaaaaauauauaagaaaauaaaaacaauuuauacauuugagcaaauugagcaaucacauuuauugcauuuauuucccuuuuucccuuuuuucacucauugaaaguguggguuuucuaaauaauauuagacacuaacacucaacagauuuauucacaaaugacacaaguacacauuuuaagacuucuuuguauuucuugcaauuauaaccaaucacuagucaugaaauauaccuacauaaaccaaguccuacacuuucagugaggaagaauguaaggaagguauguugacuguuuucaaguuucagaaaagauauuuucauaugauaggauugaguaucauggguauaguuugaucuugacauauaguuugaaaaucauacucaaaagauuugcauucaugaaaccagugaacaauaggguggaauggaugaaccaucuccuuggaagacagggcccaauuuucaauuuuuucuuuggcuaucaaguugcuagucacuuauucaggauuuucauccaaacuguguuuggacugacuguauaagucuuacugccuuuucagaaaucugcuuuccuuugugugauuuuucuuguacuguauagcacgguuuaugcaccucucuuuagaugguguacuuuaaaaacaaaaguaaaauuuagaaaaugguuuuaacacugcauaccuaaaauuaguagugugcagcauugacugccuuugauuuguaguagacaaguaaaaaugaauacguucuuguagaaugcuguaaaaguuauucaggaaugaauacgguuuuagugccguaaucaugaaucuuuuuauaugaaugcacugucuaaaagugcuaaaugcauuuucaaauuuuuaaaaauuccucagaugauauauuugaaaugucuaaaauaaugcugugcuugaaacauuaguguaaaaggaaaaaaaaaauagugucacugugauguugguccucccuguguggacacaaguagaaagaaaaaacuuggcaagucaccuuuguguacaauuugaggcagugguuauauacaauaaauugaccuuuauuauaucccccagacacacacauucuuggugagaaaagaacaaccauccagaaauugagaugagaacuuuugugaucuguaugaaucacagcagaucaugggggaggaggauuggcaugcagugcuguugaaaauugggcuuguuguuagaucagaacaaccuccauguauaugguuagaacgaaucaauuaauggaauccuaguauuucugcaaguuuggugauuuuuaaaaacuggaauagaagcauuaauucagugcuuaguucuaguauuagaaaaccccuuugauguaaugccuuguauuaacccuuugagcauuguaagauauacaaugggggacaaaagccuuucagaucauuuauuuagacuuagaccgguaaaguauacucuauauccaaaugucuaauuaugcuguuuuuuuaaagggggggguaggaagagaaaguguuuccacgccgaacacuugcauuuuauauacaacucuuaauuuuucuucaagagggcuugauauauuuauucccaaauauucacugccaucuaaguaaguguacuguuuacagaaaaaaaaaaucaacuuuucuaguaucacaccauagucucuagaaaaggaggacaaauacaugggccuggauagaccuaugucauaacugauuucugcacauugaagguaccuagauugccuuuaaaagguauaaagaaaggguuaaguuucuuuuuuuuuugucuuuuuuuucccaaaaugaaucaaaagaucucauuuauuuagcuuuagaaaguacaaguguaaguaaagccuuaggaagaaaggaguucgaguggauuaagagaaucugaacucuuugggggcaguuaggcuauuuggaguuagaucgcucauaaaauauuguuugcgaauuucacacagggcauaauuuuaucuaugcuccaaaacuuuaauacguugucaaaaaauuauauauagauagaauggagagcaaagcacuugauuuuaagcucaucugucaggagaugcuaugacuacugcuucugauaucucuaaaugucagucugcuuacaccauugcugauuuuguucaagggaaucucuucgugcacuugauucccucuguucccugcgugaucgaacaugaaagcaguguugucugcagaugugcuugcgcugcccuagcugggugcaaauaagaguguaaccuauucugaugucuggugaaaggacauccauagcauagugcaaguaugccguaaacguugcuuuuuaggcaguuuaggaagucagaccaugcaaauuacucauguguuaacaugcaauacucaaaggguuuuaauuuaacucucuucuuuugaauucuucaugaugauuuacuguaaaugcuucucaguuugcaugccuugaucauugcugcuagugauuuuaugugccaguagaccugaguuuaguuuaccaauuuuacuuaaauaguaaaagccacuuacaaagugacugccuaggauuuuuuuuuccuuucauuugaaauaauugauaauauguuuuuuuaaaaagaaaaauguguuuugucucuucuuuuauuugguucugguuugauucuuuuucuccccucuuuccuuuguuuuuuuuuuuuaaauaaauuaugauguugggauuggaagcccugaguaaugaaaaucuuugguaagaauuguuuauguagcucaauaacgaggacaacaaauauucuuuagaagaauuuugauucuggggaggaaagaaaauauaaaaacucccauugacuguugauaaccaaguaaauuuuuccuucaguaaauuaguauuuuugaagaaacgaucgccuuguuuuaacuugcuaaacaacaauuuuaaaugacccaauaaagaaucuauugaacuuuauucguuuaaaaagcaucuuuuguaccaaagcaaauuuuuuucucuacucauuuccaucaucaauuuggaccuaugguggugaccaaugcauugguuacagaaacuuuaagugagugccuugagaaaacuuggaaauuugugccugaggugguaaacuuuuaauuagguuaauuguagugcuuaccaaucaguaacuucacuaucacucagggcuuucguaccuucuagguaaaacuucuuucauuguguuuuuuuaagauacuguauuuuuuuuuaagugccaucauuuaaauuucacuuaguaaguggcagauuacauuauucagucccacaagcacagaaacauaguaacacuaggagauauuugaacauuuauuuuacaaucgacugaauauauuauguaaaugagguaagcaacuuuuguagagauuguaugugugagauaauguaauguucuuuuccaguuuuuggacuacaguugaauaaacuuuuuaauuauuuaaaaacaucuuuaccgaauaacaugugaugguuuuuuguauaauguauuugauuuuguaaauacguauuuccugaugugauuuuugugagaaaugcuaaaucuuuuaguauaucauguccucucaaaauuggcaggagcuaaauaauaguuugugggcgauuuguauuguguacuguacaauaacuggggaacuuuuauaauuauaaaaauauauauuaacuuuuaguguguuguuuaaacaaaugacuggaacauacuaaagauauuaguaggauuuuucugaauauuucagacuugaacucaggcuagcuuucuuguguuuuucaaaacaaaauggugucuugucuuuuaaaaucaauaaauuuguuuccuuguuacaaauacauugga

SEQ ID NO: 18796 - RNA, 515 nt, Homo sapiens
auacuaaaggagagagagggagagaaagggagaaagugagggagggagggggaacaaagggaggagggaagcuggcaggaagagaaggggaggaagggagaggaaagagagggaaguuugagauguuaggucccucugacagagggcacugaugugacuuggagacugcucucagagucgggcuguaaaagucgguguucaugccucuuaggcauuaugggcuuuuugaauguuauuagauucauuuuagccucauucuuaagaacuguguguugcgauauccugugggcuuuggucauuuuugguuuuagaucauguuguuccaaucaauugguuguacuauauguaucacagcaguugugugcaaaagguacuagccuuggcaaccuaaagauauguuugcuuauagaaaauaacacacacaauugaaccaccuuuggguguaguuuuucauuuaccagcguguucuccagagguacccuguauugauguauuuucccaguagugggacguug

SEQ ID NO: 18797 - RNA, 4269 nt, Homo sapiens
cuuuugugggcacagaccugguuaguggggagaugaucaagaccaucgcaggccugaagggcuauguguggccaugggcaguucagcuggcccuugugccuuugugcugcuggcucuuggcaacaauacuuggauggagagaucaaaauacagaauuggucauaaauaaacuuucuuggauguuggccaaaaaugaaucuucauaguuagguaaaccaugaagagaauuugugaacuuuaaaagaaaaccauauccuguggugcauggaaaaaauccaguuuucuauacauuuaguagguguaaguagccacuugucaggcuaagauauaggguccucucgcuccuucaggguuccagaccucagugguuuuuuggcucauugguuugguuaggagaucagucagcucucuggaaaguuuuuucagccugggguaugguggccaccucucaagacucagccgugucuuuggauuccugggugaacaauacaacuugaccgaaauuucuguugcucugagacucugagaaguucccucucuugacaucccugugccauuaaaggcuaaaacuugaggcaaaaguaagcagacuucuguacccuaccagccaggcaaaaccacaggcuggguacagaugucuguagcccagcaacuccucaaagacuccacugucuuuuuugugcaugaaauugcuugcuauaugaucugauuuugugaagucucgguccucugauuucaggcagcuuucuuuaaacuaugagaaggaggugugggaguuaacgagcagcaaaacuacucaaguccauugagccucaggauuccaaaguucagggccagggauugucucuggacucagcccagccaagaaaugaguaaggcauuuccagaacugccucugggcacuggcauguguacuuguguguugacagcaaaacuaaggacuguacucugauuccuuacugaagaguaucucucagcggguccaaagucaagaaguuacccaaaacgggccguaaucuggaguaagcuagagucuaagaucaucucgagauagagccagaucccuccccuaaaccacacagcagaauaguccuccgucguuuuucugggggccuccuuauccgcugcacaaagauguauguucugaauuauauguguugaacuuaauucggugccuguagcuguugauuugcuuuuguuucccacagucuccucugaagaacugcaggaaaucugucgcccaggauggagugcaguggcgcgaccucggcucacugcaagcucagucucccagguucacgccauucuccugccucagccuacccagcagcugggacuacaggagcacgccgccacacccggcuauuuuuuuuuuuuuuuuguauuuuuaguagagacagggucucaccguguuagccaggauggucucuaucuccugaccucgugauccgccugccucagccucccaaagcgcugggauuacaggcgugagccaccacgcccggccaacugcaggaaaauucuugauagccaagagggcuuuuuaaaaaagaguguuaugcuaaacuugcaaaucagacaauggcaggcaaaggcacaugaaauuagacuccccaucugaaacugaguacuuucuccagccaaacuuccugagaccuuuuuguguguuugaaugagauuuaguucgcacucuugaaacaggacaccucucuucaugccauauggaugaggguauaagcacccuguuagcaggcauggggucccuagccagagucaccuccuugagugagugggugauuauuucuuuucuuuugcuauauuuaaccaagaauuauacacuacaucccaggaucucacuuucuauagacuauauucccuacaauaauaacugcuuacccuccagaauccacgugacccaucuuauucaggucaaaaccucagugcacgggauugucccaggcacaguuuagcacagccgcacucacauggaacagugcacuauucaaggggcuuucucgagccucucacugcgguccugggaucaggagaauaaccccauuggcagcacuggagugaugcauaagugucccugagcuccuugaucagaugacacucucccucuaggaaaacaugcuaccccaaauuccacccucaaagagucauuccuuuggaauaagcuacugucaccuuuaagaguucccugaguagccggacaugguggcucaugccuguaaucccaacacuuugggaggccgaggugggcggaucacuaggucaggagaucgagaccauccuggcuaacacggcgaaaccccaucucuacuaaaaauaccaaaaauuacccaggcgugguggcgggugccuguagucccagguacucgggaggcugaagugggagaauugcuugaacccuggaggcuugaacccgggaggcggagguugcagugagccgagaucacaccacugcacucuuagccugggcgacagagcgagacuccaucucgaaaaaaaaaagaaaaagaaaaagaaaaaagagagagaguucccugagucaaaguaguagaguuggaaaguguccuggauuuggaguugggcacaucugggucccaaagcaaacucugccacuuggcggcugugugacuaucugcaagcaacuuaaccuccuugagccucagguuggcuuuguguaaacuuacagggcuccuguaaggcagggcucauuuaggcaaugcauauagagggguaagcacauggcugauaucuuguaggugcccaauaaacuauagguaucacuaugauuauuaaauacaagcacuucuaggaacaauaacuuggcacgaaauagacaaguuuccuuugacacaguacauagcuagcucaaaaucagguaaagaaugaaaugggugcuacucuccuagugacaccucauagcccaggaacuguaagaaggaucucagaaaagaggggaaggaggagucaaagacaagcuuuaucaccuuuggaaucuggcuucuuaaucauaccccaucuuuuaacagcuagggacacuaacucagcaaaccucuuggcuaaugucauauaguuaauugagcagcagcuggaaugagagccuauacacccuguuuccagccauagacccuuuucaccaacugagcauugcaccuauacaaugaugaaagagucagugguggcaaaacacuggaucaggaaucaaauaccugcuuucuaacuagaaaggggcaugugggaaaguccugggggcaaugaaauguucuauaucuugauuagcaugcguuugguaugguuacauagacauacauauuuaucaaaauguaucaacugggcacuucaguucuguguguucuaugguacaaaaauuauacaucaguaaaauuaguuagucaaaaaauauauuuuccagccccagcucuaacacuaaugagcugaguggucuuggccaagucaauccaagucgacucucuuugcuuuaccuuucuuuuccuuguaaugauggguuauaauuagacaaaguuccuuccaccucaacaauaugauuugguaaacaggaccucuuucuuucauuucagucgcuauuguauucacacugaguucagcagcagagccggagagacuggcccacaauuuaggaggacuggggacugguaugugcaagugauccagugucuuucuuuugcaucacuaacucuccagcuacacuuuaaagagcaugauugguuuuccacagggauccgacaaagcaauaugauugagcccugguaugagaaugaucuggccucagaaaaguuguaucugccaccagagauaacaacuuucacauggagagcagagaaaauguuuccuggacaaugggaaugacugacagauauuagaugggaggaaauugaaggcuuugccaaguuucaugauaaaaugcuauuucucacgguagggucaagcugucucuauugcagcuauugcuuuuaaaauacaaagggaacacagcagauucaacagagugcaucagauuuuacaaagaguaugugaucaaagacugcuuguuucauuuauaaaugaaaucgcaugacuauuagagcaacaaagaucaucaacaaugaauuuggaauuugcugaugaaccaaaagcugaaaaacaucaguaagaaaaucucuaaagguuugauuacaaagccuuuuggauguaaaaugcccaccaauguuugcaagauuacacauguaaaaagguuaaauuggacuuucaggcaagagcauu

SEQ ID NO: 18798 - RNA, 657 nt, Homo sapiens
cugcaacagauuuauuuuuuaaaggaauggauuuugagagaaaacaacguggggcaaaaguauggaauagaaaauaaauacagauguaggcuauugugcuaauuguuuuguaaccacaacaagcuaguacagagaaugcccuguacaaaacacaacaaagguucaaacaucgaggaguucccuuagcaagguugaaaauuucagucucugguauuuggaauuuaggcugcaguccuuguuuuuggauggaccacuggguguguggcacaguccaugcuuuuaaccagauuugaacagaagaauggccacuuggcccagguagaaguagaugaaguguuugguuucaugugucacguaacuacugaaguuccuccccaggaugcagugccagguggcauuguacuucuugucacauuccuucuugauaugagccgcaguguucuucucuauguuguauuucuccagcgccugaggagcgcacuccacugaguucuguugcaucuccuccgacauguccgcauuuuugaucacggccuuucggucgcacaugguuaccauggagaaaggggcuggccaacuccaacgguccccugggaggugccagcacagcucaggcccggcuggagcugccguugcuaccaaagccguggcgcaucu

SEQ ID NO: 18799 - RNA, 5621 nt, Homo sapiens
gcaucuggauaucaauucuuugagcuaauuuucucaucuguucuuggcaacauuuuagcaaauccacuuccugaaaugaaaaaugucagaaagagcagugccucuuagaaccucacagucuucucucccaggccagagcccucagcucuccccuccccucucacugaccacccucgaccccaggaggugaaaugucagcguggggccccgccucaauccacgugaccccagggccaggcagcuaaggguugauuguggaggcuccaccuuuuuuuuuuuuuuuuuuuuugcccuacuuucuuuuuauagacucccagaauaaaagaaaauuuagcaccuaccaugugccaagcacucacuuauagauuaucauuacauuaaauaaugcauaugaugugguacagccuaugacauauaguaggugcucaauaaacgcuagcuuuuauuauuguuauugguauauuauuaucaugcccauuuuggagaugaaaagacugagggucaaauaacuccauuacucccuguuccuaaauugcaaacuagaccuccacccaugcuuccugagcccucacuuuccacacagugacacguguggcuucugcuccugacagguagcucaguaauuucucugaccugcuggccuucccgccuccuucagggggcugggcagaaccaggagaugccuuacccggauaagguuuuucuccacguugucauggaccaaaucaaucccaauccucuucucucgaugguacagacacuccaaggccaccugugggaagcagcagaaagaacguauucuuccuguagcuguauguagacccugagcagaagggacucacauccacccuugccacaaucuguuccuuucucccggaaaccugggugcuucaugugaccucacuacugggcauuggaugggcuucugccuccccuucuccccggaugagagcuguggguugucauaugaccaaggcauccggagaugcaaggcccauguagagaaaacaggauaaaguagcaucccaagaaccaauuuugauucccauaauugcaucagcagccccaagccuucccacaauacaauaauacauagaauaaaacuucauaauaauuucagauaagacaguguuggcggccaucuuccauguagcuucucuucugacuucaaucggggcuugaccacuuccuauugugugcauuugggcaaacugcuuaaccucucugcugguuuccuccucugcagaugggugccauauuggugccuaucucacagguucauugugcaggugaagucggcuugacaaguguaaaucacugagaacacugccccuaaauauuaccugugaauaugcaugaaaaccccucuuugcagaucucccaguggagggacaguuuggggaaguggucaggacaacccugccaccuagcccugggccuuacaacucucaugcagaccugggcagagcagaagagaggacaggacaaggggcuuuucaggggcgcucuaugaugggaagcugacaaacagcagugauuagcaaaccagcccgugaugucacaaagggcccaggagcagaaggaagcaggaugucaaggucuggaugucaggaugcaaauguaugugagaacucagaaaugggagggggucacugacccgugccacaaggauuuccggagccccuucugugagacaugcucugcugaggugcuggggauagcacaacgaaccaggcugagagucccugcucucacacagccuguguucuacuaggggagagaacacccauaagaaacucagucaggcugggcacagcgccuccuucaugccuuuaaucucaacacuuugggaagccaaggugggaggauuacuuaagcucagccugggcagcauagugagaccccaucucuacaaaaaauuuuaaauuagccagccaugguggugcaugccuauagucccagcuccucaggaggcugaggucggaggaucucuuaacuccaggaggucaacuaaugagccaaaaucaugccacugcacuccagccugagcaacagacaaagacccugucucaaacaacaucaacaaaccaggaacucaaucauuuccaacugugugaagggccaagaggaaaauauucagggugaggugagugggugaggaguaaccagcggaguggucagggaggaauucucuaaggaggagaaggacugugucaugagaagcagagaugcagagcugggcaggaaugcaccagaagggaaaacagcaggugcaaaggcccugaggucagcagagaaacagacaggaagccauuggcccuggaauagaggaagcgagucuagagcaauagcggggacagggguuauggggagggguggaggaauuccggaauuaagauguuaauuucugggggaccagacacgguggcucacgccuguaaucccagcacuuugggaggcugaggugggcggaucacgaggucaagagaucaagaccauacuggcuaacacggugaaacccuaucucuacuaaaacuacaaaagauuagcggggcauaguggcgggcgccuguagucccagcuacucgggacgcugaggcaggagaauggcguggacccgggaggcggagcuugcagugagccgagaucgcaccacugcacuccagccugggcaacagagcgagaguccaucucaaaaaaaaaaaaaaaaagguuguuaauuucugggaggccaucaagggaaccaguggcugcuguaaggacaauggauuggaagggagcaggaauugggagaccagguggcuuacauugcgcagggagaggcugccuggauugugggggcagccuaggagauagaauugagaugucgauggucccccugccaccacauggcugaucagagaaagccaaaugugaccaggcaaagcuggacuuuccagacaggaugggggagugagaagagaaugggagggagagcaguaggucugggauacugcuguagggcucugaaaagcugcccugcccaucauucuucccagggagaaucugggguuguauagaaucugcucccugcauuccauggauuuggacauccuagagugauagaaaccuaugccaugucucccagggagauccggaggcaggaucucuccuacggaagccccuguagcugcaggaggcuuccaggcaagagguccugaguuccccacacacuccagggagcagccgaucaucuuccucuguggccaaagucaguucccauaggugcugcugguuccuuacccaguguccacucaaccccuuccaugauuuucuccuggacguggugagaaacauucacuuauccagaccccuuugcauccaggguccaugagagugcuggcuaauaggcuaaacauggagacacacgacggaccuucuagaaaagacauucccugauaaaaagcaauggugcccauugaugcuucugcucuuuguucuacccuugccuuccugccucgaaugagaauaucaagaggccccuggcaugcaggaacuugcaguauaaaaugcaaaaccuccuugggaacaggagaacacaaaccacaugcuguggguggcagaacagagagaggagccugggucccuucuggcaccaaguugaggcuggagccgccugaucugucucccucuggaauuuuccucaugacagaaaaauaaauuccuguuuggcuaaaccacuaucguggaguauuuguuacaugcggcuaaaaacuauccuaacugagcagggagacaacuggaggcuaggagaccaaggaaguguuaggaauguccacauuuaguuuuuguuuguuguuuguuuguuuguuuuguuuuuugagauggagucuugcuuuguggcacaggcuggagugcaguggcgcaaucucagcucacugcaaccuccgccuccuggguucaagagauucuuaugcuucagccucccaaguagcugggauuacagacaugugccaccauacccagcuaauuuuguauuuuuaguagaaaugggguuucaucauguugaccaggcuggucucaaacuccugaccucaggugauccaccugcccuggccucacaaagugcugggauuacagguguaagccacugugcccagucacauuuagauauuuacucauuuauucagcauguauuuauugaaugccuacucugugcuucgcccuguccuaggcugggaauacauucaaaacauuaguguaaacaauaccagucagcaccgacauuggucacuacggacccacacagacauacaggugcccugcacugaauagcagucuugaauacaucagugacaaagcaggcaaaaaucucuaccuugauggagacuauacuguauucuaauauucaaucaaguauagagcauguuaaaugauaaguauuacggggaaaaauaaggcaguuaugggccaggcacaguggcccaugccugcaaucccagcacucuaggaggucaaggcgggaagaucagaucgagaccagccuggccaacauagcaaaacccugucuucacuaaaaauacaaaaauuagcuggccaugguggcgggcaccuguaaucccagcuccucaggaggcugaggcacgagagucgcuugaacccaggaggcggaagucgcagcgagccaagaucgagccacugcacuccagcuugggugacagagggagacucuguguaaaaaauaaauaaauaagucaguuauuuuaagcaugugcuuuaaggaccagaacacacacaugcucaggcaugcauaaguaugcacacaauauuuucaugaaaccccugcaacuuugauguagcuucaaggagaaaaggaaauucuauucaguccaagaaacccugauuugacugggauuauccugaauugacuaagauuguauuacugaucguauucgaugaugcagcucaaaccgaccugcaaggugccugccaccuucaucuucagucaagggaagcagaaugagcgugcaguauccccaggacacagccacagcccuguccccaccccuguacucaccugcaaugggcaguucaccucauuggccgcgcacuccagccgccucuugaccgucuccaaguucugguucucagucagaagccuguccagcucauagcucagcucugacuuccagaagccaauguccgacagccucuggcccagguuccggcaggugcccuccugcaucuggugcgucagcugguccuuguccugcaagagccucauggagucauccgucagccggcuggcccacagccgggaggccucggccccacgcaccugcagcugguuggacuggucccagucgugggggcuauagcgagagaagagugcggagcgcagugugggcaggauggugggcggccgcaggguacuggugcucucguccgggcaggucuggacguuggcuaucuuguagaagaggcuaggccuccaugaauugagguagcgguacccgggcagguaguagggcugauagcauuccuggaucacuggcgccuguacagcuggcagugaggucaagccacagcauuucuugggaccacaguaacuggcggucugaguagucccaagaaacuccauc

SEQ ID NO: 18800 - RNA, 1323 nt, Homo sapiens
uaccaggauccauggcagauuuccccugccagcuaauagagucugcauuugauaugugcauaggcuugaaguuuguagaaggggaaagauguacuucuuucuacuugaauuccaaaugguguccucccccgggggugaacuuugccucaucacucccucucgguaccuuuugcuuuuuaagugaaaaggggcuagagaaaggcugugcuuugaugucuaggggugugggaggauguggagguagagaguuaaccuugaggaaggccaggacauucuggacuaugacauucuacugagagcuuuacauacuguauugguaauaugcucuugguauauaacaaaugcucacaaacuuaguagcuuaaaacaauaccucuuuaucauuucacaguucugaaggucagauauccaggcagggcuugguuggauucucugcuuagagucucauaaggcugauaucagggugugugucaccugggcugggcucagcucucaucugaaggcucugggaaagaaugugcuuccagcucauucagguugucgacagaauucaggguuguaggacugaagucaccuguuuucuucccauuuuucuugcuggcugugagcuguggacaacucuuagcauauagacaggcacuguccguauuucuguucacuuggucuccccuaccuucaagcuggcaauggugcauggaauccugguacuuuggauucaccuuccguuugauaccagcuggagaaaacauugcuuaaaaaugacucauagcacaauaguccuaccuggauuaucucccuaucuuaaggucaacugacaacagcaauacuagauuuguguuuaaauaaccaggggcugggaaucguggauuaccaucuaagaauuuugccugccacacauacugcagucuuaccuagugccgcugacguucgaacucagaucugcccauauagagcucaaauccagaacuaaggggcacauugcuuuuggaauaucacauaccugccguuccuuguacaagcucuggaaauggugcuguuggucaauguaggguggcacauagaggccaggcagauuacuauaagcaguagaggggauaugugcuacugucugcugcaaaccuggaagugucuggugugguuccagcccugcauuuggcaaagcugcuucuggaguuggaacaucuugcaggaauggugaugguauugccaaaaagaggacaaauuuaauauuuauuuaaacagcucacucccagccccuucucaaauucccaagagaagcaauguaccauuccuucgggaagaagucauccuuugcuguuugcu

SEQ ID NO: 18801 - RNA, 1205 nt, Homo sapiens
gcaguacauugagcuccauagagacagcgccggggcaagugagagccggacgggcacugggcgacucugugccucgcugaggaaaaauaacuaaacaugggcaaaggagauccuaagaagccgagaggcaaaaugucaucauaugcauuuuuugugcaaacuugucgggaggagcauaagaagaagcacccagaugcuucagucaacuucucagaguuuucuaagaagugcucagagagguggaagaccaugucugcuaaagagaaaggaaaauuugaagauauggcaaaggcggacaaggcccguuaugaaagagaaaugaaaaccuauaucccucccaaaggggagacaaaaaagaaguucaaggaucccaaugcacccaagaggcuuccuucggccuucuuccucuucugcucugaguaucgcccaaaaaucaaaggagaacauccuggccuguccauuggugauguugcgaagaaacugggagagauguggaauaacacugcugcagaugacaagcagccuuaugaaaagaaggcugcgaagcugaaggaaaaauacgaaaaggauauugcugcauaucgagcuaaaggaaagccugaugcagcaaaaaagggaguugucaaggcugaaaaaagcaagaaaaagaaggaagaggaggaagaugaggaagaugaagaggaugaggaggaggaggaagaugaagaagaugaagaagaagaugaugaugaugaauaaguugguuguagcgcaguuuuuuuucuugucuauaaagcauuuaaccccccuguacacaauucacucuuuuuaaagaaaaaaauugaaauguaaggcgguguaagauuuguuuuuaaacuguacagugucuuuuuuuguauaguuaacacacuaccgaaugugucuuuagauagcccuguccuggugguauuuucaauagccacuaacuuugccugguacaguauggggguuguaaauuggcauggaaauuuaaagcagguucuuguuggugcacagcacaaauuaguuauauauggggaugguaguuuuuucaucuucaguugucucugaugcagcuuauacgaaauaauuguuguucuguuaacugaauaccacucuguaauugcaaaaaaaaaaaguugcagcuguuuuguugacauucugaaugcuucuaaguaaauacaauuuuuuuauuaaaaaaaaaaaag

SEQ ID NO: 18802 - RNA, 55458 nt, Homo sapiens
auuuugaguuaauuuucauauaugauaugaaagagagaucugacuucguucuucuaacguggcuauucaauugucagagcaccauuuauggaaaggauuuuuuucccauugucaaaaaucaacuauagagguauggguuuauuuauagauucuuaauuguauucuaaugaucuauaauaucuucuuaugccaauaccacauugccuugauuucuguugcuuuguaggaaauuuugaaagcgagaguccuaaguuuguuuuuucuagguuguuuuggcuauucuaggucccuuguauuuccauaugaauugcaggaucagcuugucaauuucuauacuaaaauaaaggcaguugggauuuucauaagcguuguauucaugacauaaagcaaauguggagaauauugccauauuaagccuuccaguccaugaacaugagaugucuuuccauuuauuggguuuuuaaugucuuuuaacaguggauuauaauuuuugcuaagucucauacuuuuguuagauuuauuucuaaguauugcuacuguaaaaaaaauggaauuuccuguuuuuggauuguguauauaaauacaauugcuucuguauauugacauugcaucaugcaacaucaaacuuuuucuuuuuuguggauuccuuaggauuuucuacauugaaggucauguuguuugcaaccagagauaguuugaacucuuccuuuucaaucuggaugccuuuucuuucuuucuccugccaaacgguccuggcuagagccacuaguacaaugcuuauuagguggcaauaguggauauccuugucuucugaucuuagggagaagcuuucucucaucacuaauuaugaugcuagcuguggguuuuuuauugauaagcuuuaucugguugaggauguugccuucuguauaguuugucuuuuacaaaaauccaaaucccuuccaugauaaaaacacucaacaaacauacauugcaucuacugaaguagucaugugguuuuuauccuuuauucuauuaauaugguacauuacacugauuuucaaauguuuuuguuuuaagacagaguuuugcucugucacccaugcuggaaggaaguggcgcagucauggcuugcugcagccucaaccuccugagcucaagccauccuccuaccucaguuucuauaguagcugggcccacaggcacacaccaccaugcccugcuaaauguuguguuuuuaguagagucaggguuuugccauguuguccaggccagucucaaacuccugggcuuaagcaauccacccaccuuggccucccaaagugcugaaauuaagcaugugccacugcaccuggccaacuuucuguuaaaccaaccuugcauuccuggcauaaauuccauuuggucaugcuguagagccaaacuggaggaaaaaaaaaauuauuaccaacauguuauguuuuuacaagucaaauauggaaguagaagugucaaaaaauacacugauacacuccaaaaaucccuacguauuuaaacuaaaaacagacauuaagagccauaacugggauugcuggcaagauggcugaauaggaacagcucuggucugcagcucccagcgagaucgacacagaaggcgggugauuucugcauuuccagcugagguaccugguucaucucacugggacugguuggacagugggugcagcccugugaggguaagccaaagccaggguaguucguugccucaccugggaagcgcaaggggucggggaacuccuucucccagccaagggaagccauuagggacuguuagggacuguaucuugcaauccagcccagauacugugcuuuucccacagucuuugcaacccgcagaccaggagauucccuccagugcccacgccaccagggcccuggguuuccaguacaaaacuggauggcuguuuugggcagacacaaagcuagccgcaguuuuuuuuuuucauaccccaguggcaccugaaacaccagucagaaccauucacuccccuggaaagggggcugaagccagggagccaaguggucugguucggugggucccacccccacagagcccagcaagcuaagauccacuggcuugaaauucuugcugcuggcacagcagucugagcuugaccugggaugcuccaacauggggggaggggcguccaccauugcugaggcuugaguaggcaguuuuacccucacaguguaaacaaagccacugggaaguucaaaaugggcggagcccacugcaguucagcaaggcaacugcagccagacugccucucuagauucccuccucucugggcagggcaacucugaaaaaaaggcagcagccccagucagggacuaacagauaaaacccccaccucccugggacagagcacuuuggacaaagggcaguugugggcgcagcuucagcagacuuacuuaaacgucccugccuggcagcucugaagagagcagcagaucucccagcacagcauuggagcucugauaaaggacagauuaacuccucaaguggguccucccaguaggugccaacagacaccucauacaggagagcucuagcuggcaucuggcggguaccccuguaggacgaagcuuccagaggaaggaacaggcagcaaucuuugcuguucugcagccuucaccagugauacccaggcaaacagggucuggacuggaccucaagucaacuccagccaaccugcagcagagggccugaauguuaagaaggaaaaccaccaaacagaaaggaauacuaucaacaucaacaaaaaggacguccacucaagagaacccagcugaaggucaccaacuucaaagguagauaaauccacgaagaugaggaaaaaacagcaaaaaaaggcugaaaauuccaaaaagcagaucaccucuucuccuccaaaggaucacaacuccuugccagcaagggaacagaacuggacagagaaugaguuugacaaauugacagaaguaagcuucagaagguggguaauaacaaacuccuccaagcuaaaggaguguauguucuaacccaauggaaggaagcuaagaaccuugaaaaaagguuagaugaauugcuaacuagaauaacuaguuuacagaagaauauaaaugaccugauagagcugaaaacaacagcacgagaacuucauaaagcauacacagguaucaguagccgaauugaucaaguggaagaaaggguaucagagacugaagaucaacucaaugaaauaaagcaagaagacaagauuagagaaaaaagagugaaaagaaacaaacaaagccuccaagaaauaugggacuacgugaaaaggccaaaucuacauuugacugguguaccugaaagccacagggagaauggaaccaaguuggaaaacacucuucaggauauuauuuaggagaacuuccccaaccuagcaaggcaggccaacauucaauucaggaaauacagagaacgccaccaagauacuccuugagaagagcaacuccaagacacauaauugucggauccaccaaaguugaaaugaaggaaaaaauguuaagggcggccagagagaaaggucggguuacccacaaaggggagcccaucagaguaacaguggaucucucagcagaaacucuacaagccagaagagagugggggcccauauucaacauucuuaaagaauuuucaacccagaauuucauauccagccaaaccaagcuucauaagcaaaggagaaauaaaguccuuuacagacaagcaaaugcugagauguuugucaccaccaggccugccuuacaagaguuccugaaggaagcacuaaacauggaaaugaacaaccaguaccagccauugcaaaaacauaccaaauuguaaaggccauugacgguaugaagaaacugcaucaacuaacgggcaaaauaaccagccagcaucauaauggcaggaucaaauucacacauaacaacauuaaccuuaaauauaaaugcgcuaaaugccccaauuaaaagacauagacuggcaaacuggacaaagagucaagacccaucagugugguguauucaggagaugcaucucacaugcaaagacacacacaugcucaaaauaaagggauggaggaauauuuaccaagcaaaugaaaagcaaaaauaaaagcagggguugcaauccuaguuucugauaaaacagacuucuuuaaaccaacaaagaucaagagggacaaagaaggccauuacauaaugguaaagggaucaaugcaacaagaagagcuaacuauccuaaauauauauguacccaauacaggagcacccagauuuauaaaguucuuagagaccuacaaagagacuuagauucccacgcaauaauggugggagacuuuaacaccccacugucaauauuagaucaacaugauuguauauuuagaaaaccccauagucucagcccaaagucuccuuaagcugauaagcaacuucagcaaagucucaggauacaaagucagugugcaaaaaucacaagcauaccucuacaccaauaacagacaaacagagagccaaaucaugagugaacucccauucacaacugcugcaaagacaauaaaauaccuaggaauacaacuuacagaggaugugaaggaccucuucaaggagaacuacaaaccacuguucaaugaaauaagaaaggacacacacaaauggaagaacauucuaugcucauggauaggaagaaucaauauugugaaaauggccauacugcccaaaguaauuuacaaauucagugcuauccccaacaagcuaccauugacuuucuucacagaauugaauaacuacuuuaaaguucauauggaaccaaaaaagagcccacauagccaagacaauccuaagcaaaaagaacagugcuggagacaucacgcuacugacuucaaacuauacuacaaggccacaguaacaaaaacagcaugguacugguaccaaaacaagauauauagaccagugaaacagaacagagaccucagaaauaauaccacacaucuacaaccaucugaucuuugacaaaccugacaaaaacaaagaauggggaagggauucccuauuuaauaaaugguguugggaaaacuagcuagccaugugcagaaagcugacacuggaucccuuccuuacaccuuauacaaaaauuaacucaagauggauuaaagacuuaaacguaagacauaaaaacccuagaagaaaaccuaggcaauaccauucaggacacaggcaugggcaaagacuucaugacuaaaacaccaaaagcaauggcaacagaagccaaaauagacaaaugggaucuaauuaaagagcuuccgcacagcaaaagaaacuaacaucagagugaacgggcaaccuacagaaugggagaaaauuuuugcaaucuauccaucugacaaagggcuaauaccagaaucuacaaagaacuuaaacuuacaagaaaaaaaaaaaacaucaaaaagugggcaaaggguaugaacagacacuucucaaaagaagacauuuaugcagccaacaaacauaugaaaaauaagcucaucaccacuggucagagaaaugcaaaucaaaacuacaaugagauaccaugucacgccaguuagaacggcgaucauuaaaaagucaggaaacaacagaugcuaaagaggauguggagaaauaggaacucuuuuacauuguuggugggaguguaaauuaguccaaccauuguggaagacagugugacgauuccucaaggaucuagaacuagaaauaucauuugacccagccaucccauuacuggauauauacccaaaggacuauaaaucauuccacuauaaagacacaugcacauguauguuuacugcagcacuguucacgauagcaaagacucagaaccaacccaaaugcccaucaucaaugauagacuggauaaagaaaauguggcacguaugcaccauggaauacuaugcagcccuaaaaaugguugaguuccuguccuuugcagggacauggaugaagcuggaagccaucauucucagcaaacuaacacaagaacagaaagccaaacaccgcauguucucacucauaagugggaguugaacaaugagaacacauggacacagggaggggaacaucacacaccagagccugucagaggguggggggcuaggggagggacagcauuaggagaaauaccuaauguagaugacagguugaugggugcagcaaacugccauggcacauguauacauauguaacaaaccuguacauuccacacauguaccccagaacuuaaaguauaauuuuaaaaaauuuaaaaagagucguaacugcaucuuggcuaaaaacaaauguaaauagccauaacugcaucuugacuuuauuggcccuaaaagaagaagaggaguauuagguuagaaguuguucagcugcuucaccuugcauugaacuguucugagagaauucacucaaaguuuaaauaacuugcacagagaucucugaacucaaaguucaugcucuauuuuggugagugguggugcccuuuccuucuguggagauuagaauaagcaaugagucacucuggcugaaaggcaacuucuucccucccuccuacccuuacucccaaauaaaagaacgcccuuuacccuuugcuauuuuuuugcuaauggggaugauuuaaaacuccuacauaggugaagcucaacauuuaccuaauaauuucugugaaauucagaaguaccauuucauucuaagauaaaggauucuaacugaaguaaacauuuccauguugaguucuuugcucacaugagccaucuaggucuuuuaacagcaauuaaaaggcucuguggacauggaauaacccuugaaaauauggggauacagaagaacacagaucuguuuuucaguuaaaaagauaccaaccaguauauuaaacaguuuauuucaguaacauuguaaggcaacaauuaauccucaguaagucagcaaaccagugacaagaaauugacaaacacuccuucuacagcuuccugagacagcaggcuggcuuguggcccccugggugguaacaucuuaaggaauccuaucauguuuguuuauauaugcuaaacuguaaaaacaaacacuucaugcgacaaucauucuuaggucaaacacaagaacgaacuauuuugaaaucaauuccucacacuuuuucccugaauaugcaguacuguacuacuaacaucuaauucuguagaaaauaaugcauuuguuagugacuuuguuagagcuugaaaagacccuuuuagaaauuauuuaaaugaucacucuuuaaaaauuuuuuuuaaucucagaaucuacuaaugugacagacaaacgguaugcuuaacagagucauaaauacuguguauaauugcuugaccauuucuggcauuuaaaugaccucccagaauauuacacaagcccugagacuagugagcaucuuacuacugaccuuguacaauaccaaagcuucauaaugcuaaagaaaaccaaaacaaaagacaaugguuuacacagggaaauaacccuaaggcaauaugaaaacagucauaauuuauuacugauaaagaguaaaggcauccuucccauagagggggggaauucacagggaacacuaauuauaucagaugaaccacggggauagaaaauaggcccauuuuuaaaauucauugagaaauuauuacuuuuucuccacaacugugauucuauacaaaauauaaacccugcaaaccuuaugugcuaccugacagauaaaaguagcaggagccagacucuugaagcacuugagacugauuucuacaaaguccaggaagagcaaugauuccagugugcagugcugaugcaugugugagccuaacauguuauucagcucugguugcagccccaucuacaugggcccaguuaguuuuuagggagucacagauuaggcaggcaacgaggggcaugauuuaaaaagcacaucauacacaugagacaagcagcuucaaggacguuuucuccggcaaugcauacuuacugugcucuuucuauucagacagauccacagaccaccuuucaagagcauuccucucucauuuccuccaucacccaagauaaaucuagccacccuuuuuuguuaacugugccuuuucuuucaacuuuuuguccuuguuaaaacucaaaauuuguccaacguuucacauuuccuaaugauaaaaagaaagcuugcacaguuuaccauugaucucaccaaugcccucacugcuggaaccaaaaagccaugagagguacugcugugauacaccuuacaagcuacauagccaucuucaaaaugaaaaccaccuuuuaaguccucaugcugccauuacgcaggaucugaaccaccuacacguacaguggucucauuccaguauaagccacaaccucaagucucaggaaagccagucugcuggauaguaaguuacugagaaaaacuaaucuauucaacuggcuggaaaacaaaaagauaggcccagugcaucaguaagauuauaccaugaaggacuaaccuuguauaacacaagacuccuaugaaacaaagaaaagagaauaaauauuuauaaaauucccaccacucccagccuuccuucuaccccagaauagcccagauggcagcucagugcucugaggaaggaaguuaaggucauguacuggcacaaacaauauucugaaccaaaagaaccuacgaaaaccagagggguauguggccaaauauuccccuuuucaacuugguaagauggagagggguaacagacauguuucagaggaaaacaggcauagaaaaccaccucaggaaagcagcacagcagugcaucuguguguccacuugucaggacagugagucaccagcucagcacaggguccaggccucagcacagagagacaaagcacauuugagaggcugccugaagaaacagcuugacacaggcuacagccucaagagugcaaugcuucucucccagcccuauggcaaucacuuuccagugaccuacacagaguuauauucucaaggggaaucauuaccucagugaaugauauuuuacccaccauccacuaauacaacaaaugguuuuggggcuuaaauuggaaacaacuuuugucucauuaacaaugcucugacaguguacaucuuucuugauccuaaaggggcagcuauugaaguggauuguuggcuuuguccuuaaggucauauaaaaugacguguguguaguggcaguacccacaugugcugaagugccaaaagacuggcauuuucaagugucaacaggccaugcaucacugcgccacagcuaaacccuuauagugcuuggcccugaaaagcguuaacccagaaagcucuuugaacauaugaucauuaaaauucauugacuuacguuacaaacauccacguaacauagggagaaaccaugucacauggaguauccacugggcauguacuuagagcucauccacaagauuaaaauacaaagagaucguaggugcacacccaggcagagggaaauguccaaucugggaacuuuuccuucagagcauccaguugaggggaucucuugucuuccccagacagauagugggcagcaauggccacggugaccauuccuucaggauguucuucugaaaccugccagagaaaaucaauuaguucuccaguucucagaagccagaauacugaacccaagguucuugcuaaauaccaccugggaaccuaaucaaugaaacaaacaaugcugggaaauuggcaccugcacuucuauccagaacugccaugcagaggccuggaguccaugggaguaaaagacaaaguagucuccuccuuuacuugugacuggggugccauugccaagagaccacugagaaaguguugacccuuugugggcucgaacauagaaggacauauggcuugguccuguaagguaaaaggaagaaagaacaguuaaucuuuuuaaaaggaucaaaaaaauaacccacaauccaaaccagacuucauaaagguucaugccugcaugacuuuaaauauacuuacuauaaaccuaauggagguuuaccaguuuggacacuuagugugaaucaacaagguuaaauaaugagguacaggagaaaaggcacagacuguaaaugagaaagccuguguuaaguugguccuaucacuuaacugcugcaugacaucaggaauuuaaucuaugucacaauuucuucauugaggggauuauauuagaaaaagcauaugaaaguguuggcaaaacugcgaagugcuguaacaguacugaauaggacugccauuaugaauggaguuguaauuuucagaguugaucauguaacaccuuaaaauauguuuuacuaguuuuucccuucaagcuggaaaauauuagcucaguucugaaaauuuagucaucacugggaacuuccaaggaaacugaugacaguggaagucaaacuaaaacuaaaauagauaaaacuaaacaaaaacacacccucagccuaacuuaaagacagagaauacccacauuugaaauaaccguaaauuuuuaaaucucagggagcaaucucacacacuugugcccacccugcuucugcugcaaggcuuuguggcaaaugcagaccaagucaguccacccuaaaucugaaaauacuacuauaguguccagucaaagaaagguuuacagggcagggacuuaaaaguauauuauugaaguaacagucuucaaaaccaaagcuucucagggaaaaauaaaaaagaaggaagaggaauccuuuggcauuuggguggugaagaugaaaagaagcaaaagaaaauucaggguccugcaagaaaaauccagucaaaaaaguugaaagagauaaauauuauucauccacaccaacacaaacuuccuaaagaaucuggacuuucuuacacugacagaaaaggaagccauugcuagaaaucuuacaaaacagcacaaaaaugaggaagaaaaggauaaacagauccauacaguuauuaccaaaaaaaaguaucagaaaauuccucuuggaaaaaaaaagaaauaaccaugaagcaggagaaaauguuauaaucacacuccaacuacaaauauauccauacaaacauuuggggauauuuaaaaccccaccaugaaucagaaauucuuacuagaaggaagaauuaaaaggaccgacuagacucagaaaagaaauggaggaaaaaggcaaaauuaccuuagaaaugaagacaauuacaagaugcccaacagaauagauucaaaggaaaauuuaauaacagucauaaagacaggagaaauacuaagaaaauuaaaaugggaaaaagcaaaguaaaaaagguuagcgauagugguaaaaauggaaggcaggucagaaaaaauauucauuugguaccccagaagaaaaccaaacaacgaaacagaacuaauauuuaaaacuguaauccaagaaagcauuccagaaacaaaaagagagcugaaucuacacauugaaagagacuaccaggcaccuuagaauauuaacacagaacaaacaacuucaagacauaaccuaguaaaacuauuagauuucaaagaaaaaaaaaaucuucaaggucuucaauaaaaaguuugaucaaauaacuuacaaaaaaaauuacauugguaucagaccccaaaaacaauauauaaaacaaggcaacaauggaacaacaauuuuuaaaaacucaauauuggaaaacgugaaccaaagauuuuauguccaccaacuuguccuucaacuaucaggauuacagaaaaccaauuuuaaccauacagaaacagcacucaugagcccuucuucagaaacagucuagagaauaagcuucauccaaccaacagauaacuguacaaacuucagcaaaagaacuuuuuccugagacagggucuugcucuaucaccuagguucgagugcaguggugugaacacagcccacugcucuaccaccuaggcuggaaugcaguggcaugaacagcccacugcucugucaccuagggucgagugcaguggcgugaacacagcagcccacugcucuaucgccuaggcuggaguccaguggcaugaacacagcccacugcagccuugacuuccuuggcuugagcaauccuauugccucagccucccaaguagcugggacuacagaugcaugcuacaaaccuggccuuuuuuuuuuuuuuuugguagagauggggucuccccguguugcccaggcuggucucgagcuccugggcucaagccauccuccugccucaaccucccaaaguacccccaaagugagccaccacaccuggccaaaagaacuuauuauacugaggauuuuaauauauccaaauguauuacaaaaacacuaaggugaaguuauaagacaaauauacaaauguuacauguuguaauaaaaauuggauggaaaaugggagagagaaagaggaaaguagaauaagcauggcuguuguauggguuaauuggugggaguuaaaacaauaccuuuuuuuuuuuuuuuuuuuuuuuccccugagacggagucucguucuguggcccaggcuggagcgcaguggcgcaauuucagcucacugcaaccucugccucccggguucaaguaaaauaauagagaauuaaaacaaauauaaacauucauaaaugccagaaaauaaauguuuuaaagagcauagaagacaccucauagaaaaaaggaauauaacaaauaaagcaacacauguaauuauaaaauacugugacaacugaggccaaauguaugaguaauaaaaauuaauguaaauaaaccuaacuuacccacuaaaagaaaaacaauuucaacuuggcuuacaaagccaaacccaaucacauacuguauguuuccugaauacagagagauacagaaaggguaaauaaagguaugaacaaagguauuucaggcaaguggaaauuguuuaaaaguccuaucuuauuucucaaaacacagaauucaaggcaaaggcauuaaauauaaaaggggcacuuuuuaauacugaaagucacaauucacaaugaagacauaaaauugugaauaucuaugcaucagauaacauagcaaccacuuuauaaagaaaacuacaggaggcguauagaagauauauacauauaaacacacaaauaagagacuccaauauuccacucaguacaagacacaucaauugagcuuuguggggugauggaaauguuuuauaucuucauagagaugaggguuacauggguauauaucugcuuuuaccaaaacuaacugaacuguguaagaucuuuacauuucauuguauguaaauuaggccuugaaaaaaauaaaguaggcaaggggaaaagugauauuuaaaaauacuuuucacucaugaaagucccagacaacuuucuaucaggggaagaguacucagaaaaaguauagcgugaacagcugcaggaacaguugaagugaacuuccuauauuagcauucuccagggaaaccaacaggauguguacagagagaaagagagagagagacagagagagugauugagauuuauuuuaaggaacuggcuuacaugauuguugaggcuggcaaguccaaaaucugaaggauaggcaggcaggcugaagaaaaaagucacaguaugagacugaaggcagucugcuagcagaauuccccauucccucuccuuggggaaggucagucuuuuucucaaggccuucacugacgggaugaggcucacuugcauuauggagggcaaucugcuuuacucgaaguccagugauuugcauguuaaucuuacccagaaaauauuuucacagaaacaucuaggauagcauuugaccagauaccugggugcuguggucuacccaaguugacacauaaaauaaccaucauacuucccaaaaagacauuagaaagggagagaccauccugguuugcucacuuuuuaaaacaccucacaagcaaacaaacucuuuacagcuuuugaagaugagaaaaugucauaugucuugacauuucuccuccuccuuucucaagcaucugucuccguacuaagcccaaguagaaugcuuuaaaagaaaaacaguugcuaaauuuaacaauucaacacaugucuugaguacccaucaagugccagugauuauacuggaugccaagaauacagagauaaaugaaaacccauucaugucugccucccuuuaauucuaaaggaaaacaaagacauaaacuacauaaucgugauacaagauggucaguguuacaacagauauacacaaagggaggaagaagugggaggauggcaguugcucacuuaauuggaaaugaugggagaggagggcagagaaaucuucauauuuugccaagaagagaaggguagagucuggguaggagguaguaccaagaagaguaucacucauaccagaaguaacaguguguguugggugcaaauaaggguuggauguggcuaugcagugcaaagggagugcugaaaagaaucccgaaauauacacaaaguccagacuaccgaagaccuaacaugcuuugccaaggaauuugaacuuacucuccaggcaacaggaaauccaucaaaaguuuuuuaauagggaaguagacauaaugaaaucgauauuugaaagauaaacuggcagcaccauaaagaauauccuagaaagaaguuuuacaggccaaaacauaaguuaagaagcuggaagaccuaacugcuaguuuuaaagauggaaaagggaauaaaauguaccaaaaaagauaaagucauaaugccaggccaaaugcuccuggaucugacaaugaaccaauaucugacacuaaaaguuuuucaguaaaucuucuuaaaaaucauaaccagucucaacuucuuugagaaacaauguaaggcuccuaaauugcuggucaauuuaagacuuaaacuuuagggcaagaaaaaccacaugcaacuuauuaaaagguuuaagaagugaaggagcaggaaaaaaagauggucaugugacuuaccuauuguuuaaaaggucaacuugauagaaucccagggagggaugaauugagaauauuauguuauaagguaucugcacuaccaugaagcaguacaguguuaacugaagacagacauacugcaagcuccauagcaaccacuaaaauaaguauaauugauaugguaagaauauaaaagaauagaacaauauacaaugcucaauuaaaaccugagaaggcaaguauaauacaggucagaaacucaagauuuucauauaacaaaagaaagcacacuagagagggaaugagguaaaauaaaaacucauuuuuccuauucuuaauugaucuaacagauaacaguuuuucaaaauaauagcaacaauguaugugguuauguauacuuauaugugugcauuguguguacauacugcauaugugcacacacgcuucuguauaagagagauaaaugcuagcaauguuacaagagacuggaaggagaaauuaggauuauuuuguuauuaaguuauucauaaucccugugaugcagaauaguauuauuuaaaagugggcuugcauagcuguaaauguguacugcaaacgacagggcagccauuaaaaaagguuaaaaaaaaaauaguaguguaacugacaugcuaagaaaggagagaaaaccacaucauauaaaauguccaauuaaaacuacuaaaggcagaaaaagaguggaagacaaaaacaggaagaaaaaacaagggcaacaaauagaaaauaguuaacuaauaugguagcuauuaauucaacuauauuaauaaucacuuugaaugucaaugucuaaacauacaaauuaaaagacagagcgucaggguggaucaaaaaacaagaccccacuauguguugucuacagaaaacccauuuuaacuaugaaggcacauaaauuaagagucaguggauggagaacauuauaccaugcuaacacuaaucaaaagaaaguaggagagcaauauuaauuuuagacaaagcugacuuuuaaagcaaggaaaauuagcagcgauaaagaggggcaaugcauaaugauaaagggucaguucucuaagaagacauaacaaucuuuaauuuguauguagcuaacaauaaagugucaaaauaguuggcaaacucauacaacuaaaggagaaagacaaauucacaauuacagucagagacuucaacaccccuccaucacugaaaaauucaauaggcagaaaaucaguaaaaauauaauugaacugaacaucaucaucaaucgauuagaucuaagugacauucauaaagccuucuuccaacagcaacaguaugcacauuauuuucaagcauacugcuugaaauggaacauucaucaagagagaccacauccuguaucauaaagcacaccuuaacagauuuagaauagaauucauacaaaguaugcucucagaccacaaugaaauuaaacuagaaaucaauuaucagaaaaauagcugaaaaaucaaaucauuuggagauuaaagaacacacuucuacauaacaaaugggucaaaaaagaagucucaagaaaaaauuuuuaaauacuugaaacuaaauuaaaaugaaaauucaacuuaaaauuuguggcauggaacauaagcagugcuuagaaggaaacuuauagcaaugaaugcauauauuagaaaagaugauuuaaaaucaauaaucuaagcuuccaccuuaauaaacuaaaaaaggaagaacaaauuaaauccaaaguaaacagaagaaauaacuagaacagaacucaauagagaaaaccaacuauaaucaaaagcuaguucuuagaaaagaucaauaaaauugauaacccuucagccaggcagagaaaaaaagaaaagauguaaauuacuaauaugagaaaugaaagaggggacaucauuauagaucccaugaacauuaaaaggauaauuaaggaauauuauagacaaauuauauuuccauaaaucugauaaccuagauaaaaugaaccaauucuuuaaaagacacaaucugccaaaguucacaccaugagaaacugacaaccugaacaggccuguaucuauuaaagagugaaucaauaauuaauaaccuuccaacacagaaaaagaaccuaccaagccuacggggguucauaggugaauucuaccaaacauuuaaggaaggaauuauacuaauucucuacaaagcuuuucagaagacagaagcagagggaauacuucuuaacccauccuaugaguccagcauuauccuaauaccaaagcuagacaacaacaauacaagaaaacuauaaaccaguaucucucaugaacauagaugcaaaaauccuuaacaaaauauuaguaaaucaaaucaacgaugcauaaaagguuuuauacaccauaaccaaguaggauuuaccucagguaugcaaagcaguccaauacuugaaaaucaauuaaugucaucuauuacaucaaaaggcuaagaaagaaaaaucacaugcccauaucaauauaugcaggaaaagcaacugacaaaauccaagaccuauucaugauaaaaacucucaguaagcuaggaauagagggaacuuccucagucucauaaaaaacaucuaccaaaaaacguauagcuaacaacauacucagugguaagaaaccagaagcuugccuagaucaggaacaaggcaaagauguccccucucacaacgccuugucaaaaucaaacuagaagucccagauaauguaacaagucaagaaguggaaauaaaaauuauagauauuaggaaggaggaaauaaaacugucugcagaugauaagauugucuauucauagaaucuuaaaagaauaggcugggcgcgguggcucacgccuguaaucccagcacuuugagaggcugaggcaggcggaucacaaggucaggaguuugagaccagccuggccaacguggugaaacccugucucuacuaaaauuacaaaaauuagccaggugugguggcgggugccuguauucccagcuacuugggaggcugaggcgggagaaucacuugaacccaggaggcagagguugccgugagccgagaucguaccacugcacuccagccuaggugacagagugagacugucucaaaaaagaaaaagaaaaagaaaagaaaaucuucuuaaagaauaaaccaaacaaaaacaaaaacaaaaacaaaaacaaaucuccuagaucuaauaagugauuauagcaaggcugcaggauaugaggguaauaaucugaaacucaguugcuuuccuguagaccaucaaugaacaauaccauuuauuaauacauuagcacccccaaaaauaacuacuuaaaaauaaaucuaacaaaauauauauaaggauucuauaaggaaaacuacagaacugaugaaagaaaucaaacaagauaaaaauaaauggagggauauuccaacacggauaggaaaagccauuauuguuaaaauaucauuucuucccaccuugaucuacagacucaauacaaucccaaucagaacuccaacaaguuauuuugugaauauugacaaacugauucuaaaguuuacauggaaaggcaaaagacaaaacacaauucuggagaagaagaguuggaagacugauacuacccaacuucaaaacuuaacuauauaauuacagugaucaugacaguugugguaugggcaaaagaacagagaaaucagucaauggaaagaacaguuuggcaguuucuuacaaagcuaaacauaggcuuaccauauauaauauccagcaaucacacuccuaagcauuuacccaaaugaguucaaaaaccugcccaggaaucuuuauagcagccuuauucaaauauggauaacugcuguacaucuacacaacggacuauucagcaauaaaaagaaauggccuaucaagucacaaaaagauauggaggaucccuuaaaugcauacuucuaagugaaagaagucagucgaaaaaggcuacauacucugugcuuccagcuauaugauaccuggaaaaggcaaagcuacagagauaauaaaaagaccaaugguugcuaaggagagugggaagaaaagagagauaaauaggugaagcacagggcauuucuagaugguaaaucuauucuguaugauacuguaaugguagauacauggcaucacacauuuuucaauacccauagaacuacacaacacgaagaaugaacccgagugggaacaacaggcuucgauuaauaauaauauaucaguguuaaaacuggugcaucaguuuuaacaaaugcaccauacuaaugcaagacauuaauagaggaaaaucggggggcaggauaugagaacucuauaauuucuacuuaauuuuucuguaaacuuaacauugcuccaaaaaauaaaaauaauuuuuauuuuugagacagggucuugcucugucacccagguuggaaugcaguggugcuaucagccuugaccuccugggcucaagugauucucccagcucagccucucaaguucucaaguagcuaagacuacaggcaugcaccaacaugcccagcuaauuuuuuuuuuuuuaauuuuguagagacgggaugucacuauguugcccuggcuggucuugaacuccugggcucaagcaauccuccuaccucagccuccugaguagcaagcauaagccaccaugccuggccuauuaaauuuuuguuaagaagucauaaccagcuuuggccgggcgugguggcucauaccuguaaucccagcacuuugggaggccgaggcaggcagaccaugaggucaggaguucaagaccagccugaccaacauggugaaacccugucucuacuaaaaauacaaaaauuagccaggcaugguggcacacaccuguaaucccaaauacucaggaggcugaggcaggagaaucacuugaacccaggaggcggagguugcagugagccgagaucguaccacugcacucuagccugggcgacagagcgagacuccaucucaaaaaaaaaaaaaaaagaagucauaaccagcuucaauugauuuuagaaacaucacaggcucuuccuaaguugcugguuccugugauauaucugagggaaaaacauacaugccacuuauuaacaaguuuaagaaauaaaggaggggagaaaaaacuauuauaugacuuaccuguugcuucaaaagucaauuuuauagaaucccaaggugucuguucuuuggauaugagucggaaaugaggaggauuucuuggagaaacuucuggggcaggaagauaccaguuuuuccuauuuagaaaggaagcuucaguuuuagggugcuuuauuauuugauggcuaucuguaacucacagaacuguucagcauauaugaacacauuuuuggguaugaaaauaaacugacagacaugauaagcaaugccaacuccaacaaauuuagguuauuuuguaauaaaaccuucccaauguuaagaacaaaggaguaaccuaggugaucuugauuccaccacccauccuauuucuucucauccaguccuucacugccaagcuauaaaaucuucccagagaaaacaauuuuuuuuuuucuuugagagacagaguuuugcuguuguugcccaggcuggagugaaauggcgcgauaucggcucaccgcaaccuccaccucccggguucaagcaauuccccugccucagccucccgaguaccugggauuacaggcaugcaccaccaugcccggcuaauuuuauauuuuuaguagagacacgguuucuccagguuugucaggcuggucucgaacucccgaccucaggugauccacccgccucggccucccaaagugcugggauuacaggcaugagccaccgugcccggccacaauuuuugagauagaugcuuauuggcuauuauauuaguuagaagggccaccuuuucuaaccacucagguuucuagagaaaagauuuuuaaaauuugaaaaaacaaaacuacucuucugagugcuuuauuccacuaaaaaaaaaaaaaaaguuucauaaugauagaaaaaauaguacaaacaccacugaacuuguauauuaaaggauggcaguuuaaaugauaagaguacugauauggugacaagacuugagaacaaacuaaccuuaagcagaaaaauaaugaaccaaccugaucagaaagugcacuggaagauaccaaggaaaaccacaaagaggugcauucuccucacagugagcucggauacuaucauugaucucaggaaugugagggguuaugugagaaauuccaguauaaucaaacccauugauccauauuccagagucccguuuaacugcauuuccuuccaagucauggaauguucuagucauaugcugaaaaaaaaagacuagugaaaaaacuguuucaacuaguacacccacauucccaccccagauuacaaaaauggaguaugacaauaccaagaaaugauguggauauggagcaagugaauaagacacugagaguuucuaagguacugcuagcguucuuuauuuuaaacuggaaaauagauauauagauuauuguuuuauuguaucuuccaaauauauuuaggauuccuauaaaauguuuuugaaacuuacuauuucagacuuaaaagacguuaauguuagagcugcuuuuagauaaggauuuaaaacaaauacauccuaagcacauauauacauacacacucauuucccuauuaguguuuuaugaagcuaauucaugugcagagaaaagugggaauugcagcucaccacuagaugacagccuugugccuaacagaauucuaugaaaaggcaccgugcuccauuugaaauaacuuuauucacggcagaaaccagccugaagaauaccaaucaggaaaaaaacaaacaaaaaaaaacacugcauagggcaggagccggcaaacugcagccaacagggcaaacuguccacugacuguuuuuauauacgaaccauuauuugaacauggccacacucauuuguuuggguauacucuguugcugcuuucgcucuguuucacugcaacagacuguauugcugacaaagcccaaaauauuaucuuguccuuuacaggaaaaguuugccaacuucuggcacaguggaagagaacccccaaacaaaucagaaaaugacuuuuuaaaaauaaaaauccugcuuuuccuaaguauuacugacauaauuauaaaacuuaauacaucaugaaaaacacacugaaccuccuaaaaaaaaauccguucuucacuaaagguuuuacaaauuguaaaaucucacauaaaauuuaucacaguguccuucaggacuauaacaaggaauuguuauuuggccccuuuucaaaaccuccuaaguguuuuuaauuuuuuaaguccuugaauaauuaucuagguauaauuccucuggcauuucuguuuggcuagauuagguuagaugugacucuugcccuuaaggguauauguuaucuugaagcaggaucuuucacuuacagaguauaaaauacaaauaagaauuaugcaaaauauacaauauguuaguauguguucacaaacaugagaaagggauggguauaaggcauaagauaauuuguguaguaugagaacuuuuaaaaacaauuuagaaaaacuaacaauuuagccaucucuaacagagaugacuagaauugaggcuuacugcuuuauaguaccaggucuaaaaaauuugaagaaaaaguugagaucuaaaauaaguccucaaacuggccaggugugguggcucacaccuguaaucccaagcacuuugggaggccgagguggguggaucaccugaggucaggaauucaagaacagccuggccaacguagugaaacccugucuccacuaaaaauacaaaaauuagccaggcgugguggcgagcgccuguaauaccagcuacuugggagucugaggcaggagaaucacuugaaccgagggggcagagguugcagugagccaagaucguuccacugcacuccagccugggcaacagaccaagacuccauuuuaaaaaaagagaaaagaaaguaaguccuaaaacucacuuuauuaaacccuuucuaaguuauaguuucacuaucacauaucacuuugaauguuacuuaagauuaauuuuacuagcacuucuaaacaucaauuuuauuuugccaguugacaguuuagauuuuacucagccuguauacauuuuuacaaucuauauuucuaaaaacucauuauuccauaauaaauauuugcuccuguuuuuccaaauagaugcaguuuuauaauuugaauaguaauaaaaacaagcaaacauuuccaauucagucuccugggagauauaugucuagcugauaagaaugccucuugacagucagucuucuccucacugccuuacacacaaaaaaggugaguaugacuaaauaggucaacagcagaaaagucagcugcgcuugcuauucacuacugaagcucaaaacacacagggcuuccuuuccagaucucaaauaccucaugcaaaacugcucaccugaagaaacacucucuuuggcuucggauuagcaggauuggagcuauauggaaaaaauguuccacugcaaacaaggaggaauguaauugcacauaccaaaguuaaaguuagcaugguuuuuuuugugcucuuggcaagguagaugaaguuaaucugaaacacaaaccacaaacacagaaauauuacaaauucauucuagugguggaaagguguuuuuaacuaacuuuauuuuuaacaguauuaccuaacagccccugaagaaaauuuaucagcaggugcuagcauacucuaacaucuaguaaacaaagcacuaacucuaggagauuuccauugcaggugagaaccuagaaaaugacagaugccuccaaucugccaugauggugccaccuuuuuggcaugcagccaaaaaccaagagggaaaaaggaaacucaggacugucgcuguccuuaaugugcgaaaagaacagaaauguagauguaauggauuauucauuaaauaaccagagauaagcuuuaagcuuaggcagaucuguuuggacaaaacucaaauuccacucauaaugcuuuaaaauaugucaaaauacuaaauucaucucaacuggcauagagauguaccuucaagacucugccaguggaccugcauaagaggaaaaacugcauuacaaaguaauauuaucccucuaagugacaaauuaaccaaugccaacacaaucaaaacaauaaaucuaggcaguaaauguaaaugacucagucucaagguuggcaucuagaaaauccuaaauauuuucaaucguaaugaaaucgcugaacuaaaaacuguaaaggacacacacgacucacagaguauguccacagaucccuuacagggucugaagaagccauuuggggaaacuuuuaugugaaaucugaaauuguucuaagaagccacauuuuaaauauugugaauacugagagaaagauggacagcgagggugacacauuuuguuuugcuagcucagccucaaguccucagguacucugucauauuuuuguacucaguauacaaaugugagaugugugaccuaaggcuaguacuguuuugcugcagaugccucuggauggaauauugguauacuauagacaugaaaucuaaacccaccuccccuuuaugccuucuucauuuuauuucucuacuuauuuccauaaguagaaaaauaacaugaaugugaaauuuuauuuauuuuucuggagacagagucucgcucugucacccaggcuggagugcagaggcacgaucucagcucacugcaaucuccaacacucagguucaagcgauucuugugccucagccuccugaguagcugaaauuacaagugugcaccaccgugcucagcuaauuucuuguguuuuuaguacagacaggguuucaccauguuggccaggcuggucuugaacugcugaccuuaagucauccacccgccucagccucccaaagugcugggauuacaggcgugagccaccaugcccagcaagcaaucaguuaauagguguccuuaaguuauucucugcuggaccuucaugguuauacguauacugauugaaugacaggggaaauggggacugcugauacaaguggggucaggaggagaagacucagaaacagcucaguuaucagcacacaauggacauuucagagucccuuuucaugcuucucuucauuuuauuuugcacccaucucagaaccuagagugacacaggaugcaauauuucaggaaggccgaggcacgagaauugcuugaacccaggaggcggugguugcagggagccgagauuacaccacugcacuccagccugagugacagagcgagacucugucucaaaaacaaacaaacaaacaaacaaacaaaaaaccgugauugcuugacaagacuuuaauugcuuucuagcagauguauuuaauaaauccccaaggacugaagggaaagcugucugaaauaugcauugugguucaauucuccauuacccaaagaaaacagucuuacucuauuaauaagccacuaucauuaacacugcuacacauaaguaagaaaauaauuaaaagagugauaacucauggcaucaaagugcggcagggcuauuucacauuauaaugaaaaauaagugagcuuucuaaaguauuccaagaggcagucuucucuccaaaagcuuucccaauaaaauauaauuuagaugauaagacacuuuaauccucuuucuucugguuuccaagauuuccaugcuuuggggacauuuuccauuuccacaaugaacaucuccaggguucauuuugcccccuuucauauuaucaguggaacagaauuuaaauguccccuaucugagucaucuuuuauggacauccauagcucccauucaugacuauaauuuaacaaauaaacgggggugugggggcauucaguucauaacuaguugacuucagauuagauuagaaccuaaucuauagauaacaaaaguccacugucuccuucaauccuuacaacagcaaaccuaucaaaaauacagaugauauaaggguuacuauuaaacucaaaagcagcaaacccuacaggcagcaaagaacauuuuagaacuuuucauacagcccuaugaauaccaauaaggauuauccuuauccuuauauuauccuuaauaauuauccuauaaguaaaaugguuggaaggcucagaucucuuuuaagacuaguacaaccaaccucaaacaauaauaugcauaagaauuacucuacaggacuauauacacaaagucacauauauagagcuuuacuggcuauaagggacuuccacggaugaugcugaccauguguguaguguuuuccuuaccugcugucuuuagaaccuaacuuccacaaaguaaagggguaacgaaugcccuuuacuauaucaguaugaaaaggcucacuaucaucuccaugaagaaaagaacuauaauaaaaucauagcuccuuuuccuguuugguucccuauccucaaauuucaaggugcaccucugaguguucaauaauuacuuuuuauucuuaggaauucccaccaaaagagaccugcauucucuggaggggcccaucuuggaucguggagguggacaucaaaccaaagcaaaaccuugcuuggggcuuacucugcucaaggggggucuggucuuaaacucugcaucacugucuuuucuucccucugggaaucccaagggaagaaaaaaagggauggcaaacacaggacucuccuuacuagggcaggacacugauacggcaaaaugaggacugacaaggccugugaucauuucauuauuugguaaaugaaggcacguuugggugucauaacagacucaauuaacaagcuuucaugugguagcaacaagguaguggaaugauaaugaaaaaagccucaucagauuuagucuuccuucacuagcucuaaaagcacuaauaaaaccacccauguaucuauuaacaugugccucuaauuaguaauuucaaaauauacuauuaggaucauucaccaccaggcaaucucuaacaauuaauacuugguaaacgcucuacaaauucacacucagguaucugacaggcuauuugaaaagagguaaaucagagaauuuggaaggauagggaggcaaaaaacuuuuaaacagcaacaacaaacucuauacuacaguuucuuacgauaccaaauuuacaagaugcauggccauucauucaccauuucuucugcuucagauuuucucaauaaaguacacguaacacuauuucacagaaucuaguauggcuaaauucauauucauauaaaaaaugaagaaaaagaaaaaaacuuauuuucucuuacaaaauaggacgagagaaucauuguacagccagccaaaauggaugccagcacaacaucaggugggauuucagaaccacuucucccgaggauagggguaaacaucucaaauacugcccagaugagguacaaugcauaaagauaaggaauaaacauccccaaaagguaaaaagcaauaaauuuuccuugggcaccuagggaaaaagagaaaaaaagcacacaucuaugaaauccuccagugagauauaaauuuuuauaguacuggugugccuugguacccuaacagaaauuagguuagaugugacucuugcccuuaaggguguauguuaucuuggaguaggaucuuucacucaggauaaaauacaaauaagaauaaagcaaaauacacaaguaauauauuaguauguguucacaaacaugagaaagggauggaguauaaggcauaagauaauuugugugguaugaaaacuuuuaaaaacuaacaauuuagaaagccuacccaauaaaaccaaaaaagaaagagucccugaaagccuuaaguauuuuaagguauucucccauguauaucaaaaucaaaaauacccuaccaugcugcuugaaguccuuaugcacacagagcuuugugagcaaugggaaugcuacccagacagcacuaauaaacgccgagcaaaguccuugguaagugaggguaacaagaaaacagcaauggacaaacagcgaaaugucaaaaaauacuucucccagauacugggcacuggcauucugaaagaaagaaaaauauacaaguagucucauucaggggucaugcauaaagagcuuuuauuauaguaacacacuuuccaucacucaggaaagcuacauuuuguuuuaaacacagucugcucuuuaaacugauuuaaaguaaacacuaacaaagcuaccucccccaucaugaaguaguaaauucaaauguagcacaagaaagggcauuuuaacaauauagaguauaaaugcuccauguacucuaugcuuuucuucuacuaggcuaaaaguagaaauuuuccaaaauagaagaaaggacucuccuaaaaaacaaucaucucuguaagcuuuucaguucaugccaauuccaaacacuguuucaagcaaacuagagaaaugaccugugaaggaacguuaggaacugcugcagcaccaccaauaacccacaucuggaaaacugcagcaccuuuaaagcaaucuggaguuuggcuuauuuucaugaguuuuuucuaucuccaguuggucuuguacugcaccuuugcccccuucuuguauuccucaugauuuccuauuauaaaauuugaucuuacaguuuuugagauuuaaaguccaaggguuccuauguagcaccuugcacucuucaaaauaaaguugccauauaaacuuuuuuuuuuuuuuuuugagacagguucucgcucugucgccuaggccggaguccaguggugcgaucucggcccacugcagucucagccuccugggcucaagugauucuucugccucagccuccugaaguaacugggacuauaggcacacaccacuacacccagcaaaguuuaaaaaaaacauuuuuuuuuuggcagagacagggucuugccauguugcucagccuggucucaaacaccuggccucaagcagucuucccaccucagccucccaaagcacugggauuacaggugugagccacugugccuggccuaauaugaacuuaauacauuuuaacaucugcaugaguaauucuauucacacaaacaugaaaguuuuaauuacggugcauaaauacaaagauggaaauggagaaauagauauauuaaaguuucuccuucuucaagggcucaagaguuucugugacguguuuucaaaacaaguuacaguucauguaacaaccccuccccgcucccaacaaugaaagauaggcuacagcugcuaaauacuuaaguuauuaacacugcguugaucaagaggcuuggucuuuaaaaauaagaaaauuauuauuauaguucaauuugaagcugaaugccacucagauauucaaaaacaaagaucucauuuuaagugcccaaacugcaccaaagauaaaacaucgcucgaaucuauuuuccuccucaccucuauucauccccugcccacuccugcuccauuccaguccacuuuauacauuguuaucaguuuucucacaaaaucacaaauucucucacugaccugcccaaaacauuuuaauaguggccccauugauuuuuagaaucaugcucccacuucacccuggccuccuuuuccaguuauuggacuaccuccuugucuucaccacacuggacuguccacuaacugacacagaugcauuuuauacauucccaccuuaaaccgcucaucaaucuguucccuaccugguauauuuuaacacaugcuucaaaaaccccauucaggccaggugcaguggcucaugccuauaaucccaacacuuugggaggccgaggugggaggaucacuugaggucaggaguuggagaccagccuggccaacaugguaaaacccugucucuacuaaaaacacaaaaauuagcugggcaugguggcacacaucuguagucccagguacuugggaggcugaggcacaagaacagcuagaacccaggaggcagagguugcagugagccaagaucacaccacugcacuccaaccugggcgacagagugagacucugucucaacaacaacaacaaaaaaaaaacggaaacaauucaaauguugccaucucagccacccugacuuccacaagcaaaauucaucucgccuccccuauauucuuacagcauaguuauaugucagucucacuucaucccacaauauauugcaauuauuaucauucccacaccuucccaaacgaaacugagagcuccucaaagaaagagaucacauucuuauggcucucuuauggcaucauucuuguuuuuuuuaaaaaaaaauaauagagauguggucucacuuauauugcccaggcuggucucaaacuccuggccucaagcagucuuccugccuuggccucccaauguugggauuacagguguaagccaccaugcccagucucuuaugguaucauucuucugcuaccauguucacugggcacuuaaagaauauuugugaaaagaaaaugaaacacaucacucuuucuauugugcuuuuacccuaaaguguuacgaucagacaacugaaauuaguaaaaguacaugaaauuuuauuacacauuucuauccuacuucugccccaaucaacaauaguuagccacacucugauuacauacaauuacaauaaaaauaagcaugugaaauugagccccacgguauaauucuuuugggaacugaagccacuaagauaaaaauaugagcucaaccauaagcagacggcuaaccucaaagaaccuuccuucagcaggagcugcuaacauggaagguuccacagaacacaucccaacauuaacugaaacucagaccaaaguucagauaccaaagacauacuuguggaaggauguuggguuaaaaucauccaugucucauucuaaucuuuaucaggauaaauugaaaacaguaggcuuacauggagcuaagaaagaucuuccucuuuaauucacauaaacaaucugaaaccaugacucuucacuguaauucauuuuuagaccuauuauuuuacagcuuuuuaaauuuuuguuuguuuguuuguuugagauagggucucacucuguccccuaggcuggagugcagugguacaaucacagcucacugcagccuugaucucaugggcucagguaauccuccuaccucagccacccagguagcugggacuacaggcacacaccaccaugccuggcuaauuuuuuguauuuuuuguggagacaggguuucaccauguugcccaggcuaaagcgauccgccugcccagccucccaaaguguugggauuacaggcaugagccacagcacccagcccauagcccuaauuucuuuuuuuugagacagaaucucgcugucgccccagcuggagugcaguggcucaaucucagcucacugcaggcuccgccucccggguucacgccauucuccugccucagccucccgagcagcugggacuacaggcgccgccaccucgcccggcuaauuuuuuguauuuuuaguagagacgggguuucaccguguuagccaggauggucucgaucuccugaccuugugauccgcccaccucagccucccaaagugcugggauuacaggcgugagccaccgcgcccggccagcccuaauuucuaauuuuauuuuugccaaacaaauuuaugcauuugaaaccauaauaauauaacaauauucucaguauaaaucauuuggaacccuauuucccuucccucuguuuuccuuagcaaugugucuuuuaacuccaaugacauacaugcaugcagaaucugaaucaacaauauacaguuaaaaagaaaaaacagugagggaaaaacugaaaaaacuuuaaguacaacauucuuuuaggcaacaaauacuugcuguguguuaaugcugugugucagacacuaccuaagcacagaggauacagaaauaaauaaaacaaucccuauccucaaggagcuuacacuccaauggagaacagauauucaaauaacauaaauaagugggugagcccaggacauauuuacaaacacugcagcaaauucaguagaaggcugugcuaacaagccuuccagucaccaccacccuaacacuguuaacagcccggcuuuauaaccucauuugaauuuugugacauuacccucagaauaagaaaucuuucagaaaauuaacacaguguaggugcguuuuccauaaccaugcugaacaauuuuuuagcacucaaaaggccaaauacaaugaaucacacuuaaguucaucuucagucccuggaggcaacagaaagaaaucaacaaauauaccaaacacuuaccauguaauaaaaucuuuucgcaagaguauguauaaguauuauuuuggcuacaguugcaguuccauacagacaaacggagacauagaagugguuauaccaugagagagacuguccaauaagagagaugaacacugcuauaaugagaacgguaacaaggcuagugaaccagcugaucaaagugaugccaaguccacacaagaaguccuucuuguaguuaccagcuaaugaagagaaaacaaaaaguugaaaucaccaucuucaucaaaucaguuauauaaccagucaguagagcuaaaugggcaaacauuaaaacaaaaaacuccccacuguacuugaaaaguaugaaaauguccuaguguugagauuggccaaacacaagaacaagggagguaucaaauaauaauauucagguaacauuuauuaagagucucuagauacuaaacacucaaaaagauaaaucuucuaggaauaguucagguacauuccuuaugaaggaagaggauagucuuaaucuucuucacuuuugguaugcuuuguguaucaaaauauuagcaagaauggaaggcaaaguuccauauaaaauguuguuaaaauaagguaacauaagaagauaaggaguguggggaaaauaagcguugauaaagaauuauuuaaacugcugcuaaauauuuuaucucguaacagcacacaacaacuuagacucugaaacauuucaagcagaaauauuucaaauaaaagaaacaguuuaaccacaagcaguucauucauacuucgugacacugguccauacuagcuauuggucuguaguguggacuuuuuaaugggacuuuucauuagaagucaaucuguacaaaccauuuuucaauaguuucuaugugguacuuuuauggagugccuaaauauauaaaaauugacugcuucaccaagacuaaaaguaaaauaagcauauuaauuuaauauuuaaaaauuucuuacaauauaaagcaaacauugucuuaagauuuuuagcuuucugggaagauauaaacaaacugacugaaaaacuucaagcacauucuacagcaaugccaguauuuguaguuuuagaggaaaauacuuacucuuauguuugggcugcaaaaauuuuuugcccagguacaaaacaacacccauuaccaccauguaguuuaugauugagccaauacgagagggguaggcaaugacaaacaggcccagcacaucaaagaagaccauguuuccaugucgauacuuagaagcagcagccagcauaucagauguagcuagaugcuuaagaacugcuaaaauguugucaccuauuaguaaaaacaaaaaaaaaaagaaagaaaaggaaaaagauaaaaaggcugaauaaacuauuugugauuuacacauaccacuauuuaaagcagaaauaaaccauauacuguuugaaugaagaaaugguuagaaagaaugugaacagaaaucgcuuucuaccauccuacugcucucccucacuuuuuuuacuaaauuucucaaauaagguccauccccugccuuucuccauuuccucuccacucagacgcucagccaacuggccuguaucuuuucccuucuauuagaacuauucucugugaucaauuguaccuucauuguugacaaauccaauggcuguuucuugguacccauucauuuaauaauauauauuaacuguacuagacacucuucuagauaucagaaauuuaguggugaaccaagagacaaaggccuuucacgaagcucagagaugcugaacaagcugucacacauguguuaaaaauugaggagagcuagcagaguuccacaggaaaacaucaugggagacuaacagagcuacauucuuaccacucagcaauccucccaacccugggccaacuccuuuuucauuuccucacaaugaauauuccugaccuuaauugcuacacuagacuacaagacuaaaauucaagaucucaucucuccaacuccaaagcccuagcucauucacauugcauacugccucucuaaugcacaggccacagaauauuuacaaguuuauguaucaucccuaacauuccaucuuaguguauaucaaaagucuaaauuggaauaccaaccugcucucugaauggaaucuguuagaauucuguccgcugugucauacuuggugugauaaauguauccauucucaauaaaagcuaagucuauuccuaaaacauauauauagaaaaaaaaaagucauuuugcuuuaaagaucaaccuugcuuucgaccuauuucuuuaauaaauuccuaaaagacaaaaugucaaagcaguggcacgauugcuuugucacauuuacaaacgacugauauaaauucucuuccaaauucuuacacagucuauagcuuugguacauaauucgauacauaaugauugaagaaguauauuacuccacagguaggcauuacaagucacacagcaaggauaggaauauugaguuugggaggucaugaaaauuuugccaccuacauucuugccaggccagagccaaauuuuaacuucaaauaaguuguacauacaaguugccaagggaguuggcaaaccaagacaacaacgaaagaccccugaaggaucuauuaccaucuuuugggaaugaggugcuaaacaguucaccccuguucuucuauggggaaagaugacauauuuuagaggaggccagcauuuaaauuaguauggaguuuaaaaaaggaaacaaacucuguuuuagugagucaauguauauuucucacauaaagaauuugaucucagaaaaugcuguuuacucacauacuuucaagauuuaaaauuugcuuuugauaaauaaaugcugcacaguaggccguaaccauugacaauauaccuggaauguucccaaaaucccuguagauacgaaagucaguaucugaaggaaugauuccacucugaaaaaccuccugagccaccacagaagcaaaaggguguuuagcugcugaaacauaagcuugaaccaaccaaggauuuucaggaccuaaaaugaaagaugacaacacaauagaagguauuccggcaauuuuuuuuaacauacuaauguuuuucaacacauagaaaacaguaaaaguggugguuuugggagacggguccaauauguaccuuuucaucccuuuuucuguaguuuccaauguuucucugauauauguguuugacuuuuagaauaaaaaccuuuugugaaaauaaaguauaaaauaacagcaauacaaaagucugucugaaaaugaaagaucauucauaaaucuaucauccuaaaaugccuauuaucaauuguauaucuuuaauuuucuuacuaauguagaauuguguguauauagcuguacucaagauauauauacuuuguacauuuguuuucacuuaacauuauauuaaaugcauuuuccuauguugcuagauacaaauuggguauaccuuaucugaaaugcuugggaucagaaguauuuuggauuuuuuacuuuuucggauuuuggaauaucugcauuauacuaguaagcaucccuaauccuaaaauccaaaaucagaaaugcuccaaugaacauuuuugagcaucaugucagugcucaaaaaguugugaauuguggagcauuauggauuucaaauuuucagauuagggaugcucaaucuguauuauaauaaucauuuugauaacugcuuaacauuucacugaauaugccauaaaguuccuuguuacuuuuuauaauuuaucauuauuaauaauuuuccaucuguaucucauacaucuacagcuuuuucaaaugggaguuuuuccuguaggauagugggauacauuguuuuauaauuuauauaauuauauaauuauacguauauuuauauaauuauaauuauauaauuauauguauaauuguauaauuauucacucuucccucgcugaaaaaggauuauacauuccuacucuugccacauaccuuguaaugccugccuggggaaugaguacauacucuucuguaccuauuaacugcaggcguggcuacaugacuugcucuagccaacagacugugaggaggaaugacaugacccucaacugggcagaguuuucaaaggcauuaacaucauucauacuuauccuuaacuuugauuugugagaucaauacaucccuuauaggggcuucuccuucagccuggaucccagaaugaauaagacacauggaacauaauaaccguggaccauaacugcaguuauucagaaaccaaaaugcaacacgagcaagaaauaagccuuugcuguuguaaaccaccaagauuuugggguuguuaccacaaaacuuagcaacauauugacugauguaaacagaccaaguaacugaaugucagggaaucuaagaauauuguuuuuuuaacuucacagauuauaaaauugcuuuccuacauuuuaaaaaaugaccaaggcugggugcaguggcucacgcauauaaucccagcacuuuaggaggccgaggugggcagagcaccugaggucaggcauuuaagaccagccuggccaacauggcaaaaccccaccucuacuaaaaauacaaaaauaagcagggcaugguaaucccagcugcucaggaggcugaggcaggagaauugcuuagaccugugaggugaaggcugcacugagccaagauugugccacugcacuccagccugggugacagagugagacuccaucugaaaaaauaaaaauuaaaaauuaaaaaugacccaaaaaagcagagggacccuauagaaacagacauacaaguaauccagauacuggaguuaccagacacagauucuaaaauaauuaugauuaauauguuuuaaaaaacacagauaucaguaauuucaccagacaaguauaaucuauuuaaaagaguccuacaaauggaaauccuagaaugaaaaaacauaacugauguugcgaauuuuaauaaaugggcuuaacacaaaguuuaauacagcagaagaaaggauuaaaauuaaagcauaaaaagaaaaaaagguuggaaaauacacaaaugugaguaauuggagucccaaaagaacagaagauagaauggagaagauaaauguuuaaagacuuaauggccaagaaucuuccaaaacucauagaauucaagccacgaauucaaaaaggucuacaaaccccaaacaagauaaauauaaagaaaaacuguaucuggcaccauuuacuuuugaauacuauuccccaccaaaagaaaccaagccuccuuagagaaauggcugauuccaggucugggacuagcaaaguacaagguaaguugaaacaucugugccagaaaguaagaaagugaucaaaaagacaugucaaaggggcucaggcacugauuugaaauagacaccacuggccuaaacugggacaauucaugcaacaaaauaaacaauaguaacagaauauauagaguaaaauuaaaauacauaaaguacugaaauaacaaaaaaaaaaaaaaaaaaaggaaaauggaaagccuuccuucuugcagaauuccaacuaugaccuacaggcagaaugauggaaccagaaacucagcaguagcauuugguaaacauuguaauaaaaaugcuuggggacaagagucaucaaugauugcuaaaacuaggaucaaaguuuuaugacaaacaggauauuuaccuaaaguaucuaucacuaaggggaaaucaguaacuuguacaaagaaagaaauaguagaaaaaccuggcaaauaaauaccuuaaucaaacgaugaaaauguaguaucauuaauaaugagacaaacagauaccacaugcauccugaugugaugcacugaggacacaaauacaaaaggaaaaagaacuaugaugauggggaaauacguacauuacgagaucuuaucauauuaaaauacuauuauuaaaauauuacuauuugauauuaagaaauuuaugcuaaaaaauacaaugaaaaccauacugaaaaacagguaaagccaaacuaucauuaauuaucuuaaaacuuaggauaauaguuccucuuagaugggagggaguuguauuugagaagagagguuaaaaaaaaugccuaggcaggcaaggcaauccacccucuuccaugagacagaguuaaaaagauuuucaccuuacaauaauuaaguuuucaacuuuauaauuaaaugcuauauuugauccuggguaggaacccagauuuuuuuuuaaaugguuaggacauuaauggaacaacuggaaaaaucugaauaugcauuauuauaguuuaauauuaauauuucuugagugugaucaauguucuguuacagaagagcaugucccuguuuaucugagaugaucauccugagauuaucaauugacaugauuuuucucuuuauucugauaauguagugaauuacacagauugauuuucaaauauuauaccauccuguugaucaacuugguuggaaaguauuaucuuuuguauauauaaauauuccuggauucaguuugcuaauacuuaauuuaggacuuuugcaucuaaaguugguauuaccuacccaaaauaucuaccaaagcugaacauauacacaucuuaugacccagcgauuccacucagaaaugugcauacacauacauguguaccaaaagacauuuacgagaauguucacagcagcaccauucauagcaaaaaccuggaaacaacauaacagcaccaacggaauggaucaauuguuguagaauugacuaguguucggcaagaaaaaagaaugaacuacagaugaggaagugaagcucggaguggucacaugaccuguccaagguuccacguguagaaugugcuauagcuaaaguuuugagguuugaccuuagaucaucuaacuacagagccuaugcuuuuuuuuuuuuuuuuuggugacagagucucgcucugucucccaggcuggaguacagcaccucaaucuuggcucacugcaagcucugccucccggguucacaccauucuccugccucagccucccaaguagcugggacuacaggcgccugccaauaugcccggguaauuuuuuguauuuuuaguagagaugggguuucaccauguuauccaggaaggucucgaucuccugaccucgugauccgccugccucggccucccaaagugcugggauuacaggcaugagccaccgugcccagccuuuuuuuugagacagagucucucgcucugucguccaggcuggaaugcaauggcaugaucucggcucacugugaccucugccucccggguucaagcgauucuccugccucagccucccaaguagcugggauuacaagcgcccgccaccaugccuggcuaauuuuuguacuuuuaguagagacaggguuucacaauguuggccaggcuggucucgaacuccugaccucaggugauccgcccgccuuggccucccaaagugcugggauuacaggcguaagccaccacacccggccagagccuaugcucuuaaucaguacccuauccuaccuccacgcaaaaccuuuuaguuaucuuacagaguaagguggcaggcagauacagaaacauuuucaauugacauucuuucuccugccaucaucuaaauccuaugaugcuuccagcuucuuguguguucauuucucaagaaugagccucaucuuucuuaaugcaaagaguaugggcaugcguaacguucagaggagguaggccucagugccaagaauaguaagucaaaguucucuagaaguccagggaaaacagacccagcucagcagacccacagcauccuuccacugcuuuacuuccuucaaucucuaguuacggcaucaauacacaaaaggaaaaaaaaaaaggaggaacuaauaaaagagacuaagagugguaaauauuaugauggaagccaaguaacaugaggccugaaaacugacugaauuugccaaugugaccuuuacaagaauagucguggugaaguggggaggcuaaagcugacuagaauuguucaagaauagaucacaugguggaucuaucgauuuugguggaucucgguauaucaagguggaucacuugagcccaggagcuggagaacugugagccaugauugcaucacugcauuccagccuagaugacaaagcaagauccuaucucaaaaaaaaaaaaaagcaguuauucaagacuaugacuacagaccauucuuuugaggaauucugcaguagagggucagaggaauaagacuagcuagcagguugugauaaaagugguuuucuuuaaaauggaggaaaagguaugucugcaugcaaauggaaaugauccuauagagagagaaaaauuaaugauggaagaaagaaaaaaauuaucaugaccagucuccuacucauacacuaaagguauuuccaauuuucuacucuuaagagaaaaccaagacuggacaugaugccucaugccuuuaaucccagcacuuugggaggccaaggaaggaagacugcuuaaguccagaaguuugagaccagccugggcaacacagugagacccugucucuacaaaaaguaaaaaacuggcugggcaugguggcacgugccugucaucccagcuacucaggaggcugaagcaggcagaucacuugagcccaggagcuggaaaccagugagccaugacugcuccaccacauuccagccugggcaacaaagcaagauccuaucucaaaaaaaaaaaaagaaaagaaaagaaaacccaagaugacuuagauuuaugucaacuauuucugcagguuaaauucccagaaaugggucugcugaacugaagagccugcacauuuaaaaaaguaauacauguugccaaaaugcacaucuacauucucacuaacaguguaugaaaaugacugcuuauacucaucagcacugggcauuaucauuuuacuaacuuuuugcugaucaaguauuuuaaaaauccuuacuguuauauguauuugcauuuauucucaaauaaaacuguuuaauuuggcaguuucuuaaaaagcuaugcauaaauuuacuauacaucccaggaauuccauuccuagguaucuaaaagaaaugaaaauauacguuuacacaaagacuuacacaugaauguuuacuccagcauuaucauaaaagucuaaaaguggaaacaauccaaauauccaucgauggaugaauggauaaacgaaacauaauacauccauacaauggguuagucagccauuaaaaaaaaaugaaguacuaauacaugcgacaauguggaugaaccuugugaaagcugucagaaucaaaacagacucacuugcguuaaaaacuccgauaacggagccagggaaggccaugaagggaggguucucaugcacaaaugccugauaacaagaauuaucacaaaagacucuucaaaaaccacaaccuugcauaaaggccauugcaaccucauaucaaacaaaaaacuucagcaaggacaucagcccagcaacugccuguccaaucucagacuggugccacccuuguuauugauccuuguagccaaggauaauuaucccuaaaaaauuauguaauccucuucauuuuuccuauaaaaacuuuugucuuccuuuacugcccugguuuacuauggcacauaguuucacaguuuacuauggcacauguauuccuacugcaacacccauuacuaaauaccaucuucuuugagagucucccucuguuauuuagauuaacaaucugaaauacauuacacuaaguaaaaaaacccaaacgcaaacaaucacguguuguaugauuacauuuauaugaaaugucuacagcaggaaaaucuauagagacacaaaguagacaggcaguugccuagggaugggggaaaaugggagugacugcuaaugaguuuccuauuugggaugauaaaaacauucuaaaauugauuaugaugaugauugcacaacuaagaauuauauaucucaauaaagcuguaacuuuaaaaaaaagaauucauucuaaagaaggcuacaggccgggcguggugggucacaccuguaaucccagcacuuugggaaacugagugggccgaucaccugagcucaggaguucgagaccagccuggccaacauggugaaaccccgucuccacuaaaaauacaaaaauuagccaggcauggugucacacaccuguaaucccagcuacauggcaggcugaggcaagagaaucgcuugaacccaggaggcagagggugcagugagcugagaucgcgucacugcacuccacucuaagcgacagagcgagacuccaccucaaaaagaaaagguggcuauaaaguagcagacagaauaugauucuauuuuugccaagaaauauauauacacauauauaaauguauauuaauguuugcauuuagaaaaaaauucuagaagaguauagacuaaacuauuacacuaguuugcucuggaugguagaauuacaggggcaugaauauuuucccaagaggaaaaaagauucugugacccuuuugcuaucaagccucucucacucaugaaaugaggucacuggucugauaaaaucaagucauucuuucuggcccuucuuaaaaauuagguaguaaugauuauucuagucacuaaaaacuccccaaaugaaugucgcucucagaagugacaagggaguuccagagcacaaacuguuuaaccaaaaaguuuccagggcaggacaaauauuaucacacagaaaaaggaguaugguuuaaaaagcugaggacagcacaaucuggcauauacucucaagcacaacuccaaacccaggagggccuuuauccucuuuuagucaaacaugaaaauaacacuaacuagcuuuuugaaagccaugcccacaagaagcgcagucuuuuguaggcaguggcauuaaaagugacagagaugcugggaaagguaucagaaugucagaaagcacccagaaagcuuucagguauggaguuuagccaaaauaaugagcuccaaaaccuagagggagaaaaaaucauguaaaauuucagaguaaggagggaaauaaucucuucaaaucuuuuguaugacaccccuccaaaaaaauuaauuuugaaacauggggauuucagaacaaguaaaacauuuaaauuuuauguuuauacuaaccagucauaaaucuguuuuuugcuuuauuauuaaagugaucauauacauugcaaaaauuuaaauacauaaaauuauagaaaguagugcauuaaugacaaucaauucuggucuuaaauucaugaagcaacagagaauuuaaacuguuguuuuaccuuuaaccuaguccuccauuccagucacacacagcccaguucuaccagcaacugcucaccauccagcuaggagcauuauuaacaguuuguuuacacccuuucagauaauguaauuauuuuuagaauuuaugcagcugcagaauuuuugucuaaaaccauaugcauuuaauaaaaagaguaaggacucugggcugcccaggccuaccaaaaaugaguacuuaauaaauguaaauaaguaauguuagucagucuggaccugacuagcccuugguaaguguuuuaaccucuccggacuacacauauguaaaauauguuaacauacguacauaaaauacuuaugcauuaauauauauguacauagaaaaaaaucuagaaagggugcagauuaaaccauaaggcugguuuuucucuggauaggagcaguauaggggcaaggugcugugcuaauaaauuaaaagcauggagaugaaggcacuuaacacauaguauacuucaacauggaaaauacacagacacacuccugcuuacauggagcccugacauuuuucacaauaggaaagaagacugaguguccucucuccuucagaauuuucuuuugcugcuuuuugaucuggugguuguuacauguauguguuccuccuauccuaacugacauccaagaaauagaaagaggccgggcgugguggcucgugccuguaaucccagcucuuugggaggcugaagcaggaggacugcuugagcucaggaguuugagaccagccugggcaacauggccaaaccccaucucuacaaaaaaaggaaauuagccgggcauggugguauaugccuguagucccagcuacuugggaagcugagcugggaggaugucuugagcucucaaggcagagguugcagugagccgagaucauaccacuacacuccagccugggcaacggagugagacccugcuucaaaauaaauaaauaaauauauagauauagauauaucucuauaauaauguaucuacucacucuuguagauauuagaucccagcuucuucucauuaguuagaguaagaauaaagcagaaagguuugagaauugaaaacagaaccuugcugcuucugacaucaugaccuugagaaucucaaacgcuuagcuaaaguaaaauauacauacauuuugaaagauaaaagauuaaaauaaguuugauggagacuauuaaaauauaguauuguuuagguuaugaagacauacuuagcauaguuucauaauuuaaauaaaaucaggucuuaagagggugcuacaaaacaaguucccacaucaucuuacuucaccuagcccaucucagcacacaacacacucuugaauauuaaaacaucuagcaaaugcuacaucucuggauaaaaugcauuacccaaauuucuaacagggcagggaaauggaauggaacuuccaaugucaaauuuuaguaugcccccacuaaaaaaaucuaugagcucugaauuuuguuaauaaagacaauuaaaacccauuuaugccugagguugcaauuuuuuuaauuuuugcaugugugaaaaaucagaccuuggcgaugaggcuugagcaguaggauauaaauaacucccacaugcuuagcguuccaauaauggaacacuaggcauaaauaggcuaaguugauauccuuagaaaaguuuaaucauaaaacuaaaacuauuucucugggccaggcauggugguucaugcuuguaaucccagcacuuugggaggccaaggcaggaggaccacuugagcccaggaguuugagaccagccugggaaacauaaugggagccugucucuacaaaaaaauuuuuaaauagccaggcgugauagcaagcaccugcagucccagcaacucaggaaacugagacaggagaaccacuugaacccaggaggucaaggcugcaugauggcaccagugcacucgagccugggugacagagcauggcucugucucuaaaaaaacaauaaaauaaaaauuauucuggcugauuaaauauuacuaaauuuuuuuaacauuccacuaaaucaaugauaaauuuaaaccuguuacauacacuacagguaaauuuucucauuuuaacucaugaaaugauugacauuuaacaauauuuauaucauaaccacccacaguggcuaaaaguucacuaccuauauaacaauccaauuagagguuaagaacaaaguuucuggacccggacugucuagguucaaaucacacucugccauuaaacaacugugaaaccuuaggcaaguuauaaucucucuggacucaguuucaucucuaaaauggaaguaacaguacuuaucuuacauguuguuuggaggauucaaugacuuaauauauaugaaaugguuugaacaacacuuggcauauaauaagcacuauacaaguguuagaugcugcauuauuugguucaaaauuuuuaacaaagacaagcuaacaccaccucaugcuuuaaaaagaaugcucauucaagagacuguuuauugaagauauuauuuauaaucaaaaacuuucuacuuuuacaaaaacuagaauugcauuaaaauauacaacgcacaaucucacauaccuguuuggaauacaaguucuuucccuccuacaccugcugccucuagguuaaugaaugcacgaaucaagcuagcccaggggugcugaguaaugaaaccaugacuggccuuaaagagaaggaaagaaaacaaauauuuguuaaacaaucuuaaauuaucagucuugauuuugcuuaaacacagagagacuacuuugaugagguaaggaauaugaaaacaaaauaaucgcucuucaaaggcaguauccaaagacaucuucugcuucuuuuccuaugcauaauggccaugcacaucagguucggaaagucaccuaucacagaaggcagccuggugaccaucagcggugccaaacaacaucccugguaaguacaaggcugugcaaaagaaaaggcaaagagggccaggcacgguggcucacaccuguaaucccaaaacuuugggaggccauggugggaagaucacccgagcucaggaguucgagaccagccugggcaacauagcgagacucccucuuuuuuuguuugcucauuuuugaaacagagccuguggcccaggcuggagugcaauggcucgaucucggaucaccgcaaucuccacguuccagguucaaacgauucuccugccucaaccucccgaauagcugggauuacaggcacccaccaccacgccuggcuaauuuuuguaauuuuaguagagacgggguuucaccauguuggccaggcuggucucaaacuccugaccucgugaucugccugccucggccucccaaagugcugggauuauaggcaugagccagcgugccuggcccccuucucuuuuuaaaaagaaagaaaaaaaagagaacaggagaagagacgauccauauggcugggcauuuauuugugccugucucaaaacaucucugaaacuucaaugucaaagaaaaccugaggagaguaauuaugccagcgagagcccuucucucaaucaaauccugccacaauaaucugcuaaguggaguuuuccaaauauuaaacaucucuacauaagugguugugaauuuguuaaaguacugcucauaaaguauuuuucugcauauuauuuuauacuacccacaggagucauaaaaaaugcauuuacuauuuaguaaauaauauuuagcuauuauuauuaaucucauccuuauucaagccugauauuuaaaacaguaaaaucucacuugcaagacauuuuccucagcaccauuaaagagaaauaugacagcaugaugcaaggcuucugaagauguugacaagacgcgaaggacuuccagcaucacugagcagcuaacugcaucaucacuggcaccuucaaaucagaaaaacaaauuugcugcucagauuuuaaaauguuuacaauaugacccauuaggacuaggaauggagcuuucuccucagagaagcaucacaauagcugcaugaccagaagcauagcucugucaucaucaggugacaaucacacccaccagcaguaaguuccaugaagggaucuuugucugguuugcucacugacuuacucucaaugccuacuaccaugccugacccaccagagucacucaauuagugucugcuaaaugaaguaaccugaggggaccuaaagucauacuggaaacugguauucucagcaaaccaaggcaaucuguucuauucuuuacccguauuccacauccucuguaauagucucacuucuggugcucacagcuuccugcaucaucucccacugcacccacuccuuucuugcuuguuuuccugccaaaaucauaaaagcugcacagagaggucacuuuggaugguguaacauuccuuuaaggcuucuccaaggggauuaugugauggaaaacuaaaaagaagauaccuaaucuaguaagucacaggaaaggagacuaaugaccuaaguaguauccuaggucccagaacacacacucaguugaaucucugaaccucuucuugauucagaaauuuuguauguuaauuaaaaguaacuauaaagaugacuuaacugucuugcuuuuuuaaagcauuguaagagacaauuaaaggaauugauuggauauuugaugauaccaaggaauuacuguuagguuuuuuuaggugaggcaauuggugguaucaaaaagggcccuuaucugccagcaacacagagugaaauacuuuuagagaggaacugauauagcuaagaucugcuucaaaauaaucaagaaguugggaggguagugguaggaaagaaacaagaucagacugcugaagcugggagauaaguacacugggguucauuaaacaauucugcuuuugaauauauuugaaacuuuccauaucagaaaacuuaaagaguaaucaaaguaaauaagcacuaacguaacucaggcaguaacauuucuggguuuacacauuugaagcagggugccaaagaguuuggcguggauuugagagcaagaaagauuuggaaguaaauuugagcucugucacuuuacuccacuauuuccugguugaaagagcaagcuaaugauaccuaccucacagguuuaagagucacacaagauaaugcccagugccuagcaccugguagguauucaauguucauuuuucccucucuuugcaaaucugaggaaggcucuguagcuagcuaaaauuaaaaugcuuguuugggcucuguuaaauuccagaccccauuccuacuuaagaagaaauuaccuauuaaccauacuugucuugguggugauuacugguuuguauuucaaucgaagugaaacaaaguaauaaucauuuaauuacuaucaaauagaaaaugcugcuauuagcaaaaugugucaccuuccaaaaaccuaaugaaauaaacucucuuuuuaauuugacacugugaguuacuuuaaaauagagagcaaacaauaaaauguuucuuuauucaaaaagagagaaagggaaauugaaagguaucuauacaggguugauuaaaaaguuaaacuguccauucagcuucccuuauuuuaaugguucuggugcguuaaaagagaacuacagaagagucaaauaucuuuaagaaagggaaggaaaguuaagaggacaguaucuauaagggcuaggugguuagcugacaucccuuuccauuuagaauuaaccuugaaauugaagccacccccaaaauaacucaaugccucuucuaccaacgaccuggaaccacacagcaaacucaagaagauaauuaaggcuuuucuguggauaacauuacuccuaauugguaucaauuccugaguccuagauacacagaugagaacuuaaaaagaaaaaaagaaaaaagaagugcuucaauuaggccauccacuaaaaggauuuaggugauagucuauuucagggguguccaaucuuuuggcuuccaugggccacauuaagagaagaacugucuugggccacauauaaaagacacuaacacuaacaaucacugaugagcuaaaaaauaaaauaaaaauugaaaaaaaaaucucacguuuugagaaaguuuaugaauuuguauugggccacauucaaagcuacccaggacugcagguuggacaagcuuaaucuauuugaugaaugugugaaacacuauuuuuaacaauuuauuauugacagaaauugccuugagauuguugcuaaggguauuccuauaaaauuuuaguuaaaaguagguucuagggccaggcgcaguggcucacaccuguaaucccagcacuuugggaggccaaggcaggcagaucacgaggucaggagauugagaccauccuggcuaacacagugaaaccccaucucuacuaacaaaaaaauagcgaggcugaggcaggagaauggcaugaacccgggaggcggagguugcagugagcagagauagcgccacugcagucuggcgugggcgagagcgagacuccgucucaaaaaaaaaaaaaauucgcaaggcaugguggugggcgccuauagucccagcuacucgggaggcugaggcaagagaauggcgugaacccgggaggcagagcuugcagugagccgagaucgcgccacugcacucuagccugggcgacagagugagacuccgccucauaaauaaaugaauaagugaaugaaugaaugaauguacguucuaggccaggcacagugguucccaccuguaaucccagcacuuugggaggaugagguagaauaaucacuuaaggaguucaagaccagccugggcaacaaagugagaaccugucucuauuauuuaaaacauaauaauaaaaaguggguucuaauggcucacaaaaaugcuggccuuuaauuauuagacuccacauauacaaucuguaacauuuggcacuauguuuguaaagaguaacugaauaugcacuccaaaauaugucacuuugacauacggauuauuuugagcugaaggcaacugagaagcagguacuauacaaaaaagcucucugcccuccccuuguuugccuaaaagcaggguauacauuuaccaagguguccccacuuccccuuuccaccaggaaguacaaagguugaucaagaaagacaacuuuaaacuuuugguggccuggcaacagcacaaaaggaaucuauauaacacuuuacuaacuaaccuuucucuaccauuuauuugccuuccuucaauuugccaccccucgagacucaagguccuuuuccuuugucacuucucuaaaaauguauuguuugguugaagaugcuacauaagccagauuucuaagccaccucuuugagauguacucauuuuccuugaguaucucccauguacaugaagugcauguguuaauaaacuucuauuugguuuuucucuuuuuaaccugucuuuuguuacagggguccacucagcuaagaacuaugaaggguagaggggaaacuuuuuucuuuugucccuacauuugcugcuaauucuuguauauacagccuucuuauauaauguucuuaagcaaccaugguguuuauuugccgcuucccagaauuuaagcaucauaauagugggcaaagagugacauuuauuacugcuuugaaauggacauaaaaaaaccacugguggccgggcacaguggcucacaccuauaaucucagaaauuugggagacugagguaggcggaucacuugaggucaggaguucaagaccagccuggccaacauggugaaacccugucgcugccaaaaauacaaaaaaaaucagccgagugugguggcacaguaggagaaucgcuuaaacccgggaggcagaggaugcagugagccaagauugugccacugcaugccagccuggugacagagugagacuuggccccccagccaaaaaaaaaaaaaaaaaaacacuaaaccacugguuaccccagcagcacacgaagguacuucuggcuuauuuaacaaacguguguauacugauuuuugaaaaugcaaguuacauucuaaacgcaauugucaagcuuucuaaaugaagauauucuaauaugaaucauuuuaucaagcaaauaaauuuuacuuacauuuuguauaacucuagacguucaaauuuggccugcuauaaguucgaguaauccagaaguguuaauauuacauaagaguuaauaaaaacuuuuaaaaaucacuuuccaugccagguacuauuuuagcguuuuacuuauuuuuaauccuccaagcaacacuauuaggaaaguacuauuauuuucuccauuacacagaugagaaacuaagaaguuaagcaauuugcaaaagggaguauuaauuacacccuaauauucuuuuuccuuucaaauguagcugaaagaacugacuggccaggaaauccagcaucuuauccuaguuuugucucugaucagcgaugaccagcuagcuaaauguacuccuguaucaaaugagggguucagccagaugccaucucaggucuugucuaccacuaaaaugcuaugccauuguaaaugcuauuuuccaucccuauuuacaaucccuuuaaccacugaauacaauuuucugaaaaauaaauauuuuaauaaauggaaguucaauuuaggggauucccauucauuugacaaauauauacugcaucaggcacuguccuaaaugcaaguauucuauuuugccaaaugauuuucagagaaagauuuacacauuaauuagguacuuuaacaguauggcacccucaguggagcaaaauucucacuuuauaggucaacagaaucugcuagaagagauauccgccaacccgcagcccaggacagcuuugaaugcagcccaauacaaauuuguaaacuuucuuaaaacaugaguuuuuuuuuuuaagcucaucagccaucauuaguguauauuauguguggcccaugacaauucuucuucuuccaauguggcccagggcagccaaaagauuggacaccccugcucuaaaaccaugcaguaacccuugaaggcagggacuguccuuaugugguauccccaaagccuaguauaacacccagcugaguaaaacacuuucuaagugucagaaccuaacuccaggacacuaggacacacacacugucugguaacauugagaaagcugcuucagucuaccagaaacauuccaagucuuaucacugggcugcuggcauuaacaccaaaaaauaauauuaauaaagcacuuaagagaagacagaaugguuagauccuaaacuaaaugauacuauccuaauuauccugcuuuccaucacaaagaaaaaagguuugcccaagaaaaugguccccacaauugcccaaguagcuugggguuauguuaauaaacuuucugggcugugacaaguuccaaaugacuaaaaaacagguacauaccuggugaguuugcuacugagucaaaaugacaauuagccaagacagcaugcugggcuccaucucuggguuccagcuuuaccacaacauuggugauguugucauaauagcuuguaaaaccucccaagaaaucaaugcuaaaagagccugugggccguuguacaucuacugaaaucuuaugaaggcuguugcuuugcacuucaaucaguuuaaucuguuccaaaagguagugcacggucagaauuucauuuucuggacuuccuguaguccuggggccaauggagguuauguguucaagauaaucccuggaaguaaccaaaagaauaacaaagguuuguaguuaaaauugacacuuagcguggguaacuuuuccacuacacaccccuuccuccccaaaaaagcuuaguucuuugccuuauauaaaagggaccgccuuucauuauuucagacaccaagugaacaucacuuauaaaguuccauauuuuuauuguugccucccacgaguugaccccuucaguuuucuccaccaucccacucccaacuucuccccauaucaaaccaauacaaggacuagggauguauucaaaacgugugaccacuggccaggcacgguggcucacgccuguaaucccaggacuuucggaggcugagguggguggauugcuugagcucaggaguuugagaccagccugggcaacauggugaaaccccaucucuucuaaaacuacaaaaacuagccagauguagacuacuauccgccuguagucccagcuacucaagaggcugaggugggaggacugcuugaaccugggagguggaggcuacagacccgagauggagccacugcacuccagccugggcgacagagccaggcccugucucagaaaacaaacaaaaaaagcuaaagacuaagcaggauagaauauaacuucacugugcauacuccugaacguuacagauucuggguuaaugacuuuaaguagcagaaaccaaugagcaaaaauaaucaagucaagagguuaaauaaggcgggcgggggaaacuuuugauggaccuagcccuccuagcauacacccaaggucuaauaacuucaauucaggccaaaaccaacuguaccccuaaugaaaacaaaacuguuuuugucuuuucacugcauuccaaguggggaaagcuggaagugggggugggagacguuucagaaaguccuuaauaagcuugcaacacuuugcauucuagcaaaaacuuuuuagaacacaguagcuguugaaaacuugacgccagcuuaacacuucaugagcuuugacacaccuggguuacaauaucuuugacuuaaucaccuuuccuagcauucuuaaaggucuuaaaaaaaaaaaaaaaagucaaaccuuacacagucacuaauccaaggggccuaaagauaaacugcagggaucugagaauuuaucagacugcauaccaaauuuugacugggcgguguuccagaaagaguuucuauagccuucagaugugggggcuguaacccucagaaaguuagaacagugcacuagcgccuuccaaaacuccccgcccccaaagcgaauuuauacaacagucuagguacacaaauuuccaucuggaaagcagaagggcuaagcaagguaaaaaggggaagcuguuccagaauauggggagacgacucacaaccaaccaucugcacgaagggcagacaguggaaagcagguucaaucuaccuggcaaccccaaucugcaccacgagcuuaaccggggacaggcaagccccaagucccggcaauucagaccccagaagaaggacaagcaaggucaccccaccccacgugcagccugggaggggucagcgagucccagcgguccggcaggggcgggugcacacaggugcggugccccggagccugcgcaggagccgcaaacggacgcgcgggccgugccaggagggagcggccgguaccuggcuuggagcgcgucgaacuccccgcgguguccagcggccccgcguagcacgagcugcugcagcgagagcugcaccagcguccgcagcgcgaucagguagagcgcgagccccagcgcggcgcgcaccucagacagcccgguccccgcgccccugcucgcgccgccgcuacccccggggcuccucuuccgcguccucccgccgccgcugcacccauccaccagaggcuccugcgcucgggccucccucuccggcgguggcgcggccgccgcucccucucgacgcucuacuccgacgcggugccgccucacagcagccgacucagaaccccacuccauggccacgagccucagcugccagcccaaccgccccaacccgcgacagccccggccgccgccgacgccgccgucgcugccgcagcg

SEQ ID NO: 18803 - RNA, 55458 nt, Homo sapiens
cgcugcggcagcgacggcggcgucggcggcggccggggcugucgcggguuggggcgguugggcuggcagcugaggcucguggccauggagugggguucugagucggcugcugugaggcggcaccgcgucggaguagagcgucgagagggagcggcggccgcgccaccgccggagagggaggcccgagcgcaggagccucugguggaugggugcagcggcggcgggaggacgcggaagaggagccccggggguagcggcggcgcgagcaggggcgcggggaccgggcugucugaggugcgcgccgcgcuggggcucgcgcucuaccugaucgcgcugcggacgcuggugcagcucucgcugcagcagcucgugcuacgcggggccgcuggacaccgcggggaguucgacgcgcuccaagccagguaccggccgcucccuccuggcacggcccgcgcguccguuugcggcuccugcgcaggcuccggggcaccgcaccugugugcacccgccccugccggaccgcugggacucgcugaccccucccaggcugcacgugggguggggugaccuugcuuguccuucuucuggggucugaauugccgggacuuggggcuugccuguccccgguuaagcucguggugcagauugggguugccagguagauugaaccugcuuuccacugucugcccuucgugcagaugguugguugugagucgucuccccauauucuggaacagcuuccccuuuuuaccuugcuuagcccuucugcuuuccagauggaaauuuguguaccuagacuguuguauaaauucgcuuugggggcggggaguuuuggaaggcgcuagugcacuguucuaacuuucugaggguuacagcccccacaucugaaggcuauagaaacucuuucuggaacaccgcccagucaaaauuugguaugcagucugauaaauucucagaucccugcaguuuaucuuuaggccccuuggauuagugacuguguaagguuugacuuuuuuuuuuuuuuuuaagaccuuuaagaaugcuaggaaaggugauuaagucaaagauauuguaacccaggugugucaaagcucaugaaguguuaagcuggcgucaaguuuucaacagcuacuguguucuaaaaaguuuuugcuagaaugcaaaguguugcaagcuuauuaaggacuuucugaaacgucucccacccccacuuccagcuuuccccacuuggaaugcagugaaaagacaaaaacaguuuuguuuucauuagggguacaguugguuuuggccugaauugaaguuauuagaccuuggguguaugcuaggagggcuagguccaucaaaaguuucccccgcccgccuuauuuaaccucuugacuugauuauuuuugcucauugguuucugcuacuuaaagucauuaacccagaaucuguaacguucaggaguaugcacagugaaguuauauucuauccugcuuagucuuuagcuuuuuuuguuuguuuucugagacagggccuggcucugucgcccaggcuggagugcaguggcuccaucucgggucuguagccuccaccucccagguucaagcaguccucccaccucagccucuugaguagcugggacuacaggcggauaguagucuacaucuggcuaguuuuuguaguuuuagaagagaugggguuucaccauguugcccaggcuggucucaaacuccugagcucaagcaauccacccaccucagccuccgaaaguccugggauuacaggcgugagccaccgugccuggccaguggucacacguuuugaauacaucccuaguccuuguauugguuugauauggggagaaguugggagugggaugguggagaaaacugaaggggucaacucgugggaggcaacaauaaaaauauggaacuuuauaagugauguucacuuggugucugaaauaaugaaaggcggucccuuuuauauaaggcaaagaacuaagcuuuuuuggggaggaagggguguguaguggaaaaguuacccacgcuaagugucaauuuuaacuacaaaccuuuguuauucuuuugguuacuuccagggauuaucuugaacacauaaccuccauuggccccaggacuacaggaaguccagaaaaugaaauucugaccgugcacuaccuuuuggaacagauuaaacugauugaagugcaaagcaacagccuucauaagauuucaguagauguacaacggcccacaggcucuuuuagcauugauuucuugggagguuuuacaagcuauuaugacaacaucaccaauguugugguaaagcuggaacccagagauggagcccagcaugcugucuuggcuaauugucauuuugacucaguagcaaacucaccagguauguaccuguuuuuuagucauuuggaacuugucacagcccagaaaguuuauuaacauaaccccaagcuacuugggcaauuguggggaccauuuucuugggcaaaccuuuuuucuuugugauggaaagcaggauaauuaggauaguaucauuuaguuuaggaucuaaccauucugucuucucuuaagugcuuuauuaauauuauuuuuugguguuaaugccagcagcccagugauaagacuuggaauguuucugguagacugaagcagcuuucucaauguuaccagacaguguguguguccuaguguccuggaguuagguucugacacuuagaaaguguuuuacucagcuggguguuauacuaggcuuuggggauaccacauaaggacagucccugccuucaaggguuacugcaugguuuuagagcagggguguccaaucuuuuggcugcccugggccacauuggaagaagaagaauugucaugggccacacauaauauacacuaaugauggcugaugagcuuaaaaaaaaaaacucauguuuuaagaaaguuuacaaauuuguauugggcugcauucaaagcuguccugggcugcggguuggcggauaucucuucuagcagauucuguugaccuauaaagugagaauuuugcuccacugagggugccauacuguuaaaguaccuaauuaauguguaaaucuuucucugaaaaucauuuggcaaaauagaauacuugcauuuaggacagugccugaugcaguauauauuugucaaaugaaugggaauccccuaaauugaacuuccauuuauuaaaauauuuauuuuucagaaaauuguauucagugguuaaagggauuguaaauagggauggaaaauagcauuuacaauggcauagcauuuuagugguagacaagaccugagauggcaucuggcugaaccccucauuugauacaggaguacauuuagcuagcuggucaucgcugaucagagacaaaacuaggauaagaugcuggauuuccuggccagucaguucuuucagcuacauuugaaaggaaaaagaauauuaggguguaauuaauacucccuuuugcaaauugcuuaacuucuuaguuucucaucuguguaauggagaaaauaauaguacuuuccuaauaguguugcuuggaggauuaaaaauaaguaaaacgcuaaaauaguaccuggcauggaaagugauuuuuaaaaguuuuuauuaacucuuauguaauauuaacacuucuggauuacucgaacuuauagcaggccaaauuugaacgucuagaguuauacaaaauguaaguaaaauuuauuugcuugauaaaaugauucauauuagaauaucuucauuuagaaagcuugacaauugcguuuagaauguaacuugcauuuucaaaaaucaguauacacacguuuguuaaauaagccagaaguaccuucgugugcugcugggguaaccagugguuuaguguuuuuuuuuuuuuuuuuuuggcuggggggccaagucucacucugucaccaggcuggcaugcaguggcacaaucuuggcucacugcauccucugccucccggguuuaagcgauucuccuacugugccaccacacucggcugauuuuuuuuguauuuuuggcagcgacaggguuucaccauguuggccaggcuggucuugaacuccugaccucaagugauccgccuaccucagucucccaaauuucugagauuauaggugugagccacugugcccggccaccagugguuuuuuuauguccauuucaaagcaguaauaaaugucacucuuugcccacuauuaugaugcuuaaauucugggaagcggcaaauaaacaccaugguugcuuaagaacauuauauaagaaggcuguauauacaagaauuagcagcaaauguagggacaaaagaaaaaaguuuccccucuacccuucauaguucuuagcugaguggaccccuguaacaaaagacagguuaaaaagagaaaaaccaaauagaaguuuauuaacacaugcacuucauguacaugggagauacucaaggaaaaugaguacaucucaaagagguggcuuagaaaucuggcuuauguagcaucuucaaccaaacaauacauuuuuagagaagugacaaaggaaaaggaccuugagucucgagggguggcaaauugaaggaaggcaaauaaaugguagagaaagguuaguuaguaaaguguuauauagauuccuuuugugcuguugccaggccaccaaaaguuuaaaguugucuuucuugaucaaccuuuguacuuccugguggaaaggggaaguggggacaccuugguaaauguauacccugcuuuuaggcaaacaaggggagggcagagagcuuuuuuguauaguaccugcuucucaguugccuucagcucaaaauaauccguaugucaaagugacauauuuuggagugcauauucaguuacucuuuacaaacauagugccaaauguuacagauuguauauguggagucuaauaauuaaaggccagcauuuuugugagccauuagaacccacuuuuuauuauuauguuuuaaauaauagagacagguucucacuuuguugcccaggcuggucuugaacuccuuaagugauuauucuaccucauccucccaaagugcugggauuacaggugggaaccacugugccuggccuagaacguacauucauucauucauucacuuauucauuuauuuaugaggcggagucucacucugucgcccaggcuagagugcaguggcgcgaucucggcucacugcaagcucugccucccggguucacgccauucucuugccucagccucccgaguagcugggacuauaggcgcccaccaccaugccuugcgaauuuuuuuuuuuuuugagacggagucucgcucucgcccacgccagacugcaguggcgcuaucucugcucacugcaaccuccgccucccggguucaugccauucuccugccucagccucgcuauuuuuuuguuaguagagaugggguuucacuguguuagccaggauggucucaaucuccugaccucgugaucugccugccuuggccucccaaagugcugggauuacaggugugagccacugcgccuggcccuagaaccuacuuuuaacuaaaauuuuauaggaauacccuuagcaacaaucucaaggcaauuucugucaauaauaaauuguuaaaaauaguguuucacacauucaucaaauagauuaagcuuguccaaccugcaguccuggguagcuuugaauguggcccaauacaaauucauaaacuuucucaaaacgugagauuuuuuuuucaauuuuuauuuuauuuuuuagcucaucagugauuguuaguguuagugucuuuuauauguggcccaagacaguucuucucuuaauguggcccauggaagccaaaagauuggacaccccugaaauagacuaucaccuaaauccuuuuaguggauggccuaauugaagcacuucuuuuuucuuuuuuucuuuuuaaguucucaucuguguaucuaggacucaggaauugauaccaauuaggaguaauguuauccacagaaaagccuuaauuaucuucuugaguuugcugugugguuccaggucguugguagaagaggcauugaguuauuuuggggguggcuucaauuucaagguuaauucuaaauggaaagggaugucagcuaaccaccuagcccuuauagauacuguccucuuaacuuuccuucccuuucuuaaagauauuugacucuucuguaguucucuuuuaacgcaccagaaccauuaaaauaagggaagcugaauggacaguuuaacuuuuuaaucaacccuguauagauaccuuucaauuucccuuucucucuuuuugaauaaagaaacauuuuauuguuugcucucuauuuuaaaguaacucacagugucaaauuaaaaagagaguuuauuucauuagguuuuuggaaggugacacauuuugcuaauagcagcauuuucuauuugauaguaauuaaaugauuauuacuuuguuucacuucgauugaaauacaaaccaguaaucaccaccaagacaaguaugguuaauagguaauuucuucuuaaguaggaauggggucuggaauuuaacagagcccaaacaagcauuuuaauuuuagcuagcuacagagccuuccucagauuugcaaagagagggaaaaaugaacauugaauaccuaccaggugcuaggcacugggcauuaucuugugugacucuuaaaccugugagguagguaucauuagcuugcucuuucaaccaggaaauaguggaguaaagugacagagcucaaauuuacuuccaaaucuuucuugcucucaaauccacgccaaacucuuuggcacccugcuucaaauguguaaacccagaaauguuacugccugaguuacguuagugcuuauuuacuuugauuacucuuuaaguuuucugauauggaaaguuucaaauauauucaaaagcagaauuguuuaaugaaccccaguguacuuaucucccagcuucagcagucugaucuuguuucuuuccuaccacuacccucccaacuucuugauuauuuugaagcagaucuuagcuauaucaguuccucucuaaaaguauuucacucuguguugcuggcagauaagggcccuuuuugauaccaccaauugccucaccuaaaaaaaccuaacaguaauuccuugguaucaucaaauauccaaucaauuccuuuaauugucucuuacaaugcuuuaaaaaagcaagacaguuaagucaucuuuauaguuacuuuuaauuaacauacaaaauuucugaaucaagaagagguucagagauucaacugaguguguguucugggaccuaggauacuacuuaggucauuagucuccuuuccugugacuuacuagauuagguaucuucuuuuuaguuuuccaucacauaauccccuuggagaagccuuaaaggaauguuacaccauccaaagugaccucucugugcagcuuuuaugauuuuggcaggaaaacaagcaagaaaggagugggugcagugggagaugaugcaggaagcugugagcaccagaagugagacuauuacagaggauguggaauacggguaaagaauagaacagauugccuugguuugcugagaauaccaguuuccaguaugacuuuagguccccucagguuacuucauuuagcagacacuaauugagugacucuggugggucaggcaugguaguaggcauugagaguaagucagugagcaaaccagacaaagaucccuucauggaacuuacugcuggugggugugauugucaccugaugaugacagagcuaugcuucuggucaugcagcuauugugaugcuucucugaggagaaagcuccauuccuaguccuaaugggucauauuguaaacauuuuaaaaucugagcagcaaauuuguuuuucugauuugaaggugccagugaugaugcaguuagcugcucagugaugcuggaaguccuucgcgucuugucaacaucuucagaagccuugcaucaugcugucauauuucucuuuaauggugcugaggaaaaugucuugcaagugagauuuuacuguuuuaaauaucaggcuugaauaaggaugagauuaauaauaauagcuaaauauuauuuacuaaauaguaaaugcauuuuuuaugacuccuguggguaguauaaaauaauaugcagaaaaauacuuuaugagcaguacuuuaacaaauucacaaccacuuauguagagauguuuaauauuuggaaaacuccacuuagcagauuauuguggcaggauuugauugagagaagggcucucgcuggcauaauuacucuccucagguuuucuuugacauugaaguuucagagauguuuugagacaggcacaaauaaaugcccagccauauggaucgucucuucuccuguucucuuuuuuuucuuucuuuuuaaaaagagaagggggccaggcacgcuggcucaugccuauaaucccagcacuuugggaggccgaggcaggcagaucacgaggucaggaguuugagaccagccuggccaacauggugaaaccccgucucuacuaaaauuacaaaaauuagccaggcgugguggugggugccuguaaucccagcuauucgggagguugaggcaggagaaucguuugaaccuggaacguggagauugcggugauccgagaucgagccauugcacuccagccugggccacaggcucuguuucaaaaaugagcaaacaaaaaaagagggagucucgcuauguugcccaggcuggucucgaacuccugagcucgggugaucuucccaccauggccucccaaaguuuugggauuacaggugugagccaccgugccuggcccucuuugccuuuucuuuugcacagccuuguacuuaccagggauguuguuuggcaccgcugauggucaccaggcugccuucugugauaggugacuuuccgaaccugaugugcauggccauuaugcauaggaaaagaagcagaagaugucuuuggauacugccuuugaagagcgauuauuuuguuuucauauuccuuaccucaucaaaguagucucucuguguuuaagcaaaaucaagacugauaauuuaagauuguuuaacaaauauuuguuuucuuuccuucucuuuaaggccagucaugguuucauuacucagcaccccugggcuagcuugauucgugcauucauuaaccuagaggcagcagguguaggagggaaagaacuuguauuccaaacagguaugugagauugugcguuguauauuuuaaugcaauucuaguuuuuguaaaaguagaaaguuuuugauuauaaauaauaucuucaauaaacagucucuugaaugagcauucuuuuuaaagcaugaggugguguuagcuugucuuuguuaaaaauuuugaaccaaauaaugcagcaucuaacacuuguauagugcuuauuauaugccaaguguuguucaaaccauuucauauauauuaagucauugaauccuccaaacaacauguaagauaaguacuguuacuuccauuuuagagaugaaacugaguccagagagauuauaacuugccuaagguuucacaguuguuuaauggcagagugugauuugaaccuagacaguccggguccagaaacuuuguucuuaaccucuaauuggauuguuauauagguagugaacuuuuagccacugugggugguuaugauauaaauauuguuaaaugucaaucauuucaugaguuaaaaugagaaaauuuaccuguaguguauguaacagguuuaaauuuaucauugauuuaguggaauguuaaaaaaauuuaguaauauuuaaucagccagaauaauuuuuauuuuauuguuuuuuuagagacagagccaugcucugucacccaggcucgagugcacuggugccaucaugcagccuugaccuccuggguucaagugguucuccugucucaguuuccugaguugcugggacugcaggugcuugcuaucacgccuggcuauuuaaaaauuuuuuuguagagacaggcucccauuauguuucccaggcuggucucaaacuccugggcucaagugguccuccugccuuggccucccaaagugcugggauuacaagcaugaaccaccaugccuggcccagagaaauaguuuuaguuuuaugauuaaacuuuucuaaggauaucaacuuagccuauuuaugccuaguguuccauuauuggaacgcuaagcaugugggaguuauuuauauccuacugcucaagccucaucgccaaggucugauuuuucacacaugcaaaaauuaaaaaaauugcaaccucaggcauaaauggguuuuaauugucuuuauuaacaaaauucagagcucauagauuuuuuuagugggggcauacuaaaauuugacauuggaaguuccauuccauuucccugcccuguuagaaauuuggguaaugcauuuuauccagagauguagcauuugcuagauguuuuaauauucaagaguguguugugugcugagaugggcuaggugaaguaagaugaugugggaacuuguuuuguagcacccucuuaagaccugauuuuauuuaaauuaugaaacuaugcuaaguaugucuucauaaccuaaacaauacuauauuuuaauagucuccaucaaacuuauuuuaaucuuuuaucuuucaaaauguauguauauuuuacuuuagcuaagcguuugagauucucaaggucaugaugucagaagcagcaagguucuguuuucaauucucaaaccuuucugcuuuauucuuacucuaacuaaugagaagaagcugggaucuaauaucuacaagagugaguagauacauuauuauagagauauaucuauaucuauauauuuauuuauuuauuuugaagcagggucucacuccguugcccaggcuggaguguagugguaugaucucggcucacugcaaccucugccuugagagcucaagacauccucccagcucagcuucccaaguagcugggacuacaggcauauaccaccaugcccggcuaauuuccuuuuuuuguagagaugggguuuggccauguugcccaggcuggucucaaacuccugagcucaagcaguccuccugcuucagccucccaaagagcugggauuacaggcacgagccaccacgcccggccucuuucuauuucuuggaugucaguuaggauaggaggaacacauacauguaacaaccaccagaucaaaaagcagcaaaagaaaauucugaaggagagaggacacucagucuucuuuccuauugugaaaaaugucagggcuccauguaagcaggagugugucuguguauuuuccauguugaaguauacuauguguuaagugccuucaucuccaugcuuuuaauuuauuagcacagcaccuugccccuauacugcuccuauccagagaaaaaccagccuuaugguuuaaucugcacccuuucuagauuuuuuucuauguacauauauauuaaugcauaaguauuuuauguacguauguuaacauauuuuacauauguguaguccggagagguuaaaacacuuaccaagggcuagucagguccagacugacuaacauuacuuauuuacauuuauuaaguacucauuuuugguaggccugggcagcccagaguccuuacucuuuuuauuaaaugcauaugguuuuagacaaaaauucugcagcugcauaaauucuaaaaauaauuacauuaucugaaaggguguaaacaaacuguuaauaaugcuccuagcuggauggugagcaguugcugguagaacugggcugugugugacuggaauggaggacuagguuaaagguaaaacaacaguuuaaauucucuguugcuucaugaauuuaagaccagaauugauugucauuaaugcacuacuuucuauaauuuuauguauuuaaauuuuugcaauguauaugaucacuuuaauaauaaagcaaaaaacagauuuaugacugguuaguauaaacauaaaauuuaaauguuuuacuuguucugaaauccccauguuucaaaauuaauuuuuuuggaggggugucauacaaaagauuugaagagauuauuucccuccuuacucugaaauuuuacaugauuuuuucucccucuagguuuuggagcucauuauuuuggcuaaacuccauaccugaaagcuuucugggugcuuucugacauucugauaccuuucccagcaucucugucacuuuuaaugccacugccuacaaaagacugcgcuucuugugggcauggcuuucaaaaagcuaguuaguguuauuuucauguuugacuaaaagaggauaaaggcccuccuggguuuggaguugugcuugagaguauaugccagauugugcuguccucagcuuuuuaaaccauacuccuuuuucugugugauaauauuuguccugcccuggaaacuuuuugguuaaacaguuugugcucuggaacucccuugucacuucugagagcgacauucauuuggggaguuuuuagugacuagaauaaucauuacuaccuaauuuuuaagaagggccagaaagaaugacuugauuuuaucagaccagugaccucauuucaugagugagagaggcuugauagcaaaagggucacagaaucuuuuuuccucuugggaaaauauucaugccccuguaauucuaccauccagagcaaacuaguguaauaguuuagucuauacucuucuagaauuuuuuucuaaaugcaaacauuaauauacauuuauauauguguauauauauuucuuggcaaaaauagaaucauauucugucugcuacuuuauagccaccuuuucuuuuugagguggagucucgcucugucgcuuagaguggagugcagugacgcgaucucagcucacugcacccucugccuccuggguucaagcgauucucuugccucagccugccauguagcugggauuacaggugugugacaccaugccuggcuaauuuuuguauuuuuaguggagacgggguuucaccauguuggccaggcuggucucgaacuccugagcucaggugaucggcccacucaguuucccaaagugcugggauuacaggugugacccaccacgcccggccuguagccuucuuuagaaugaauucuuuuuuuuaaaguuacagcuuuauugagauauauaauucuuaguugugcaaucaucaucauaaucaauuuuagaauguuuuuaucaucccaaauaggaaacucauuagcagucacucccauuuucccccaucccuaggcaacugccugucuacuuugugucucuauagauuuuccugcuguagacauuucauauaaauguaaucauacaacacgugauuguuugcguuuggguuuuuuuacuuaguguaauguauuucagauuguuaaucuaaauaacagagggagacucucaaagaagaugguauuuaguaauggguguugcaguaggaauacaugugccauaguaaacugugaaacuaugugccauaguaaaccagggcaguaaaggaagacaaaaguuuuuauaggaaaaaugaagaggauuacauaauuuuuuagggauaauuauccuuggcuacaaggaucaauaacaaggguggcaccagucugagauuggacaggcaguugcugggcugauguccuugcugaaguuuuuuguuugauaugagguugcaauggccuuuaugcaagguugugguuuuugaagagucuuuugugauaauucuuguuaucaggcauuugugcaugagaacccucccuucauggccuucccuggcuccguuaucggaguuuuuaacgcaagugagucuguuuugauucugacagcuuucacaagguucauccacauugucgcauguauuaguacuucauuuuuuuuuaauggcugacuaacccauuguauggauguauuauguuucguuuauccauucauccaucgauggauauuuggauuguuuccacuuuuagacuuuuaugauaaugcuggaguaaacauucauguguaagucuuuguguaaacguauauuuucauuucuuuuagauaccuaggaauggaauuccugggauguauaguaaauuuaugcauagcuuuuuaagaaacugccaaauuaaacaguuuuauuugagaauaaaugcaaauacauauaacaguaaggauuuuuaaaauacuugaucagcaaaaaguuaguaaaaugauaaugcccagugcugaugaguauaagcagucauuuucauacacuguuagugagaauguagaugugcauuuuggcaacauguauuacuuuuuuaaaugugcaggcucuucaguucagcagacccauuucugggaauuuaaccugcagaaauaguugacauaaaucuaagucaucuuggguuuucuuuucuuuucuuuuuuuuuuuuugagauaggaucuugcuuuguugcccaggcuggaaugugguggagcagucauggcucacugguuuccagcuccugggcucaagugaucugccugcuucagccuccugaguagcugggaugacaggcacgugccaccaugcccagccaguuuuuuacuuuuuguagagacagggucucacuguguugcccaggcuggucucaaacuucuggacuuaagcagucuuccuuccuuggccucccaaagugcugggauuaaaggcaugaggcaucauguccagucuugguuuucucuuaagaguagaaaauuggaaauaccuuuaguguaugaguaggagacuggucaugauaauuuuuuucuuucuuccaucauuaauuuuucucucucuauaggaucauuuccauuugcaugcagacauaccuuuuccuccauuuuaaagaaaaccacuuuuaucacaaccugcuagcuagucuuauuccucugacccucuacugcagaauuccucaaaagaauggucuguagucauagucuugaauaacugcuuuuuuuuuuuuuugagauaggaucuugcuuugucaucuaggcuggaaugcagugaugcaaucauggcucacaguucuccagcuccugggcucaagugauccaccuugauauaccgagauccaccaaaaucgauagauccaccaugugaucuauucuugaacaauucuagucagcuuuagccuccccacuucaccacgacuauucuuguaaaggucacauuggcaaauucagucaguuuucaggccucauguuacuuggcuuccaucauaauauuuaccacucuuagucucuuuuauuaguuccuccuuuuuuuuuuuccuuuuguguauugaugccguaacuagagauugaaggaaguaaagcaguggaaggaugcugugggucugcugagcugggucuguuuucccuggacuucuagagaacuuugacuuacuauucuuggcacugaggccuaccuccucugaacguuacgcaugcccauacucuuugcauuaagaaagaugaggcucauucuugagaaaugaacacacaagaagcuggaagcaucauaggauuuagaugauggcaggagaaagaaugucaauugaaaauguuucuguaucugccugccaccuuacucuguaagauaacuaaaagguuuugcguggagguaggauaggguacugauuaagagcauaggcucuggccgggugugguggcuuacgccuguaaucccagcacuuugggaggccaaggcgggcggaucaccugaggucaggaguucgagaccagccuggccaacauugugaaacccugucucuacuaaaaguacaaaaauuagccaggcaugguggcgggcgcuuguaaucccagcuacuugggaggcugaggcaggagaaucgcuugaacccgggaggcagaggucacagugagccgagaucaugccauugcauuccagccuggacgacagagcgagagacucugucucaaaaaaaaggcugggcacgguggcucaugccuguaaucccagcacuuugggaggccgaggcaggcggaucacgaggucaggagaucgagaccuuccuggauaacauggugaaaccccaucucuacuaaaaauacaaaaaauuacccgggcauauuggcaggcgccuguagucccagcuacuugggaggcugaggcaggagaauggugugaacccgggaggcagagcuugcagugagccaagauugaggugcuguacuccagccugggagacagagcgagacucugucaccaaaaaaaaaaaaaaaaagcauaggcucuguaguuagaugaucuaaggucaaaccucaaaacuuuagcuauagcacauucuacacguggaaccuuggacaggucaugugaccacuccgagcuucacuuccucaucuguaguucauucuuuuuucuugccgaacacuagucaauucuacaacaauugauccauuccguuggugcuguuauguuguuuccagguuuuugcuaugaauggugcugcugugaacauucucguaaaugucuuuugguacacauguauguguaugcacauuucugaguggaaucgcugggucauaagauguguauauguucagcuuugguagauauuuuggguagguaauaccaacuuuagaugcaaaaguccuaaauuaaguauuagcaaacugaauccaggaauauuuauauauacaaaagauaauacuuuccaaccaaguugaucaacaggaugguauaauauuugaaaaucaaucuguguaauucacuacauuaucagaauaaagagaaaaaucaugucaauugauaaucucaggaugaucaucucagauaaacagggacaugcucuucuguaacagaacauugaucacacucaagaaauauuaauauuaaacuauaauaaugcauauucagauuuuuccaguuguuccauuaauguccuaaccauuuaaaaaaaaaucuggguuccuacccaggaucaaauauagcauuuaauuauaaaguugaaaacuuaauuauuguaaggugaaaaucuuuuuaacucugucucauggaagaggguggauugccuugccugccuaggcauuuuuuuuaaccucucuucucaaauacaacucccucccaucuaagaggaacuauuauccuaaguuuuaagauaauuaaugauaguuuggcuuuaccuguuuuucaguaugguuuucauuguauuuuuuagcauaaauuucuuaauaucaaauaguaauauuuuaauaauaguauuuuaauaugauaagaucucguaauguacguauuuccccaucaucauaguucuuuuuccuuuuguauuuguguccucagugcaucacaucaggaugcaugugguaucuguuugucucauuauuaaugauacuacauuuucaucguuugauuaagguauuuauuugccagguuuuucuacuauuucuuucuuuguacaaguuacugauuuccccuuagugauagauacuuuagguaaauauccuguuugucauaaaacuuugauccuaguuuuagcaaucauugaugacucuuguccccaagcauuuuuauuacaauguuuaccaaaugcuacugcugaguuucugguuccaucauucugccuguaggucauaguuggaauucugcaagaaggaaggcuuuccauuuuccuuuuuuuuuuuuuuuuuuuguuauuucaguacuuuauguauuuuaauuuuacucuauauauucuguuacuauuguuuauuuuguugcaugaauugucccaguuuaggccaguggugucuauuucaaaucagugccugagccccuuugacaugucuuuuugaucacuuucuuacuuucuggcacagauguuucaacuuaccuuguacuuugcuagucccagaccuggaaucagccauuucucuaaggaggcuugguuucuuuugguggggaauaguauucaaaaguaaauggugccagauacaguuuuucuuuauauuuaucuuguuugggguuuguagaccuuuuugaauucguggcuugaauucuaugaguuuuggaagauucuuggccauuaagucuuuaaacauuuaucuucuccauucuaucuucuguucuuuugggacuccaauuacucacauuuguguauuuuccaaccuuuuuuucuuuuuaugcuuuaauuuuaauccuuucuucugcuguauuaaacuuuguguuaagcccauuuauuaaaauucgcaacaucaguuauguuuuuucauucuaggauuuccauuuguaggacucuuuuaaauagauuauacuugucuggugaaauuacugauaucuguguuuuuuaaaacauauuaaucauaauuauuuuagaaucugugucugguaacuccaguaucuggauuacuuguaugucuguuucuauagggucccucugcuuuuuugggucauuuuuaauuuuuaauuuuuauuuuuucagauggagucucacucugucacccaggcuggagugcaguggcacaaucuuggcucagugcagccuucaccucacaggucuaagcaauucuccugccucagccuccugagcagcugggauuaccaugcccugcuuauuuuuguauuuuuaguagaggugggguuuugccauguuggccaggcuggucuuaaaugccugaccucaggugcucugcccaccucggccuccuaaagugcugggauuauaugcgugagccacugcacccagccuuggucauuuuuuaaaauguaggaaagcaauuuuauaaucugugaaguuaaaaaaacaauauucuuagauucccugacauucaguuacuuggucuguuuacaucagucaauauguugcuaaguuuugugguaacaaccccaaaaucuuggugguuuacaacagcaaaggcuuauuucuugcucguguugcauuuugguuucugaauaacugcaguuaugguccacgguuauuauguuccaugugucuuauucauucugggauccaggcugaaggagaagccccuauaagggauguauugaucucacaaaucaaaguuaaggauaaguaugaaugauguuaaugccuuugaaaacucugcccaguugagggucaugucauuccuccucacagucuguuggcuagagcaagucauguagccacgccugcaguuaauagguacagaagaguauguacucauuccccaggcaggcauuacaagguauguggcaagaguaggaauguauaauccuuuuucagcgagggaagagugaauaauuauacaauuauacauauaauuauauaauuauaauuauauaaauauacguauaauuauauaauuauauaaauuauaaaacaauguaucccacuauccuacaggaaaaacucccauuugaaaaagcuguagauguaugagauacagauggaaaauuauuaauaaugauaaauuauaaaaaguaacaaggaacuuuauggcauauucagugaaauguuaagcaguuaucaaaaugauuauuauaauacagauugagcaucccuaaucugaaaauuugaaauccauaaugcuccacaauucacaacuuuuugagcacugacaugaugcucaaaaauguucauuggagcauuucugauuuuggauuuuaggauuagggaugcuuacuaguauaaugcagauauuccaaaauccgaaaaaguaaaaaauccaaaauacuucugaucccaagcauuucagauaagguauacccaauuuguaucuagcaacauaggaaaaugcauuuaauauaauguuaagugaaaacaaauguacaaaguauauauaucuugaguacagcuauauacacacaauucuacauuaguaagaaaauuaaagauauacaauugauaauaggcauuuuaggaugauagauuuaugaaugaucuuucauuuucagacagacuuuuguauugcuguuauuuuauacuuuauuuucacaaaagguuuuuauucuaaaagucaaacacauauaucagagaaacauuggaaacuacagaaaaagggaugaaaagguacauauuggacccgucucccaaaaccaccacuuuuacuguuuucuauguguugaaaaacauuaguauguuaaaaaaaauugccggaauaccuucuauuguguugucaucuuucauuuuagguccugaaaauccuugguugguucaagcuuauguuucagcagcuaaacacccuuuugcuucugugguggcucaggagguuuuucagaguggaaucauuccuucagauacugacuuucguaucuacagggauuuugggaacauuccagguauauugucaaugguuacggccuacugugcagcauuuauuuaucaaaagcaaauuuuaaaucuugaaaguaugugaguaaacagcauuuucugagaucaaauucuuuaugugagaaauauacauugacucacuaaaacagaguuuguuuccuuuuuuaaacuccauacuaauuuaaaugcuggccuccucuaaaauaugucaucuuuccccauagaagaacaggggugaacuguuuagcaccucauucccaaaagaugguaauagauccuucaggggucuuucguuguugucuugguuugccaacucccuuggcaacuuguauguacaacuuauuugaaguuaaaauuuggcucuggccuggcaagaauguagguggcaaaauuuucaugaccucccaaacucaauauuccuauccuugcugugugacuuguaaugccuaccuguggaguaauauacuucuucaaucauuauguaucgaauuauguaccaaagcuauagacuguguaagaauuuggaagagaauuuauaucagucguuuguaaaugugacaaagcaaucgugccacugcuuugacauuuugucuuuuaggaauuuauuaaagaaauaggucgaaagcaagguugaucuuuaaagcaaaaugacuuuuuuuuuucuauauauauguuuuaggaauagacuuagcuuuuauugagaauggauacauuuaucacaccaaguaugacacagcggacagaauucuaacagauuccauucagagagcagguugguauuccaauuuagacuuuugauauacacuaagauggaauguuagggaugauacauaaacuuguaaauauucuguggccugugcauuagagaggcaguaugcaaugugaaugagcuagggcuuuggaguuggagagaugagaucuugaauuuuagucuuguagucuaguguagcaauuaaggucaggaauauucauugugaggaaaugaaaaaggaguuggcccaggguugggaggauugcugagugguaagaauguagcucuguuagucucccaugauguuuuccuguggaacucugcuagcucuccucaauuuuuaacacaugugugacagcuuguucagcaucucugagcuucgugaaaggccuuugucucuugguucaccacuaaauuucugauaucuagaagagugucuaguacaguuaauauauauuauuaaaugaauggguaccaagaaacagccauuggauuugucaacaaugaagguacaauugaucacagagaauaguucuaauagaagggaaaagauacaggccaguuggcugagcgucugaguggagaggaaauggagaaaggcaggggauggaccuuauuugagaaauuuaguaaaaaaagugagggagagcaguaggaugguagaaagcgauuucuguucacauucuuucuaaccauuucuucauucaaacaguauaugguuuauuucugcuuuaaauagugguauguguaaaucacaaauaguuuauucagccuuuuuaucuuuuuccuuuucuuucuuuuuuuuuuuguuuuuacuaauaggugacaacauuuuagcaguucuuaagcaucuagcuacaucugauaugcuggcugcugcuucuaaguaucgacauggaaacauggucuucuuugaugugcugggccuguuugucauugccuaccccucucguauuggcucaaucauaaacuacauggugguaauggguguuguuuuguaccugggcaaaaaauuuuugcagcccaaacauaagaguaaguauuuuccucuaaaacuacaaauacuggcauugcuguagaaugugcuugaaguuuuucagucaguuuguuuauaucuucccagaaagcuaaaaaucuuaagacaauguuugcuuuauauuguaagaaauuuuuaaauauuaaauuaauaugcuuauuuuacuuuuagucuuggugaagcagucaauuuuuauauauuuaggcacuccauaaaaguaccacauagaaacuauugaaaaaugguuuguacagauugacuucuaaugaaaagucccauuaaaaaguccacacuacagaccaauagcuaguauggaccagugucacgaaguaugaaugaacugcuugugguuaaacuguuucuuuuauuugaaauauuucugcuugaaauguuucagagucuaaguuguugugugcuguuacgagauaaaauauuuagcagcaguuuaaauaauucuuuaucaacgcuuauuuuccccacacuccuuaucuucuuauguuaccuuauuuuaacaacauuuuauauggaacuuugccuuccauucuugcuaauauuuugauacacaaagcauaccaaaagugaagaagauuaagacuauccucuuccuucauaaggaauguaccugaacuauuccuagaagauuuaucuuuuugaguguuuaguaucuagagacucuuaauaaauguuaccugaauauuauuauuugauaccucccuuguucuuguguuuggccaaucucaacacuaggacauuuucauacuuuucaaguacaguggggaguuuuuuguuuuaauguuugcccauuuagcucuacugacugguuauauaacugauuugaugaagauggugauuucaacuuuuuguuuucucuucauuagcugguaacuacaagaaggacuucuuguguggacuuggcaucacuuugaucagcugguucacuagccuuguuaccguucucauuauagcaguguucaucucucuuauuggacagucucucucaugguauaaccacuucuaugucuccguuugucuguauggaacugcaacuguagccaaaauaauacuuauacauacucuugcgaaaagauuuuauuacaugguaaguguuugguauauuuguugauuucuuucuguugccuccagggacugaagaugaacuuaagugugauucauuguauuuggccuuuugagugcuaaaaaauuguucagcaugguuauggaaaacgcaccuacacuguguuaauuuucugaaagauuucuuauucugaggguaaugucacaaaauucaaaugagguuauaaagccgggcuguuaacaguguuagggugguggugacuggaaggcuuguuagcacagccuucuacugaauuugcugcaguguuuguaaauauguccugggcucacccacuuauuuauguuauuugaauaucuguucuccauuggaguguaagcuccuugaggauagggauuguuuuauuuauuucuguauccucugugcuuagguagugucugacacacagcauuaacacacagcaaguauuuguugccuaaaagaauguuguacuuaaaguuuuuucaguuuuucccucacuguuuuuucuuuuuaacuguauauuguugauucagauucugcaugcauguaugucauuggaguuaaaagacacauugcuaaggaaaacagagggaagggaaauaggguuccaaaugauuuauacugagaauauuguuauauuauuaugguuucaaaugcauaaauuuguuuggcaaaaauaaaauuagaaauuagggcuggccgggcgcgguggcucacgccuguaaucccagcacuuugggaggcugaggugggcggaucacaaggucaggagaucgagaccauccuggcuaacacggugaaaccccgucucuacuaaaaauacaaaaaauuagccgggcgagguggcggcgccuguagucccagcugcucgggaggcugaggcaggagaauggcgugaacccgggaggcggagccugcagugagcugagauugagccacugcacuccagcuggggcgacagcgagauucugucucaaaaaaaagaaauuagggcuaugggcugggugcuguggcucaugccuguaaucccaacacuuugggaggcugggcaggcggaucgcuuuagccugggcaacauggugaaacccugucuccacaaaaaauacaaaaaauuagccaggcaugguggugugugccuguagucccagcuaccuggguggcugagguaggaggauuaccugagcccaugagaucaaggcugcagugagcugugauuguaccacugcacuccagccuaggggacagagugagacccuaucucaaacaaacaaacaaacaaaaauuuaaaaagcuguaaaauaauaggucuaaaaaugaauuacagugaagagucaugguuucagauuguuuaugugaauuaaagaggaagaucuuucuuagcuccauguaagccuacuguuuucaauuuauccugauaaagauuagaaugagacauggaugauuuuaacccaacauccuuccacaaguaugucuuugguaucugaacuuuggucugaguuucaguuaauguugggauguguucuguggaaccuuccauguuagcagcuccugcugaaggaagguucuuugagguuagccgucugcuuaugguugagcucauauuuuuaucuuaguggcuucaguucccaaaagaauuauaccguggggcucaauuucacaugcuuauuuuuauuguaauuguauguaaucagaguguggcuaacuauuguugauuggggcagaaguaggauagaaauguguaauaaaauuucauguacuuuuacuaauuucaguugucugaucguaacacuuuaggguaaaagcacaauagaaagagugauguguuucauuuucuuuucacaaauauucuuuaagugcccagugaacaugguagcagaagaaugauaccauaagagacugggcaugguggcuuacaccuguaaucccaacauugggaggccaaggcaggaagacugcuugaggccaggaguuugagaccagccugggcaauauaagugagaccacaucucuauuauuuuuuuuuaaaaaaaacaagaaugaugccauaagagagccauaagaaugugaucucuuucuuugaggagcucucaguuucguuugggaaggugugggaaugauaauaauugcaauauauugugggaugaagugagacugacauauaacuaugcuguaagaauauaggggaggcgagaugaauuuugcuuguggaagucaggguggcugagauggcaacauuugaauuguuuccguuuuuuuuuuguuguuguuguugagacagagucucacucugucgcccagguuggagugcaguggugugaucuuggcucacugcaaccucugccuccuggguucuagcuguucuugugccucagccucccaaguaccugggacuacagaugugugccaccaugcccagcuaauuuuuguguuuuuaguagagacaggguuuuaccauguuggccaggcuggucuccaacuccugaccucaagugauccucccaccucggccucccaaaguguugggauuauaggcaugagccacugcaccuggccugaaugggguuuuugaagcauguguuaaaauauaccagguagggaacagauugaugagcgguuuaaggugggaauguauaaaaugcaucugugucaguuaguggacaguccaguguggugaagacaaggagguaguccaauaacuggaaaaggaggccagggugaagugggagcaugauucuaaaaaucaauggggccacuauuaaaauguuuugggcaggucagugagagaauuugugauuuugugagaaaacugauaacaauguauaaaguggacuggaauggagcaggagugggcaggggaugaauagaggugaggaggaaaauagauucgagcgauguuuuaucuuuggugcaguuugggcacuuaaaaugagaucuuuguuuuugaauaucugaguggcauucagcuucaaauugaacuauaauaauaauuuucuuauuuuuaaagaccaagccucuugaucaacgcaguguuaauaacuuaaguauuuagcagcuguagccuaucuuucauuguugggagcggggagggguuguuacaugaacuguaacuuguuuugaaaacacgucacagaaacucuugagcccuugaagaaggagaaacuuuaauauaucuauuucuccauuuccaucuuuguauuuaugcaccguaauuaaaacuuucauguuugugugaauagaauuacucaugcagauguuaaaauguauuaaguucauauuaggccaggcacaguggcucacaccuguaaucccagugcuuugggaggcugaggugggaagacugcuugaggccagguguuugagaccaggcugagcaacauggcaagacccugucucugccaaaaaaaaaauguuuuuuuuaaacuuugcuggguguaguggugugugccuauagucccaguuacuucaggaggcugaggcagaagaaucacuugagcccaggaggcugagacugcagugggccgagaucgcaccacuggacuccggccuaggcgacagagcgagaaccugucucaaaaaaaaaaaaaaaaaguuuauauggcaacuuuauuuugaagagugcaaggugcuacauaggaacccuuggacuuuaaaucucaaaaacuguaagaucaaauuuuauaauaggaaaucaugaggaauacaagaagggggcaaaggugcaguacaagaccaacuggagauagaaaaaacucaugaaaauaagccaaacuccagauugcuuuaaaggugcugcaguuuuccagauguggguuauugguggugcugcagcaguuccuaacguuccuucacaggucauuucucuaguuugcuugaaacaguguuuggaauuggcaugaacugaaaagcuuacagagaugauuguuuuuuaggagaguccuuucuucuauuuuggaaaauuucuacuuuuagccuaguagaagaaaagcauagaguacauggagcauuuauacucuauauuguuaaaaugcccuuucuugugcuacauuugaauuuacuacuucaugaugggggagguagcuuuguuaguguuuacuuuaaaucaguuuaaagagcagacuguguuuaaaacaaaauguagcuuuccugagugauggaaaguguguuacuauaauaaaagcucuuuaugcaugaccccugaaugagacuacuuguauauuuuucuuucuuucagaaugccagugcccaguaucugggagaaguauuuuuugacauuucgcuguuuguccauugcuguuuucuuguuacccucacuuaccaaggacuuugcucggcguuuauuagugcugucuggguagcauucccauugcucacaaagcucugugugcauaaggacuucaagcagcaugguaggguauuuuugauuuugauauacaugggagaauaccuuaaaauacuuaaggcuuucagggacucuuucuuuuuugguuuuauuggguaggcuuucuaaauuguuaguuuuuaaaaguuuucauaccacacaaauuaucuuaugccuuauacuccaucccuuucucauguuugugaacacauacuaauauauuacuuguguauuuugcuuuauucuuauuuguauuuuauccugagugaaagauccuacuccaagauaacauacacccuuaagggcaagagucacaucuaaccuaauuucuguuaggguaccaaggcacaccaguacuauaaaaauuuauaucucacuggaggauuucauagaugugugcuuuuuuucucuuuuucccuaggugcccaaggaaaauuuauugcuuuuuaccuuuuggggauguuuauuccuuaucuuuaugcauuguaccucaucugggcaguauuugagauguuuaccccuauccucgggagaagugguucugaaaucccaccugauguugugcuggcauccauuuuggcuggcuguacaaugauucucucguccuauuuuguaagagaaaauaaguuuuuuucuuuuucuucauuuuuuauaugaauaugaauuuagccauacuagauucugugaaauaguguuacguguacuuuauugagaaaaucugaagcagaagaaauggugaaugaauggccaugcaucuuguaaauuugguaucguaagaaacuguaguauagaguuuguuguugcuguuuaaaaguuuuuugccucccuauccuuccaaauucucugauuuaccucuuuucaaauagccugucagauaccugagugugaauuuguagagcguuuaccaaguauuaauuguuagagauugccugguggugaaugauccuaauaguauauuuugaaauuacuaauuagaggcacauguuaauagauacaugggugguuuuauuagugcuuuuagagcuagugaaggaagacuaaaucugaugaggcuuuuuucauuaucauuccacuaccuuguugcuaccacaugaaagcuuguuaauugagucuguuaugacacccaaacgugccuucauuuaccaaauaaugaaaugaucacaggccuugucaguccucauuuugccguaucaguguccugcccuaguaaggagaguccuguguuugccaucccuuuuuuucuucccuugggauucccagagggaagaaaagacagugaugcagaguuuaagaccagaccccccuugagcagaguaagccccaagcaagguuuugcuuugguuugauguccaccuccacgauccaagaugggccccuccagagaaugcaggucucuuuuggugggaauuccuaagaauaaaaaguaauuauugaacacucagaggugcaccuugaaauuugaggauagggaaccaaacaggaaaaggagcuaugauuuuauuauaguucuuuucuucauggagaugauagugagccuuuucauacugauauaguaaagggcauucguuaccccuuuacuuuguggaaguuagguucuaaagacagcagguaaggaaaacacuacacacauggucagcaucauccguggaagucccuuauagccaguaaagcucuauauaugugacuuuguguauauaguccuguagaguaauucuuaugcauauuauuguuugagguugguuguacuagucuuaaaagagaucugagccuuccaaccauuuuacuuauaggauaauuauuaaggauaauauaaggauaaggauaauccuuauugguauucauagggcuguaugaaaaguucuaaaauguucuuugcugccuguaggguuugcugcuuuugaguuuaauaguaacccuuauaucaucuguauuuuugauagguuugcuguuguaaggauugaaggagacaguggacuuuuguuaucuauagauuagguucuaaucuaaucugaagucaacuaguuaugaacugaaugcccccacacccccguuuauuuguuaaauuauagucaugaaugggagcuauggauguccauaaaagaugacucagauaggggacauuuaaauucuguuccacugauaauaugaaagggggcaaaaugaacccuggagauguucauuguggaaauggaaaauguccccaaagcauggaaaucuuggaaaccagaagaaagaggauuaaagugucuuaucaucuaaauuauauuuuauugggaaagcuuuuggagagaagacugccucuuggaauacuuuagaaagcucacuuauuuuucauuauaaugugaaauagcccugccgcacuuugaugccaugaguuaucacucuuuuaauuauuuucuuacuuauguguagcaguguuaaugauaguggcuuauuaauagaguaagacuguuuucuuuggguaauggagaauugaaccacaaugcauauuucagacagcuuucccuucaguccuuggggauuuauuaaauacaucugcuagaaagcaauuaaagucuugucaagcaaucacgguuuuuuguuuguuuguuuguuuguuuguuuuugagacagagucucgcucugucacucaggcuggagugcagugguguaaucucggcucccugcaaccaccgccuccuggguucaagcaauucucgugccucggccuuccugaaauauugcauccugugucacucuagguucugagaugggugcaaaauaaaaugaagagaagcaugaaaagggacucugaaauguccauugugugcugauaacugagcuguuucugagucuucuccuccugaccccacuuguaucagcaguccccauuuccccugucauucaaucaguauacguauaaccaugaagguccagcagagaauaacuuaaggacaccuauuaacugauugcuugcugggcaugguggcucacgccuguaaucccagcacuuugggaggcugaggcggguggaugacuuaaggucagcaguucaagaccagccuggccaacauggugaaacccugucuguacuaaaaacacaagaaauuagcugagcacgguggugcacacuuguaauuucagcuacucaggaggcugaggcacaagaaucgcuugaaccugaguguuggagauugcagugagcugagaucgugccucugcacuccagccugggugacagagcgagacucugucuccagaaaaauaaauaaaauuucacauucauguuauuuuucuacuuauggaaauaaguagagaaauaaaaugaagaaggcauaaaggggagguggguuuagauuucaugucuauaguauaccaauauuccauccagaggcaucugcagcaaaacaguacuagccuuaggucacacaucucacauuuguauacugaguacaaaaauaugacagaguaccugaggacuugaggcugagcuagcaaaacaaaaugugucacccucgcuguccaucuuucucucaguauucacaauauuuaaaauguggcuucuuagaacaauuucagauuucacauaaaaguuuccccaaauggcuucuucagacccuguaagggaucuguggacauacucugugagucguguguguccuuuacaguuuuuaguucagcgauuucauuacgauugaaaauauuuaggauuuucuagaugccaaccuugagacugagucauuuacauuuacugccuagauuuauuguuuugauuguguuggcauugguuaauuugucacuuagagggauaauauuacuuuguaaugcaguuuuuccucuuaugcagguccacuggcagagucuugaagguacaucucuaugccaguugagaugaauuuaguauuuugacauauuuuaaagcauuaugaguggaauuugaguuuuguccaaacagaucugccuaagcuuaaagcuuaucucugguuauuuaaugaauaauccauuacaucuacauuucuguucuuuucgcacauuaaggacagcgacaguccugaguuuccuuuuucccucuugguuuuuggcugcaugccaaaaagguggcaccaucauggcagauuggaggcaucugucauuuucuagguucucaccugcaauggaaaucuccuagaguuagugcuuuguuuacuagauguuagaguaugcuagcaccugcugauaaauuuucuucaggggcuguuagguaauacuguuaaaaauaaaguuaguuaaaaacaccuuuccaccacuagaaugaauuuguaauauuucuguguuugugguuuguguuucagauuaacuucaucuaccuugccaagagcacaaaaaaaaccaugcuaacuuuaacuuugguaugugcaauuacauuccuccuuguuugcaguggaacauuuuuuccauauagcuccaauccugcuaauccgaagccaaagagaguguuucuucaggugagcaguuuugcaugagguauuugagaucuggaaaggaagcccuguguguuuugagcuucaguagugaauagcaagcgcagcugacuuuucugcuguugaccuauuuagucauacucaccuuuuuuguguguaaggcagugaggagaagacugacugucaagaggcauucuuaucagcuagacauauaucucccaggagacugaauuggaaauguuugcuuguuuuuauuacuauucaaauuauaaaacugcaucuauuuggaaaaacaggagcaaauauuuauuauggaauaaugaguuuuuagaaauauagauuguaaaaauguauacaggcugaguaaaaucuaaacugucaacuggcaaaauaaaauugauguuuagaagugcuaguaaaauuaaucuuaaguaacauucaaagugauaugugauagugaaacuauaacuuagaaaggguuuaauaaagugaguuuuaggacuuacuuucuuuucucuuuuuuuaaaauggagucuuggucuguugcccaggcuggagugcaguggaacgaucuuggcucacugcaaccucugcccccucgguucaagugauucuccugccucagacucccaaguagcugguauuacaggcgcucgccaccacgccuggcuaauuuuuguauuuuuaguggagacaggguuucacuacguuggccaggcuguucuugaauuccugaccucaggugauccacccaccucggccucccaaagugcuugggauuacaggugugagccaccacaccuggccaguuugaggacuuauuuuagaucucaacuuuuucuucaaauuuuuuagaccugguacuauaaagcaguaagccucaauucuagucaucucuguuagagauggcuaaauuguuaguuuuucuaaauuguuuuuaaaaguucucauacuacacaaauuaucuuaugccuuauacccaucccuuucucauguuugugaacacauacuaacauauuguauauuuugcauaauucuuauuuguauuuuauacucuguaagugaaagauccugcuucaagauaacauauacccuuaagggcaagagucacaucuaaccuaaucuagccaaacagaaaugccagaggaauuauaccuagauaauuauucaaggacuuaaaaaauuaaaaacacuuaggagguuuugaaaaggggccaaauaacaauuccuuguuauaguccugaaggacacugugauaaauuuuaugugagauuuuacaauuuguaaaaccuuuagugaagaacggauuuuuuuuuaggagguucaguguguuuuucaugauguauuaaguuuuauaauuaugucaguaauacuuaggaaaagcaggauuuuuauuuuuaaaaagucauuuucugauuuguuuggggguucucuuccacugugccagaaguuggcaaacuuuuccuguaaaggacaagauaauauuuugggcuuugucagcaauacagucuguugcagugaaacagagcgaaagcagcaacagaguauacccaaacaaaugaguguggccauguucaaauaaugguucguauauaaaaacagucaguggacaguuugcccuguuggcugcaguuugccggcuccugcccuaugcaguguuuuuuuuuguuuguuuuuuuccugauugguauucuucaggcugguuucugccgugaauaaaguuauuucaaauggagcacggugccuuuucauagaauucuguuaggcacaaggcugucaucuaguggugagcugcaauucccacuuuucucugcacaugaauuagcuucauaaaacacuaauagggaaaugaguguguauguauauaugugcuuaggauguauuuguuuuaaauccuuaucuaaaagcagcucuaacauuaacgucuuuuaagucugaaauaguaaguuucaaaaacauuuuauaggaauccuaaauauauuuggaagauacaauaaaacaauaaucuauauaucuauuuuccaguuuaaaauaaagaacgcuagcaguaccuuagaaacucucagugucuuauucacuugcuccauauccacaucauuucuugguauugucauacuccauuuuuguaaucuggggugggaauguggguguacuaguugaaacaguuuuuucacuagucuuuuuuuuucagcauaugacuagaacauuccaugacuuggaaggaaaugcaguuaaacgggacucuggaauauggaucaauggguuugauuauacuggaauuucucacauaaccccucacauuccugagaucaaugauaguauccgagcucacugugaggagaaugcaccucuuugugguuuuccuugguaucuuccagugcacuuucugaucagguugguucauuauuuuucugcuuaagguuaguuuguucucaagucuugucaccauaucaguacucuuaucauuuaaacugccauccuuuaauauacaaguucagugguguuuguacuauuuuuucuaucauuaugaaacuuuuuuuuuuuuuuuaguggaauaaagcacucagaagaguaguuuuguuuuuucaaauuuuaaaaaucuuuucucuagaaaccugagugguuagaaaagguggcccuucuaacuaauauaauagccaauaagcaucuaucucaaaaauuguggccgggcacgguggcucaugccuguaaucccagcacuuugggaggccgaggcggguggaucaccugaggucgggaguucgagaccagccugacaaaccuggagaaaccgugucucuacuaaaaauauaaaauuagccgggcaugguggugcaugccuguaaucccagguacucgggaggcugaggcaggggaauugcuugaacccgggagguggagguugcggugagccgauaucgcgccauuucacuccagccugggcaacaacagcaaaacucugucucucaaagaaaaaaaaaaauuguuuucucugggaagauuuuauagcuuggcagugaaggacuggaugagaagaaauaggaugggugguggaaucaagaucaccuagguuacuccuuuguucuuaacauugggaagguuuuauuacaaaauaaccuaaauuuguuggaguuggcauugcuuaucaugucugucaguuuauuuucauacccaaaaauguguucauauaugcugaacaguucugugaguuacagauagccaucaaauaauaaagcacccuaaaacugaagcuuccuuucuaaauaggaaaaacugguaucuuccugccccagaaguuucuccaagaaauccuccucauuuccgacucauauccaaagaacagacaccuugggauucuauaaaauugacuuuugaagcaacagguaagucauauaauaguuuuuucuccccuccuuuauuucuuaaacuuguuaauaaguggcauguauguuuuucccucagauauaucacaggaaccagcaacuuaggaagagccugugauguuucuaaaaucaauugaagcugguuaugacuucuuuuuuuuuuuuuuuugagauggagucucgcucugucgcccaggcuagagugcagugguacgaucucggcucacugcaaccuccgccuccuggguucaagugauucuccugccucagccuccugaguauuugggauuacaggugugugccaccaugccuggcuaauuuuuguauuuuuaguagagacaggguuucaccauguuggucaggcuggucuugaacuccugaccucauggucugccugccucggccucccaaagugcugggauuacagguaugagccaccacgcccggccaaagcugguuaugacuucuuaacaaaaauuuaauaggccaggcaugguggcuuaugcuugcuacucaggaggcugagguaggaggauugcuugagcccaggaguucaagaccagccagggcaacauagugacaucccgucucuacaaaauuaaaaaaaaaaaaauuagcugggcauguuggugcaugccuguagucuuagcuacuugagaacuugagaggcugagcugggagaaucacuugagcccaggaggucaaggcugauagcaccacugcauuccaaccugggugacagagcaagacccugucucaaaaauaaaaauuauuuuuauuuuuuggagcaauguuaaguuuacagaaaaauuaaguagaaauuauagaguucucauauccugccccccgauuuuccucuauuaaugucuugcauuaguauggugcauuuguuaaaacugaugcaccaguuuuaacacugauauauuauuauuaaucgaagccuguuguucccacucggguucauucuucguguuguguaguucuauggguauugaaaaaugugugaugccauguaucuaccauuacaguaucauacagaauagauuuaccaucuagaaaugcccugugcuucaccuauuuaucucucuuuucuucccacucuccuuagcaaccauuggucuuuuuauuaucucuguagcuuugccuuuuccagguaucauauagcuggaagcacagaguauguagccuuuuucgacugacuucuuucacuuagaaguaugcauuuaagggauccuccauaucuuuuugugacuugauaggccauuucuuuuuauugcugaauaguccguuguguagauguacagcaguuauccauauuugaauaaggcugcuauaaagauuccugggcagguuuuugaacucauuuggguaaaugcuuaggagugugauugcuggauauuauauaugguaagccuauguuuagcuuuguaagaaacugccaaacuguucuuuccauugacugauuucucuguucuuuugcccauaccacaacugucaugaucacuguaauuauauaguuaaguuuugaaguuggguaguaucagucuuccaacucuucuucuccagaauuguguuuugucuuuugccuuuccauguaaacuuuagaaucaguuugucaauauucacaaaauaacuuguuggaguucugauugggauuguauugagucuguagaucaaggugggaagaaaugauauuuuaacaauaauggcuuuuccuauccguguuggaauaucccuccauuuauuuuuaucuuguuugauuucuuucaucaguucuguaguuuuccuuauagaauccuuauauauauuuuguuagauuuauuuuuaaguaguuauuuuugggggugcuaauguauuaauaaaugguauuguucauugauggucuacaggaaagcaacugaguuucagauuauuacccucauauccugcagccuugcuauaaucacuuauuagaucuaggagauuuguuuuuguuuuuguuuuuguuuuuguuugguuuauucuuuaagaagauuuucuuuucuuuuucuuuuucuuuuuugagacagucucacucugucaccuaggcuggagugcagugguacgaucucggcucacggcaaccucugccuccuggguucaagugauucucccgccucagccucccaaguagcugggaauacaggcacccgccaccacaccuggcuaauuuuuguaauuuuaguagagacaggguuucaccacguuggccaggcuggucucaaacuccugaccuugugauccgccugccucagccucucaaagugcugggauuacaggcgugagccaccgcgcccagccuauucuuuuaagauucuaugaauagacaaucuuaucaucugcagacaguuuuauuuccuccuuccuaauaucuauaauuuuuauuuccacuucuugacuuguuacauuaucugggacuucuaguuugauuuugacaaggcguugugagaggggacaucuuugccuuguuccugaucuaggcaagcuucugguuucuuaccacugaguauguuguuagcuauacguuuuuugguagauguuuuuuaugagacugaggaaguucccucuauuccuagcuuacugagaguuuuuaucaugaauaggucuuggauuuugucaguugcuuuuccugcauauauugauaugggcaugugauuuuucuuucuuagccuuuugauguaauagaugacauuaauugauuuucaaguauuggacugcuuugcauaccugagguaaauccuacuugguuaugguguauaaaaccuuuuaugcaucguugauuugauuuacuaauauuuuguuaaggauuuuugcaucuauguucaugagagauacugguuuauaguuuucuuguauuguuguugucuagcuuugguauuaggauaaugcuggacucauaggauggguuaagaaguauucccucugcuucugucuucugaaaagcuuuguagagaauuaguauaauuccuuccuuaaauguuugguagaauucaccuaugaacccccguaggcuugguagguucuuuuucuguguuggaagguuauuaauuauugauucacucuuuaauagauacaggccuguucagguugucaguuucucauggugugaacuuuggcagauugugucuuuuaaagaauugguucauuuuaucuagguuaucagauuuauggaaauauaauuugucuauaauauuccuuaauuauccuuuuaauguucaugggaucuauaaugauguccccucuuucauuucucauauuaguaauuuacaucuuuucuuuuuuucucugccuggcugaaggguuaucaauuuuauugaucuuuucuaagaacuagcuuuugauuauaguugguuuucucuauugaguucuguucuaguuauuucuucuguuuacuuuggauuuaauuuguucuuccuuuuuuaguuuauuaagguggaagcuuagauuauugauuuuaaaucaucuuuucuaauauaugcauucauugcuauaaguuuccuucuaagcacugcuuauguuccaugccacaaauuuuaaguugaauuuucauuuuaauuuaguuucaaguauuuaaaaauuuuuucuugagacuucuuuuuugacccauuuguuauguagaaguguguucuuuaaucuccaaaugauuugauuuuucagcuauuuuucugauaauugauuucuaguuuaauuucauuguggucugagagcauacuuuguaugaauucuauucuaaaucuguuaaggugugcuuuaugauacaggauguggucucucuugaugaauguuccauuucaagcaguaugcuugaaaauaaugugcauacuguugcuguuggaagaaggcuuuaugaaugucacuuagaucuaaucgauugaugaugauguucaguucaauuauauuuuuacugauuuucugccuauugaauuuuucagugauggagggguguugaagucucugacuguaauugugaauuugucuuucuccuuuaguuguaugaguuugccaacuauuuugacacuuuauuguuagcuacauacaaauuaaagauuguuaugucuucuuagagaacugacccuuuaucauuaugcauugccccucuuuaucgcugcuaauuuuccuugcuuuaaaagucagcuuugucuaaaauuaauauugcucuccuacuuucuuuugauuaguguuagcaugguauaauguucuccauccacugacucuuaauuuaugugccuucauaguuaaaauggguuuucuguagacaacacauaguggggucuuguuuuuugauccacccugacgcucugucuuuuaauuuguauguuuagacauugacauucaaagugauuauuaauauaguugaauuaauagcuaccauauuaguuaacuauuuucuauuuguugcccuuguuuuuucuuccuguuuuugucuuccacucuuuuucugccuuuaguaguuuuaauuggacauuuuauaugaugugguuuucucuccuuucuuagcaugucaguuacacuacuauuuuuuuuuuaaccuuuuuuaauggcugcccugucguuugcaguacacauuuacagcuaugcaagcccacuuuuaaauaauacuauucugcaucacagggauuaugaauaacuuaauaacaaaauaauccuaauuucuccuuccagucucuuguaacauugcuagcauuuaucucucuuauacagaagcgugugugcacauaugcaguauguacacacaaugcacacauauaaguauacauaaccacauacauuguugcuauuauuuugaaaaacuguuaucuguuagaucaauuaagaauaggaaaaaugaguuuuuauuuuaccucauucccucucuagugugcuuucuuuuguuauaugaaaaucuugaguuucugaccuguauuauacuugccuucucagguuuuaauugagcauuguauauuguucuauucuuuuauauucuuaccauaucaauuauacuuauuuuagugguugcuauggagcuugcaguaugucugucuucaguuaacacuguacugcuucaugguagugcagauaccuuauaacauaauauucucaauucaucccucccugggauucuaucaaguugaccuuuuaaacaauagguaagucacaugaccaucuuuuuuuccugcuccuucacuucuuaaaccuuuuaauaaguugcaugugguuuuucuugcccuaaaguuuaagucuuaaauugaccagcaauuuaggagccuuacauuguuucucaaagaaguugagacugguuaugauuuuuaagaagauuuacugaaaaacuuuuagugucagauauugguucauugucagauccaggagcauuuggccuggcauuaugacuuuaucuuuuuugguacauuuuauucccuuuuccaucuuuaaaacuagcaguuaggucuuccagcuucuuaacuuauguuuuggccuguaaaacuucuuucuaggauauucuuuauggugcugccaguuuaucuuucaaauaucgauuucauuaugucuacuucccuauuaaaaaacuuuugauggauuuccuguugccuggagaguaaguucaaauuccuuggcaaagcauguuaggucuucgguagucuggacuuuguguauauuucgggauucuuuucagcacucccuuugcacugcauagccacauccaacccuuauuugcacccaacacacacuguuacuucugguaugagugauacucuucuugguacuaccuccuacccagacucuacccuucucuucuuggcaaaauaugaagauuucucugcccuccucucccaucauuuccaauuaagugagcaacugccauccucccacuucuuccucccuuuguguauaucuguuguaacacugaccaucuuguaucacgauuauguaguuuaugucuuuguuuuccuuuagaauuaaagggaggcagacaugaauggguuuucauuuaucucuguauucuuggcauccaguauaaucacuggcacuugauggguacucaagacauguguugaauuguuaaauuuagcaacuguuuuucuuuuaaagcauucuacuugggcuuaguacggagacagaugcuugagaaaggaggaggagaaaugucaagacauaugacauuuucucaucuucaaaagcuguaaagaguuuguuugcuugugagguguuuuaaaaagugagcaaaccaggauggucucucccuuucuaaugucuuuuugggaaguaugaugguuauuuuaugugucaacuuggguagaccacagcacccagguaucuggucaaaugcuauccuagauguuucugugaaaauauuuucuggguaagauuaacaugcaaaucacuggacuucgaguaaagcagauugcccuccauaaugcaagugagccucaucccgucagugaaggccuugagaaaaagacugaccuuccccaaggagagggaauggggaauucugcuagcagacugccuucagucucauacugugacuuuuuucuucagccugccugccuauccuucagauuuuggacuugccagccucaacaaucauguaagccaguuccuuaaaauaaaucucaaucacucucucugucucucucucucuuucucucuguacacauccuguugguuucccuggagaaugcuaauauaggaaguucacuucaacuguuccugcagcuguucacgcuauacuuuuucugaguacucuuccccugauagaaaguugucugggacuuucaugagugaaaaguauuuuuaaauaucacuuuuccccuugccuacuuuauuuuuuucaaggccuaauuuacauacaaugaaauguaaagaucuuacacaguucaguuaguuuugguaaaagcagauauauacccauguaacccucaucucuaugaagauauaaaacauuuccaucaccccacaaagcucaauugaugugucuuguacugaguggaauauuggagucucuuauuuguguguuuauauguauauaucuucuauacgccuccuguaguuuucuuuauaaagugguugcuauguuaucugaugcauagauauucacaauuuuaugucuucauugugaauugugacuuucaguauuaaaaagugccccuuuuauauuuaaugccuuugccuugaauucuguguuuugagaaauaagauaggacuuuuaaacaauuuccacuugccugaaauaccuuuguucauaccuuuauuuacccuuucuguaucucucuguauucaggaaacauacaguaugugauuggguuuggcuuuguaagccaaguugaaauuguuuuucuuuuaguggguaaguuagguuuauuuacauuaauuuuuauuacucauacauuuggccucaguugucacaguauuuuauaauuacauguguugcuuuauuuguuauauuccuuuuuucuaugaggugucuucuaugcucuuuaaaacauuuauuuucuggcauuuaugaauguuuauauuuguuuuaauucucuauuauuuuacuugaacccgggaggcagagguugcagugagcugaaauugcgccacugcgcuccagccugggccacagaacgagacuccgucucaggggaaaaaaaaaaaaaaaaaaaaaaagguauuguuuuaacucccaccaauuaacccauacaacagccaugcuuauucuacuuuccucuuucucucucccauuuuccauccaauuuuuauuacaacauguaacauuuguauauuugucuuauaacuucaccuuaguguuuuuguaauacauuuggauauauuaaaauccucaguauaauaaguucuuuuggccaggugugguggcucacuuuggggguacuuugggagguugaggcaggaggauggcuugagcccaggagcucgagaccagccugggcaacacggggagaccccaucucuaccaaaaaaaaaaaaaaaaggccagguuuguagcaugcaucuguagucccagcuacuugggaggcugaggcaauaggauugcucaagccaaggaagucaaggcugcagugggcuguguucaugccacuggacuccagccuaggcgauagagcagugggcugcuguguucacgccacugcacucgacccuaggugacagagcagugggcuguucaugccacugcauuccagccuaggugguagagcagugggcuguguucacaccacugcacucgaaccuaggugauagagcaagacccugucucaggaaaaaguucuuuugcugaaguuuguacaguuaucuguugguuggaugaagcuuauucucuagacuguuucugaagaagggcucaugagugcuguuucuguaugguuaaaauugguuuucuguaauccugauaguugaaggacaaguugguggacauaaaaucuuugguucacguuuuccaauauugaguuuuuaaaaauuguuguuccauuguugccuuguuuuauauauuguuuuuggggucugauaccaauguaauuuuuuuuguaaguuauuugaucaaacuuuuuauugaagaccuugaagauuuuuuuuuucuuugaaaucuaauaguuuuacuagguuaugucuugaaguuguuuguucuguguuaauauucuaaggugccugguagucucuuucaauguguagauucagcucucuuuuuguuucuggaaugcuuucuuggauuacaguuuuaaauauuaguucuguuucguuguuugguuuucuucugggguaccaaaugaauauuuuuucugaccugccuuccauuuuuaccacuaucgcuaaccuuuuuuacuuugcuuuuucccauuuuaauuuucuuaguauuucuccugucuuuaugacuguuauuaaauuuuccuuugaaucuauucuguugggcaucuuguaauugucuucauuucuaagguaauuuugccuuuuuccuccauuucuuuucugagucuagucgguccuuuuaauucuuccuucuaguaagaauuucugauucauggugggguuuuaaauauccccaaauguuuguauggauauauuuguaguuggagugugauuauaacauuuucuccugcuucaugguuauuucuuuuuuuuuccaagaggaauuuucugauacuuuuuuuugguaauaacuguauggaucuguuuauccuuuucuuccucauuuuugugcuguuuuguaagauuucuagcaauggcuuccuuuucugucaguguaagaaaguccagauucuuuaggaaguuuguguugguguggaugaauaauauuuaucucuuucaacuuuuuugacuggauuuuucuugcaggacccugaauuuucuuuugcuucuuuucaucuucaccacccaaaugccaaaggauuccucuuccuucuuuuuuauuuuucccugagaagcuuugguuuugaagacuguuacuucaauaauauacuuuuaagucccugcccuguaaaccuuucuuugacuggacacuauaguaguauuuucagauuuaggguggacugacuuggucugcauuugccacaaagccuugcagcagaagcagggugggcacaagugugugagauugcucccugagauuuaaaaauuuacgguuauuucaaauguggguauucucugucuuuaaguuaggcugaggguguguuuuuguuuaguuuuaucuauuuuaguuuuaguuugacuuccacugucaucaguuuccuuggaaguucccagugaugacuaaauuuucagaacugagcuaauauuuuccagcuugaagggaaaaacuaguaaaacauauuuuaagguguuacaugaucaacucugaaaauuacaacuccauucauaauggcaguccuauucaguacuguuacagcacuucgcaguuuugccaacacuuucauaugcuuuuucuaauauaauccccucaaugaagaaauugugacauagauuaaauuccugaugucaugcagcaguuaagugauaggaccaacuuaacacaggcuuucucauuuacagucugugccuuuucuccuguaccucauuauuuaaccuuguugauucacacuaaguguccaaacugguaaaccuccauuagguuuauaguaaguauauuuaaagucaugcaggcaugaaccuuuaugaagucugguuuggauuguggguuauuuuuuugauccuuuuaaaaagauuaacuguucuuucuuccuuuuaccuuacaggaccaagccauauguccuucuauguucgagcccacaaagggucaacacuuucucaguggucucuuggcaauggcaccccagucacaaguaaaggaggagacuacuuugucuuuuacucccauggacuccaggccucugcauggcaguucuggauagaagugcaggugccaauuucccagcauuguuuguuucauugauuagguucccaggugguauuuagcaagaaccuuggguucaguauucuggcuucugagaacuggagaacuaauugauuuucucuggcagguuucagaagaacauccugaaggaauggucaccguggccauugcugcccacuaucugucuggggaagacaagagauccccucaacuggaugcucugaaggaaaaguucccagauuggacauuucccucugccugggugugcaccuacgaucucuuuguauuuuaaucuuguggaugagcucuaaguacaugcccaguggauacuccaugugacaugguuucucccuauguuacguggauguuuguaacguaagucaaugaauuuuaaugaucauauguucaaagagcuuucuggguuaacgcuuuucagggccaagcacuauaaggguuuagcuguggcgcagugaugcauggccuguugacacuugaaaaugccagucuuuuggcacuucagcacauguggguacugccacuacacacacgucauuuuauaugaccuuaaggacaaagccaacaauccacuucaauagcugccccuuuaggaucaagaaagauguacacugucagagcauuguuaaugagacaaaaguuguuuccaauuuaagccccaaaaccauuuguuguauuaguggaugguggguaaaauaucauucacugagguaaugauuccccuugagaauauaacucuguguaggucacuggaaagugauugccauagggcugggagagaagcauugcacucuugaggcuguagccugugucaagcuguuucuucaggcagccucucaaaugugcuuugucucucugugcugaggccuggacccugugcugagcuggugacucacuguccugacaaguggacacacagaugcacugcugugcugcuuuccugaggugguuuucuaugccuguuuuccucugaaacaugucuguuaccccucuccaucuuaccaaguugaaaaggggaauauuuggccacauaccccucugguuuucguagguucuuuugguucagaauauuguuugugccaguacaugaccuuaacuuccuuccucagagcacugagcugccaucugggcuauucugggguagaaggaaggcugggaguggugggaauuuuauaaauauuuauucucuuuucuuuguuucauaggagucuuguguuauacaagguuaguccuucaugguauaaucuuacugaugcacugggccuaucuuuuuguuuuccagccaguugaauagauuaguuuuucucaguaacuuacuauccagcagacuggcuuuccugagacuugagguuguggcuuauacuggaaugagaccacuguacguguaggugguucagauccugcguaauggcagcaugaggacuuaaaaggugguuuucauuuugaagauggcuauguagcuuguaagguguaucacagcaguaccucucauggcuuuuugguuccagcagugagggcauuggugagaucaaugguaaacugugcaagcuuucuuuuuaucauuaggaaaugugaaacguuggacaaauuuugaguuuuaacaaggacaaaaaguugaaagaaaaggcacaguuaacaaaaaaggguggcuagauuuaucuugggugauggaggaaaugagagaggaaugcucuugaaagguggucuguggaucugucugaauagaaagagcacaguaaguaugcauugccggagaaaacguccuugaagcugcuugucucauguguaugaugugcuuuuuaaaucaugccccucguugccugccuaaucugugacucccuaaaaacuaacugggcccauguagauggggcugcaaccagagcugaauaacauguuaggcucacacaugcaucagcacugcacacuggaaucauugcucuuccuggacuuuguagaaaucagucucaagugcuucaagagucuggcuccugcuacuuuuaucugucagguagcacauaagguuugcaggguuuauauuuuguauagaaucacaguuguggagaaaaaguaauaauuucucaaugaauuuuaaaaaugggccuauuuucuauccccgugguucaucugauauaauuaguguucccugugaauucccccccucuaugggaaggaugccuuuacucuuuaucaguaauaaauuaugacuguuuucauauugccuuaggguuauuucccuguguaaaccauugucuuuuguuuugguuuucuuuagcauuaugaagcuuugguauuguacaaggucaguaguaagaugcucacuagucucagggcuuguguaauauucugggaggucauuuaaaugccagaaauggucaagcaauuauacacaguauuuaugacucuguuaagcauaccguuugucugucacauuaguagauucugagauuaaaaaaaauuuuuaaagagugaucauuuaaauaauuucuaaaagggucuuuucaagcucuaacaaagucacuaacaaaugcauuauuuucuacagaauuagauguuaguaguacaguacugcauauucagggaaaaagugugaggaauugauuucaaaauaguucguucuuguguuugaccuaagaaugauugucgcaugaaguguuuguuuuuacaguuuagcauauauaaacaaacaugauaggauuccuuaagauguuaccacccagggggccacaagccagccugcugucucaggaagcuguagaaggaguguuugucaauuucuugucacugguuugcugacuuacugaggauuaauuguugccuuacaauguuacugaaauaaacuguuuaauauacugguugguaucuuuuuaacugaaaaacagaucuguguucuucuguauccccauauuuucaaggguuauuccauguccacagagccuuuuaauugcuguuaaaagaccuagauggcucaugugagcaaagaacucaacauggaaauguuuacuucaguuagaauccuuuaucuuagaaugaaaugguacuucugaauuucacagaaauuauuagguaaauguugagcuucaccuauguaggaguuuuaaaucauccccauuagcaaaaaaauagcaaaggguaaagggcguucuuuuauuugggaguaaggguaggagggagggaagaaguugccuuucagccagagugacucauugcuuauucuaaucuccacagaaggaaagggcaccaccacucaccaaaauagagcaugaacuuugaguucagagaucucugugcaaguuauuuaaacuuugagugaauucucucagaacaguucaaugcaaggugaagcagcugaacaacuucuaaccuaauacuccucuucuucuuuuagggccaauaaagucaagaugcaguuauggcuauuuacauuuguuuuuagccaagaugcaguuacgacucuuuuuaaauuuuuuaaaauuauacuuuaaguucugggguacauguguggaauguacagguuuguuacauauguauacaugugccauggcaguuugcugcacccaucaaccugucaucuacauuagguauuucuccuaaugcugucccuccccuagccccccacccucugacaggcucuggugugugauguuccccucccuguguccauguguucucauuguucaacucccacuuaugagugagaacaugcgguguuuggcuuucuguucuuguguuaguuugcugagaaugauggcuuccagcuucauccaugucccugcaaaggacaggaacucaaccauuuuuagggcugcauaguauuccauggugcauacgugccacauuuucuuuauccagucuaucauugaugaugggcauuuggguugguucugagucuuugcuaucgugaacagugcugcaguaaacauacaugugcaugugucuuuauaguggaaugauuuauaguccuuuggguauauauccaguaaugggauggcugggucaaaugauauuucuaguucuagauccuugaggaaucgucacacugucuuccacaaugguuggacuaauuuacacucccaccaacaauguaaaagaguuccuauuucuccacauccucuuuagcaucuguuguuuccugacuuuuuaaugaucgccguucuaacuggcgugacaugguaucucauuguaguuuugauuugcauuucucugaccaguggugaugagcuuauuuuucauauguuuguuggcugcauaaaugucuucuuuugagaagugucuguucauacccuuugcccacuuuuugauguuuuuuuuuuuucuuguaaguuuaaguucuuuguagauucugguauuagcccuuugucagauggauagauugcaaaaauuuucucccauucuguagguugcccguucacucugauguuaguuucuuuugcugugcggaagcucuuuaauuagaucccauuugucuauuuuggcuucuguugccauugcuuuugguguuuuagucaugaagucuuugcccaugccuguguccugaaugguauugccuagguuuucuucuaggguuuuuaugucuuacguuuaagucuuuaauccaucuugaguuaauuuuuguauaagguguaaggaagggauccagugucagcuuucugcacauggcuagcuaguuuucccaacaccauuuauuaaauagggaaucccuuccccauucuuuguuuuugucagguuugucaaagaucagaugguuguagaugugugguauuauuucugaggucucuguucuguuucacuggucuauauaucuuguuuugguaccaguaccaugcuguuuuuguuacuguggccuuguaguauaguuugaagucaguagcgugaugucuccagcacuguucuuuuugcuuaggauugucuuggcuaugugggcucuuuuuugguuccauaugaacuuuaaaguaguuauucaauucugugaagaaagucaaugguagcuuguuggggauagcacugaauuuguaaauuacuuugggcaguauggccauuuucacaauauugauucuuccuauccaugagcauagaauguucuuccauuuguguguguccuuucuuauuucauugaacagugguuuguaguucuccuugaagagguccuucacauccucuguaaguuguauuccuagguauuuuauugucuuugcagcaguugugaaugggaguucacucaugauuuggcucucuguuugucuguuauugguguagagguaugcuugugauuuuugcacacugacuuuguauccugagacuuugcugaaguugcuuaucagcuuaaggagacuuugggcugagacuaugggguuuucuaaauauacaaucauguugaucuaauauugacagugggguguuaaagucucccaccauuauugcgugggaaucuaagucucuuuguaggucucuaagaacuuuauaaaucugggugcuccuguauuggguacauauauauuuaggauaguuagcucuucuuguugcauugaucccuuuaccauuauguaauggccuucuuugucccucuugaucuuuguugguuuaaagaagucuguuuuaucagaaacuaggauugcaaccccugcuuuuauuuuugcuuuucauuugcuugguaaauauuccuccaucccuuuauuuugagcaugugugugucuuugcaugugagaugcaucuccugaauacaccacacugaugggucuugacucuuuguccaguuugccagucuaugucuuuuaauuggggcauuuagcgcauuuauauuuaagguuaauguuguuaugugugaauuugauccugccauuaugaugcuggcugguuauuuugcccguuaguugaugcaguuucuucauaccgucaauggccuuuacaauuugguauguuuuugcaauggcugguacugguuguucauuuccauguuuagugcuuccuucaggaacucuuguaaggcaggccugguggugacaaacaucucagcauuugcuugucuguaaaggacuuuauuucuccuuugcuuaugaagcuugguuuggcuggauaugaaauucuggguugaaaauucuuuaagaauguugaauaugggcccccacucucuucuggcuuguagaguuucugcugagagauccacuguuacucugaugggcuccccuuuguggguaacccgaccuuucucucuggccgcccuuaacauuuuuuccuucauuucaacuuugguggauccgacaauuaugugucuuggaguugcucuucucaaggaguaucuugguggcguucucuguauuuccugaauugaauguuggccugccuugcuagguuggggaaguucuccuaaauaauauccugaagaguguuuuccaacuugguuccauucucccuguggcuuucagguacaccagucaaauguagauuuggccuuuucacguagucccauauuucuuggaggcuuuguuuguuucuuuucacucuuuuuucucuaaucuugucuucuugcuuuauuucauugaguugaucuucagucucugauacccuuucuuccacuugaucaauucggcuacugauaccuguguaugcuuuaugaaguucucgugcuguuguuuucagcucuaucaggucauuuauauucuucuguaaacuaguuauucuaguuagcaauucaucuaaccuuuuuucaagguucuuagcuuccuuccauuggguuagaacauacacuccuuuagcuuggaggaguuuguuauuacccaccuucugaagcuuacuucugucaauuugucaaacucauucucuguccaguucuguucccuugcuggcaaggaguugugauccuuuggaggagaagaggugaucugcuuuuuggaauuuucagccuuuuuuugcuguuuuuuccucaucuucguggauuuaucuaccuuugaaguuggugaccuucagcuggguucucuugaguggacguccuuuuuguugauguugauaguauuccuuucuguuuggugguuuuccuucuuaacauucaggcccucugcugcagguuggcuggaguugacuugagguccaguccagacccuguuugccuggguaucacuggugaaggcugcagaacagcaaagauugcugccuguuccuuccucuggaagcuucguccuacagggguacccgccagaugccagcuagagcucuccuguaugaggugucuguuggcaccuacugggaggacccacuugaggaguuaaucuguccuuuaucagagcuccaaugcugugcugggagaucugcugcucucuucagagcugccaggcagggacguuuaaguaagucugcugaagcugcgcccacaacugcccuuuguccaaagugcucugucccagggagguggggguuuuaucuguuagucccugacuggggcugcugccuuuuuuucagaguugcccugcccagagaggagggaaucuagagaggcagucuggcugcaguugccuugcugaacugcagugggcuccgcccauuuugaacuucccaguggcuuuguuuacacugugaggguaaaacugccuacucaagccucagcaaugguggacgccccuccccccauguuggagcaucccaggucaagcucagacugcugugccagcagcaagaauuucaagccaguggaucuuagcuugcugggcucugugggggugggacccaccgaaccagaccacuuggcucccuggcuucagcccccuuuccaggggagugaaugguucugacugguguuucaggugccacugggguaugaaaaaaaaaaacugcggcuagcuuugugucugcccaaaacagccauccaguuuuguacuggaaacccagggcccugguggcgugggcacuggagggaaucuccuggucugcggguugcaaagacugugggaaaagcacaguaucugggcuggauugcaagauacagucccuaacagucccuaauggcuucccuuggcugggagaaggaguuccccgaccccuugcgcuucccaggugaggcaacgaacuacccuggcuuuggcuuacccucacagggcugcacccacuguccaaccagucccagugagaugaaccagguaccucagcuggaaaugcagaaaucacccgccuucugugucgaucucgcugggagcugcagaccagagcuguuccuauucagccaucuugccagcaaucccaguuauggcucuuaaugucuguuuuuaguuuaaauacguagggauuuuuggaguguaucaguguauuuuuugacacuucuacuuccauauuugacuuguaaaaacauaacauguugguaauaauuuuuuuuuuccuccaguuuggcucuacagcaugaccaaauggaauuuaugccaggaaugcaagguugguuuaacagaaaguuggccaggugcaguggcacaugcuuaauuucagcacuuugggaggccaagguggguggauugcuuaagcccaggaguuugagacuggccuggacaacauggcaaaacccugacucuacuaaaaacacaacauuuagcagggcaugguggugugugccugugggcccagcuacuauagaaacugagguaggaggauggcuugagcucaggagguugaggcugcagcaagccaugacugcgccacuuccuuccagcaugggugacagagcaaaacucugucuuaaaacaaaaacauuugaaaaucaguguaauguaccauauuaauagaauaaaggauaaaaaccacaugacuacuucaguagaugcaauguauguuuguugaguguuuuuaucauggaagggauuuggauuuuuguaaaagacaaacuauacagaaggcaacauccucaaccagauaaagcuuaucaauaaaaaacccacagcuagcaucauaauuagugaugagagaaagcuucucccuaagaucagaagacaaggauauccacuauugccaccuaauaagcauuguacuaguggcucuagccaggaccguuuggcaggagaaagaaagaaaaggcauccagauugaaaaggaagaguucaaacuaucucugguugcaaacaacaugaccuucaauguagaaaauccuaaggaauccacaaaaaagaaaaaguuugauguugcaugaugcaaugucaauauacagaagcaauuguauuuauauacacaauccaaaaacaggaaauuccauuuuuuuuacaguagcaauacuuagaaauaaaucuaacaaaaguaugagacuuagcaaaaauuauaauccacuguuaaaagacauuaaaaacccaauaaauggaaagacaucucauguucauggacuggaaggcuuaauauggcaauauucuccacauuugcuuuaugucaugaauacaacgcuuaugaaaaucccaacugccuuuauuuuaguauagaaauugacaagcugauccugcaauucauauggaaauacaagggaccuagaauagccaaaacaaccuagaaaaaacaaacuuaggacucucgcuuucaaaauuuccuacaaagcaacagaaaucaaggcaaugugguauuggcauaagaagauauuauagaucauuagaauacaauuaagaaucuauaaauaaacccauaccucuauaguugauuuuugacaaugggaaaaaaauccuuuccauaaauggugcucugacaauugaauagccacguuagaagaacgaagucagaucucucuuucauaucauauaugaaaauuaacucaaaau

SEQ ID NO: 18804 - RNA, 4118 nt, Homo sapiens
cuguuccacuucugguaaaaguuauuaagugugcaaauuccaaaaccaaaaaaaaugucauugcuacagagaacuguaucucagcaauagggaagauuuugaaguuuaagccuaacuguguaaauguagaugaaguucuuccacacugguuaucauggcuuccacugcaugaagauaaagaggaagcuauucagacuuugaguuuucucugugaccuaauugaaaguaaccacccaguuguaauugguccaaauaauuccaaucuucccaaaauaaucaguauaauugcagaaggaaaaauuaaugagacuauuaacuaugaggauccuugugccaaacgccuagcuaaugucgugcgucagguacagacuucugaagauuuaugguuggaauguguaucacaacuugaugaugaacagcaggaagccuuacaggaguugcuaaauuuugcuugaagcacuuuaauauaacuugaauauuaucuauuauaaaaguaacuacaaauaaguguugugaauagauuuuauuauaaaucagagaacuguuuucucccugcuaagcaguuuauaguucuucuccauguuucuccagaauuaaucaguguuaguccucuguuuaucucgcauguuuuaucuuccaaacacagaccuuggugauaaccugugcuucaaacugucuuaaacaauguuugucaccuuuccccuaguugauguaaaguauauaaauuguugcuauuuguuugaacuauuauugaugcuagccaagcaguauacuugaugugaagaugucaugcuaucacaauaugcuaagagcucacaaaaauaagauagaauuuccaggacaaacaucuuuggaauugugagugaaggauauaguggcaggcuugucccucuuuaauuaauacucuugguauuuguggugaugggaggaugcuguuacuaggagaguuuugagauacugcaguggaugugggauguauaugaacuucuucauaauguacuccugggaacuggguaggacauauccauauuguaguucccaaggugucugguugagaguuagagaacuuuuaaauuucuuuagccagacaggucucuauuuuuuuaaguuauccaggacuccaagaaccauaguuacugaaaagggaguccugauacaucuaauauugguagcauguaacaguguuugacaaagaguaaguaagcaguauucuugggagucaguguuauguguuucagcagaguauuauuuuguauauguaugccauuuucucccugcaaagcagcucaacaagagaaaaagcucuaguuauagggcuuaaauugauuucuauuucaaauaauuuccuaagagauucuagaguagaacugaagaguauucuauuggaaaagugaaaggaaagaaauguaauuuucuuugaacaugaaaaagaaaacaacuuugagaguagucauuuagcaguagaugugcauuauuaugagaaaacaguucuauaaguccaggguuaauuauauuaauuggaaugucagucuuuaaugucgagcuuauuguaggguagaaaagagcuuucuacucagcuaacgauuacucauugauccaaaacuuaaauacaucuauaauuuccuggggcuauugugaguacuguguauguauuuagcaaauauuuaagaccuaguaagugcucaauaaauuguagcuguuauugcuguuguuguuuguaccucuauugugucuggaacuucuuuuacuuuagaauuuucccaauccauucccuacucauucauauuggcaggcuauuuaggcuauuguugacaagaauauaaaguugagauuuuagauaugcaauucuguccauuccauguaauuauuacuaaugggggaaaaaggaaaauuaaggacauuauguauaguaugaucacaauuuuuaguauauuuaagauaaauaaaguauagaagaaugaauagaaaaaucccaccucaaaguauuaauagagguuuucucuaggugguaggauuaaguggcaaauuuucuccucacuuaccuauauuuucuaauuuaccuacauaccuacaaccaacauauuucuuguuuuguuuguuuguuuugagauguaguuuugcucuuguugcccaagcuggagugcaauggcacgaucucggcucacugcaaccuccgccucccagguucaagcaauucugccucagcuucccgaguagcugggauuacaggugcgcaccaccacucccagcuaauuuuuuguauucuuaguagaaacgggguuucaccauguuagccaggcuggucuagaacuccugaccucaggugaucuguccaccucagccucccaaagugcagggauuacaggugucagccaccgugcccagcccauauuucuuguguaauagaguuucuuuuuuaagaucaaggacccgauccuacuuucauuauaguuaaguugcuaucaucuugaccucuucauaaccuagaguugagguuccuucuacucacccacaccuuucucuuuuauauaaucuuaauuaagaaacccuuuaucaacauuucuagcaauucccuacacuuuuauguaugaggaauuagaaauucugccagaugacuuggaauuaggcaccuggaguuuuugaaguaugacagaccuagauuuuaacuuuguuuaacaacuuucuuaaacuaagaggcaguuuccucaucugaaaaauaagguuaauaccuagcugauaggcuuguugugagauuaaaggagacaaugaauauaaagugcuuaguggcacaggguucaauaauguaagcuaauauuguccaagagucaugaaauagagcugaugacuaaagaggaguagaggauguuugcuuggguacguugggcuucagauuccugggcuuugucgaaagaaaggaggaaugucuagucagacacacguuuugguugccaggugcugaaguaagacugaucccugcauuuuucuuucugugagcugagguucuguggacucuucagaguccacagacucuucucugaggggagagaacccuguaaaugcguuauauauuacaaaugucugaugagaggagaccucgaauacuagauaaaagguauguguggaggacagugugaauacccuaacagagcguucccgcuucacuauuuuacuuaagagugauacuuaacuuacuggacaaaaacagcuuugagguuaaaaaaaaauuuuaucacugcuuuaaaguucacauuaaugagaaguaaacaauugcaagagucagaguauccuaaucauuuaguuauacacauuuuacuuuuaaaaugcaugauuucuguaauuuuguuuuuguguuuagguaauucuagguuuuaacgaggguucuguguaccuagaaaaaauaauaugugcgucuuucaaauagaacaugaggaaauaguaguauuugcuuuauggaaccaugaauuccuaccucccaacuaauuuuaaguaacauguaaaccaaugugaaugaugaguccacuuuuuagucauuaaacaguaauuguaaaauguagugagauuaucagcccaugcaaacaacuguuuaaugcuguacaacucagacaugaacuauuuugacuguuuucagucccaagaauuuguuuaaaugagguuccauucucuuuauucuuaacagaucucaagaaucgggaggguggaaauuuguaacugaaaacauggaauuaguuccaaaauaugaauugauguuaagagcugggguucuaaaaaucacuuccuuuucuucugcaugugaacguauggucgaguccuuaaacuuucuuucuaaacuucucaaaauucugguuauauauagaagacccgcagucacaagggagaaagggugggaacagaauguaaauuuuauaguagagaagauuuacauuuugcgcuuucucacuauucauuugccauuaacaaagguuaucuagcaacuuuaauuuuaguuuggggggcuaacacgggucuugcaaaagaaguuuccucuugaagcacuugcuuuaaaaaaagccuuuuggccaccuucccaggcgguagcgaauuaagcugcgcaggcgccuugcuucccccuccaucaacau

SEQ ID NO: 18805 - RNA, 5630 nt, Homo sapiens
uagcuuugacagagcgcaauggcggcaaccgcgucugcaggggugccggcgaccgugucagaaaagcaagaguuuuaccagcuucugaagaaccugaucaauccaagcuguauggugcggaggcaagcagaggaaaucuaugaaaauaucccaggucuguguaagacuaccuuccucuuagaugccgucagaaauagaagagcagguuaugaggugagacaaauggcugccgcacugcuacgacggcuuuuguccucuggguuugaggagguuuauccaaaucugccugcugauguucagagagaugucaagauugaacugauucuggcuguuaaguuagaaacacaugcuagcaugaggaaaaaacuuugugauauuuuugcagugcuggccaggaauuugauagaugaggauggcacuaaccacuggccggaaggucugaaguuucuuauugauucaaucuacuccaaaaaugugguucuaugggaaguugcacuucacguuuucuggcacuuuccugggauuuuugggacccaagagcggcaugauuuggauaucaucaaacgguuguuggaccaguguauucaagaucaagaacauccagcaaucaggacauuauccgcuagagcugcagcugcauuuguacuugcuaaugagaauaauauugcucuuuucaaagacuuugcagacuugcuuccuggaaucuuacaggcugugaaugacucaugcuaccaggaugaugauucagugcuagaaucccuuguugagauugcagauaccguaccuaaguacuuggguccuuauuuagaagauacucuacaguugaguuugaaguuauguggagacucuaggcuuaguaaucugcagcgccagcuggcccucgaaguuauagugaccuugucugaaacugccacuccgauguugaaaaaacauacaaauauuauugcacaggcaguuccucauauauuagcaaugaugguugaucuacaagaugaugaggacuggguaaaugcugaugaaauggaagaagaugauuuugacagcaaugcaguugcugcggagagugcacuagacagacuggcuugugggcuugguggaaaaguuguuuuaccaaugaccaaggagcauaucaugcagaugcuucagagcccugacuggaaguaucgacaugcuggauuaauggccuuaucugccauuggagaaggaugccaucaacaaauggaaucaauucuagaugaaacaguuaacuccguuuugcuuuuucuucaggauccucauccaagggugagggcugcagccuguacuacacuuggacagauggcuacagauuuugcaccuaauuuccaaaagaaauuucaugaaacagugauugcagcucuguuacguaccauggaaaaucaagguaaucagcgugugcaaucacaugcagcuucugcucuuauuauuuuuauugaagacugcccuaaaucauugcuaguucuauauguggauaguauggugaaaaaucuacauuccgucuuggugauuaaacuucaagaguugauucggaauggaacuaaguuggcuuuggaacaacuugugacaaccauugcaucaguugcagauacaauagaagaaaaauuugucccauauuaugauauauucaugcccucacuaaagcacauuguugagcuugcuguucagaaggaacucaagcuucugagaggaaaaacuaucgagugcauuagccauauuggucuugcuguugggaaggaaaaauuuaugcaagaugcaucaaaugugaugcagcuguuguugaagacacaaucagacuuaaauaauauggaagaugaugacccucagaccucuuacaugguuucagcaugggcuagaauguguaaaauucuuggaaaagauuuucaacaguaccuuccacugguuaucgagccucuuauuaagacugcuucagcuaaaccugauguugcucucuuagacacacaggauguggaaaauaugagugacgaugauggcuggcaauuuguaaaucuuggagaccagcagaguuuuggaauuaaaacuucaggacuugaagcaaaagcaacugcuugccaaauguugguuuacuaugcuaaggaguuaagggaaggguuuguggaauauacagaacaaguugugaagcugaugguuccuuuacugaaauuuuauuuccaugacaauguucgaguggcagcagcagaguccaugccuuuucuccuggaaugugcaagaauucguggcccagaguaucuugcacagauguggcaauucauaugugaccccuuaaucaaggcuauugguacugaaccagauacagaugugcucucagaaauaaugaauucuuuugcaaaguccauugaaguuaugggagaugguugccuuaaugaugaacacuuggaagaacugggaggaauacugaaagcaaaacuugaagggcacuuuaaaaaccaagaauugagacaggugaaaagacaggaagaaaacuaugaucaacagguugagaugucucugcaagaugaggaugaaugugauguuuauauucugaccaaaguaucagauauuuugcacucauuauuuaguacuuauaaggaaaagauuuuaccaugguuugaacaacuacuuccauuaauuguaaaucuaauuuguucaaguaggccauggccagacagacaguggggauugugcauauuugaugacaucauagagcacugcaguccaacuucauuuaaauauguagaauauuuucgguggccaaugcuacuaaauaugcgagauaacaacccugaagucaggcaagcugcugcuuauggccugggugucauggcacaguuugguggagaugauuaucguucuuuauguucagaagcuguuccacuucugguaaaaguuauuaagugugcaaauuccaaaaccaaaaaaaaugucauugcuacagagaacuguaucucagcaauagggaagauuuugaaguuuaagccuaacuguguaaauguagaugaaguucuuccacacugguuaucauggcuuccacugcaugaagauaaagaggaagcuauucagacuuugaguuuucucugugaccuaauugaaaguaaccacccaguuguaauugguccaaauaauuccaaucuucccaaaauaaucaguauaauugcagaaggaaaaauuaaugagacuauuaacuaugaggauccuugugccaaacgccuagcuaaugucgugcgucagguacagacuucugaagauuuaugguuggaauguguaucacaacuugaugaugaacagcaggaagccuuacaggaguugcuaaauuuugcuugaagcacuuuaauauaacuugaauauuaucuauuauaaaaguaacuacaaauaaguguugugaauagauuuuauuauaaaucagagaacuguuuucucccugcuaagcaguuuauaguucuucuccauguuucuccagaauuaaucaguguuaguccucuguuuaucucgcauguuuuaucuuccaaacacagaccuuggugauaaccugugcuucaaacugucuuaaacaauguuugucaccuuuccccuaguugauguaaaguauauaaauuguugcuauuuguuugaacuauuauugaugcuagccaagcaguauacuugaugugaagaugucaugcuaucacaauaugcuaagagcucacaaaaauaagauagaauuuccaggacaaacaucuuuggaauugugagugaaggauauaguggcaggcuugucccucuuuaauuaauacucuugguauuuguggugaugggaggaugcuguuacuaggagaguuuugagauacugcaguggaugugggauguauaugaacuucuucauaauguacuccugggaacuggguaggacauauccauauuguaguucccaaggugucugguugagaguuagagaacuuuuaaauuucuuuagccagacaggucucuauuuuuuuaaguuauccaggacuccaagaaccauaguuacugaaaagggaguccugauacaucuaauauugguagcauguaacaguguuugacaaagaguaaguaagcaguauucuugggagucaguguuauguguuucagcagaguauuauuuuguauauguaugccauuuucucccugcaaagcagcucaacaagagaaaaagcucuaguuauagggcuuaaauugauuucuauuucaaauaauuuccuaagagauucuagaguagaacugaagaguauucuauuggaaaagugaaaggaaagaaauguaauuuucuuugaacaugaaaaagaaaacaacuuugagaguagucauuuagcaguagaugugcauuauuaugagaaaacaguucuauaaguccaggguuaauuauauuaauuggaaugucagucuuuaaugucgagcuuauuguaggguagaaaagagcuuucuacucagcuaacgauuacucauugauccaaaacuuaaauacaucuauaauuuccuggggcuauugugaguacuguguauguauuuagcaaauauuuaagaccuaguaagugcucaauaaauuguagcuguuauugcuguuguuguuuguaccucuauugugucuggaacuucuuuuacuuuagaauuuucccaauccauucccuacucauucauauuggcaggcuauuuaggcuauuguugacaagaauauaaaguugagauuuuagauaugcaauucuguccauuccauguaauuauuacuaaugggggaaaaaggaaaauuaaggacauuauguauaguaugaucacaauuuuuaguauauuuaagauaaauaaaguauagaagaaugaauagaaaaaucccaccucaaaguauuaauagagguuuucucuaggugguaggauuaaguggcaaauuuucuccucacuuaccuauauuuucuaauuuaccuacauaccuacaaccaacauauuucuuguuuuguuuguuuguuuugagauguaguuuugcucuuguugcccaagcuggagugcaauggcacgaucucggcucacugcaaccuccgccucccagguucaagcaauucugccucagcuucccgaguagcugggauuacaggugcgcaccaccacucccagcuaauuuuuuguauucuuaguagaaacgggguuucaccauguuagccaggcuggucuagaacuccugaccucaggugaucuguccaccucagccucccaaagugcagggauuacaggugucagccaccgugcccagcccauauuucuuguguaauagaguuucuuuuuuaagaucaaggacccgauccuacuuucauuauaguuaaguugcuaucaucuugaccucuucauaaccuagaguugagguuccuucuacucacccacaccuuucucuuuuauauaaucuuaauuaagaaacccuuuaucaacauuucuagcaauucccuacacuuuuauguaugaggaauuagaaauucugccagaugacuuggaauuaggcaccuggaguuuuugaaguaugacagaccuagauuuuaacuuuguuuaacaacuuucuuaaacuaagaggcaguuuccucaucugaaaaauaagguuaauaccuagcugauaggcuuguugu

SEQ ID NO: 18806 - RNA, 3872 nt, Homo sapiens
gguuuucuuuaaaauacuguauccguauccucauuccaaucaauagauuucagguuaaacaaaacuugaaauaugaaacucaccuagcaagagaaaaaaagaguggaaugaggaaggauuugugauuuuuaauuaauaauuauuuuaaaaccaaaauaauuagaacaagucugcuuugcaugcaguaguacucaagauacugcaaauuauuuuguuugguacaaaaucugcauguauuuguuaacuguauuuaugggcacacauccuguuccugccaaucaccaaguacuuuggaguauuauuuuuguggaugauuuucuuccuuguccgaaaaauauugaccauuuagguagguauuauuaauuuauuggaaacuauuuuugaaaguaguaauguaagauucacucucauucugccaugaucauuugaguuuaucaaugcagaacacgucuuucuuuaaaguuauucuagagcugaucaauauugucuuauauuuagacacugucuuuucucugaucaucuuuaaacauaucacacuuccguucuuguagaacacacacauacguacacacacacaaaccucuaagaucacaaucccaaaauguaugucuacuuauaacauuucaugauauuaaauguuaaauuuuauuucaaaaacuaucacagccuaaagggaaauauaauuuaagcauuaagauaguacauuucagaaaauaagcuaguauuuucauguuacauuuuagguaccuaucauuugucauuccaagagauccuugcguucuagacucuagaauuaaaugggguaaaggguuaugcuuuuaagaacuauaagcugaaaugauuuacuucaguucaauauagaauauuugucagucaagauaacaaucaauguguacaaaaauuuacauaacaagaggaaaaauaggcagugcagcaccuuuagaaaaauaauuaaaaguuucauugcauuuacagguaagugccacacugagaauuuacaauacaguaauuuacugcaaucacaggggaguuccauaaagaaacaaagcucuuacacuccagguuuuuggaagguguuauuggaaugcuuaacugaaaccacagaacuuguauauccuuaggauugaguugaugaaggucauaaaagguuuucauagcaucuauuauauaaaaggaguucacugcauuuggauagcugguuuagugucucugacaagugugaagccuagaagaauuacuggcuugauggugaucuuucuguauccggcaagacagaccuucuccacaguaacaacgcuggaauauuucuaguccaugagagccuuuucuccuaugcuugguacacacuugaccuucuuucaggacagguuuacagaucuuggaccagaagugucuagcacaacacaauccugaggcacagucugaugaccggagacaaacagaaccuucuuguccuacgaaggagaagacaguaggaaaaaaguacauaguuacuguuaaaccugcaucguuucacuaaaauaauucaaaagacacuucugaugugcuaagaaugagucuuaacauccuuaccuuuggugugauacauuuuugaagacaaggugguucuucuggaauacccauccaaggugcuaugaucauuaccaaagcuuucagugaugguuuccucaauuucuccucggaaaugauuuugaucagaagacacacauauuccuaaggaagcaggaaauagugauuaacuucaggguuguaaugcauuacugcuaacagcugugacaguggcagucuguuaugccagcaucaacuugagauacuucauugcagugacaucauuuuaaacacaagccaaacuuccucuuuacuguuaaugcaaaacucuccagauggacagaagcaccaauguguauacuguauacagucagucauagguaauauccccaguauagccauuuaaaauacuuucccaccaacugugguaggggcaagugagauuucugcccauuuuaauauuaccuuugggguaagaaaaagaaacucagucacuuuaaaaauguucuuaaaaauaacuucucugccccuggugcuauauggguccuaccagacuaaguuaagcaaaugcaauuccagcugccuggaacauugcaaucucaccggccaguuacuuuacuguguaauuucuauauuacagagauuuacuuaguucauccuggaguacugcuggguccuaaggagggucgucgcccuguuagcuuauuucuggagaccucuuuagcugucuaaauccaccuuuugaaaaauuaaaaguuaguggaucugugguuggggggaggaguacuuauauuaaggcagcagaggguagagggagggggaaggauggagaagucaaguugugaggguaccaagaucucucuuaaaaauggccaaugcagauaaaucaguccucuggcugacaacaguuucagcaaaaaucagaaggcgaggccagucuggcaaaacugugagaaucacaauaagaaaaaugaaaaggacagcugaacgccaaagcugguuucuuugauaucuguaugaucccaucguccuccucaucaucccccuucucaauugaccucaagguucuccccagacaaauuuuuauggaagaguccacuacgaggugaaccguuguauugaaucauugagggacacggaggaagauaaggaccucagagaccucccaacuucucucuucuucccgauuaaacacuugcaaugaagauacuucagcggaauccugcaugcugaacacccauuugcagguggcgccgcaguguucucagggcggagauuucuccccccaccccccccaaccccccgcccccgcccaauucauagacgcucaaaggcuggacaguuuuagugugaaagggagcuuucaggacucaccauuuuugcaguaauucccggggcagcacauagcgugacgcaugcagcguuuucggcgcuuccugcaggcgagacagauuugcacgccugcguccccuccgcgggugggacuagcgcaguacucaucagugccgcacuccucguccucugcgcacggguacggcugugggaaggguucggggagagggugaggcacccagacguccagguacccgcccucuuggacccgggcgcugaucacaguccuuaucuguccaccucuccaaaaccuguuacugcccacugcucccaaaugcaggguuaccaaaugcucccugaaccgcacacauucagcacguucuacucccucgucuccagauaggacccuuucaaggucagagcauccucugagugcccgaccccucucaccugguaguugucaauggucugguacuuauucccgcccggguacaggauucccggcgcggcgcugacugcagagccugggugccccgcagcgccgcccagcggugggggcagguucuugauagcguuggaauugagaaccgaguucaagguggcgcucacucccagcagaggguggccgccgagagccgccgcuaccaucgcgacaaagacccggguagcucccgcugcgcccagagccaucaucucagaaggacucaagagggagaaagaaagagaaaaugaccgucacuuugcaagccuggguccccacgaaaccgugccgguucggcugcagagucaggguccgggagcccccugcggucccagaguccugacugcagggagcacagagcucugcgccgccaccgccaccgcggcugccuuuauaccgcgggcccggagcauuccggccccuugggagggagacaacaaagccgggaugggauuucaaagcgcugggaggggcugggaggggguguguuuguguacaugaaggggggccu

SEQ ID NO: 18807 - RNA, 1011 nt, Homo sapiens
uuuaaauguggacuuccaguuagaaaaauggucuaauauaaaacaguagaggaauguuuagccaccaauucacaguuuuuagaaaguucccaccauauauaaugcgugaucuucuugaaggugaauacacuguacuuuuaaaauaucaaacucuuccauccuucauauaaaaauauugaccauuuuucuugacaguuuaaugacaaaaucauagcaacaauucuuucaguuauuaucaucuuuaucacuaucaucugacauuuaugcugaaauagcuguguauacguucuugcagagcaguacaaugagaaacuuuucucucuggccuccagguguuugucaauuccauccuggcucuggggaacaaaacaagugccugcaggaaaacagggaagugcaaaugaccuauuccucuagagcucagccuuuuguuagccuugaaaauggaauugccuguguugguccauagcccuugaggggucuaggaaagagaagcugaugccugcagggagaauaaagaaagugccaacauuuuucugcccauguaguggucuggaguuugcugccaaguggucuggaguuugcugccaaggucccaggacuggguaauaguugcaggucuucauucuuaucagcaggacuuccacagggaggagagguucugggaaauccuccugacagcaggugucugcaaauggggaggcagagaugagggagggaaggaaaguguuugcauccccaccaggaaggaaacuuaccugacacauuucguagcagcaaggguuugacaaugcuuuaggauacuaaagcuaggauacucauuauucaacuaaauguugaauuuuauauauaucagcauguauuuuauaaauacugaguauauacucuguggaagguaggcacacaguugaacaauaugggaguuuaaaugugaacgaaaaugugacuucucuuuucaguaguacuuucacaggaaacuuuaucauuagccuuucucuugaacuuacacug

SEQ ID NO: 18808 - RNA, 731 nt, Homo sapiens
auuucuuuuuuuuuuuuuuuuccccaaaucaauaggucuuuuauugcaucauuuaaauaucacaaguaggucuuaagugucaucuggcaucuucuuucuguagccagguaacucuuagaucuuauucaucagccugcugaacaguuccuuuuucagagacauagauaccauccaaaaauuuccugauauccuuguuuuuaacuguuguggcuugcugaaucaaagccgcugaauuugaaacaagcucaaugucauuuccuucaaggauuaauucaucuuucugggcuugagauacugaacaagcaacaccuggucucauccgaacccugcggauguauuuuucacccaaaaaauuucggauuucaacaagagacccauucuccuggauaacaacguugauggggaagugagcauacacagaccucaucuuguaacggaagcccaguguaacacccuugaucauguucuguacaugacuacaaauaguccgaacgguagccaguuccuuucuguuaccccaccauuugucaacccggagccucuuuuuuuucuuuccaagaaggcugaguucuacauugaugugauugaagucccuccgcaggguuccucuggggcccuucacgauaacugugcgucccuucagaguaaugucgacauuuucuggaaugucgacagucugauugcugagaauagucuucauucucgcaguagacgcagcaaagaaagccuaa

SEQ ID NO: 18809 - RNA, 1403 nt, Homo sapiens
aauacuuauuugauucaugguuuuuuuuccuuuuuaaagcacgaauaacauuucuuucaaaauaaauauacaguucuauaaaaaaauauaagaagguacuauaauucuuggucacuguccagcagaaacauguuugauugcuuuuagagucagaagucaacaccauccacaaaaauacauucuuuuagccagguuuuagaacacuuugaaacauagaaaauuccuuauucuacaaacaaguccuuuuagagauauucuaaauaugccagugaugaaugucuaauucauaugcaggauucaaggcuauugaggugagcuagacuaagaauaccaagaacacaaaauuguauugauacacaaacaguauguaaauuacuuugucagauuacaaaaaugcaucagauuuuaucuaugguuuucauagauaaacauaaagcaauaaguuaguugcuuuaaaaaaauauauagcucagguguuucucuucauucaagugugaaaggcacagcagucccgagucuuaggggcacccaccgcagccacaucaccgcgcugggacagaugcaguccgcagcguucccaguauuuugucccaguguguaaaguacggagcgaaguugcaguuaaagugagagugaugcaggucguggugcaccacacccccguaccacccgaagggcaccagucugugaguggaccaagggaaguuguagccggagugguccuccacggaaagccagauguugaccacguggaaggucaggguggugagcggguggcacccgagcagugugacguucaucaugucgaagaagcccaaagaaaacaguucccagacgcucauauacugcguugccagcgcgaacgaggacgaguucugguggugcaccuuguggaaggugcgguacagccagggcaccuuguggugcagcaggugccacacgaagaacuccaugucgaagaguagcaggcagaacaggauguggugcagcagcaggagcagcucgggagcuucguggggcaggagggccgggcugcgggcccaaugcagcagcgucacggggaacacaaacaucacaugcugguagagggucugccccaggcaagguagcagcugcugcgcggauggcgagaagucaggguggaucuuguagcgccgcagggcgggcacccaggagcacaggauauccaggaccacgaagggcaggcaaaagcccacguauguggugauggagaagaugaccgggaagaagggcgacuguaggagggccucccagcuccucagguggucccagaggggcugcaggaacagcugcccggagcugcaaaggaccugggggucggagcaguuguggcagcucauugcgaggcugugcaaggcagcugaggcugcugcucgaguccc

SEQ ID NO: 18810 - RNA, 12282 nt, Homo sapiens
ggcagacaggaagacuucugaagaacaaaucagccuggucaccagcuuuucggaacagcagagacacagagggcagucaugaggucagugaaauaagaaugcauaaucaugcuuguuuuugagugcaaauuguaaguugaguuucuuacugugcaggcacauuccugaauuguccugauguuuauagauucaauaugucuuuaucagucugagcauuuguaagauguuugagggguuuuucccuguggcuuuuuuugguguacacacaggcuucuuaaguuucuggaaugguucccuacggaacuacauggggggaggcaggguggggaaugcaucagcucauguuuccucccugugugcagcuauuuccugcaaugagaggaaggcuuggcaggagcgguguauuucacucagccacaaacuuggcugauucaaggguagaccuaagggaauuacucuuuuggguuuuucuguuauugucauuuuguuugaaaagauuaagucacaggcuuuuuuucuuguaauuuuaaaaggaggaauuuauuuucaacagauauugugaaagauacaaucaguacugcaaacccacucaugaagaaggcaauuuugcccugaaacguugcauuacuuuaaggugggaaguggaagaaacaauucuuacaaaugggcauuuuugucauuucuuauauaaaaacaaacccaaagcuuagcauuuauuuuuauugauguagugaaugcuggucagcagcaaaaaaagaauuucuccucaaaaguguaaugaccuaaucuauuaucuaaaacuagucuaaucucuaauggugggaagcagaucagugguugccuggagaugguggggauugaguaggaaggcucccaaaagaaucuuuuuagaaucauaggaauagucuauagggagguagugaugguggcuacauaugcauaaacauuuaccaaaacucaucagacuauacacugaaaaugggugcaucuuauuguauauaaagcauaaucucaguaaacuugauuuuuaaauuuauauauugaccuccuggaguucuucaggggauagcauguuagggagaacuaagagaaaaggaugccuuucccaccaagcaucucuaggaaaggagugaggaggugauugccagggagggaagaccccaucgaccauucaggggggcagaaaaggaaaacuggauucccuaccuuacucugccccaaggacuugaagaugcucugcaaugucauguuuggggaugagauggguaagaggaauucacugccaaauaccucaguauauagaauacccuuuuauauagaauaaguuccuggucaagagugauguuaauugugucugugugagugggauugaccagagagcaaggcgucuuaguagccagcuugcaggaaagguuuuacaggguccugucuuuaggugugucuauagccacugaccugaggaggucugaggggggcucucugaacuaugcuggacucagguucacaucaaggugcuccuauuuccagaggcuauaggaacaggaagagauugggcugcuccuccccaguugugcuaaaaauuuccaaaugggaaaaucaccuggagaacucacuggcacgugccagcugaugggcauccuccucugccccauccacugaggaacucuguugcucccuuuacacacucacaaauucacuuaaaauuauaacacaaauauauuaguaccagcaaucauggugguaacauuucuuugugaucuguaguuagugguuucaugcaaguccgugugaagagaccaccaaacaggcuuugugugagcaacaaggcuguuuauuucaccugggugcaggugggcugaguccgaaaagaaagucagggaagggagauagggguggggccauuuuauaagauuuggguagguaaaggaaaauuacugucaaagggggguuguucucuggugggcaggugugggggucacaaggugcucaguaggggagcuuuugagccaggaugagccaggagaaggaauuucacaagauaaugucaucgguuaaggcaggaacaggccauuuucacuucuuuugugguggaaugucaucaguuaaggcaggaacuggccaucuggauguguacaugcaggucacaggauaugauggcuuagcuugggcucagaggccugacaagugggcacuguguuaaacacguuuuacgcaugaccucauaucacccuuccaacagcccuaggaaguaagagcuauuauuucuauuauuagccucauuuucuagaugaccaaaauggggcuuagaagggcaaauuacuugcccaagacaucagauagagagcaggugucagagcagagucauuaauggaggcaccaaacucuacugcugaucaucugacucuaugcccaauggccaaaaggugaaagaucuuaaugcuuucaacuaugcucacuuuagagagggggccagggaugggcuuccuaucuggagaguaagggccagccuuugaugguuacccaugccuuagaguggccaaagccacaagaacugaacccagaucuuggagaagggugaaagugguucuccccagggcauaauuuucuaucauuuggaugaagggaaaaggaaauucauccuagggcauuuuaaggauaagggaaugaggcucagugauaugacucaagaaauaucccagaacuaagcaaagaggucacugaaauccagguguccugugguuuucuucccuucacucaagaugccugauaaugcugcuuaauucaccacauuagcuccauaaauaaaggggaaaacugcuuuuuaaaauaccucuaugacagcacuucucaaaaugugguacaggaacuccugcacugaauuuccaaggcacuugugaaaacacagguuucuaagcucacaucagauucacugcaccagaaucucugggaguaggacugcauagucaguacugucaauauacaauaaucagaaggcucaggauccaguuaaaagaguuuauucaacaaaaaguugagggcagcagucccaggaguagagcugcacccaagaauggugaacaguacuuccaguguagagaaaaaugaggacuguuuacauaggcaaagacagagguguucaacagaaugacaacuucucuuguuguuguuguuuuuguuguugcuguuguuguuuuugagacagagucucacucugucacccaggcuggagugcaguggcccgaucauggcucacugcagccucagacuccugggcucaagggauucucccacccagccucccaaguagcugggacuauaggagcacgccacuaugccugguuaauuuuuuuguauuuuaguagcaaugggguuuugccauguuggucagguuggucuugaacuccugaccuuaagugaugcacccaccuuggccucccaaagugcugagauuacaggcgugagccuccgugccuggccaacauuuuccauacagaggcuaacauacagauauacaauuugauuggcuacuauugauuacaguccaagggaauugcuuaauauucuuuuguaaagagguaacauggcuggccgcaguggcucacacccauaagcccaacacuuugggaggccgaggagggcagaugcuugagcucaggaguuggagaccagccugggcaacauagugagaccccgucuguacuaaaaauacaaaaaucagccaggcgugguggcacgugccuauagucucauugacuggagaggcugagaugggaggaucgcuugagccugggaggcagagguugcaguaagcugagaucgugcuacugcacuccagccuggaugacagagugagauccugucucaaaaaaaaaaaaaaaaaaaaaaaguaacaaucaaaagggucucuauuuccauaacaugaggucuacguuuuaauaaagacuagguugucugaggccgggcacgguggugcaaggcuauaaucccagcacuuugggaggccaaggcgggcagaucaugaggucaggaguucgagaacagccugaccaacauggugaaaccccgccucuacuaaaaauacaaaaauuauccaggcaugguggugcacgucuguaaucccagcuacucaggaggcugaggcaggagaaucacuugaacccgagaggcagaaauugcagugagacuagggagucugguuaacauguaaccccucaccacacaggucaaagagcaacagucaugcaccugagaaaaaaaacagucacguuacgugagucaguuuucagggcuuaacuuugccucuugacauaacacauuuggaagcuucuaaaauuuuauuuucuuuuuacagugccuuuuuacaacuuucaaaccacaguuuuccaaaucugucuggaacauguuccuggcgugagugagcucaguucucacagauucuguuucaguuuccccucaagagggaucuugauaggguuccaucaguuucacuuuccuuuccccuuucauaaaagcacagaccuaacagcacccuggguggaaaccucuucagcauuugcuuggaaucaguaagcuaaaaacaaaaucaaccgggaccccagcuuuucagaacugcagggaaacagccaucaugagguaaauagucccugcuucucugauaggaaacagaauuucuuauguacaacuuccugacuuaugcuauuucaguguuugcuuagagaugaaauaugcauuuaucuaauucaagcauaaaucugccuuaccaauucaugcauuuuuauuucuguagcucuuugugauguauagaguuaggcagccaaaggacacagggaaaugggagcugggagcugggaagggacggggcauauugagagauccuagagagcccaugcucagaugcuuucagguaaaaucgggccagugaaagcuggggccuggagggaaguuacuggagguucugguucgucuuuuguuucuuauauuuagaaagccuaagucagagguuugugguuuuguugugacugugguuauuuuuaaaccaugcuugcuucucagcaaaugugucaauaauuaauucagcacugcaaaauuccaauuuauguugaggucacuuuuaccuugaaaugcacuuuuucauaauugggggauaugucuacuugaguuguccucuagcaggucuagugaccugcuaagccucccacgugaucaaugaacagggagaagguguugcuugcagucucucaaacuguguucugcgaguggccugaaucauaucaaccugagucuucuaauagaaugcaaauuucuagguccugcauucugaaauccugauugaguaaaacagaaauaagguccagaaacaaacauauauuuaaagaggaccacaaguacuucauaggcauacugaauggcuuacagaagaaauguccaucuccaaauccucucuuccuuaaaugcauacaaggcuuccugcauuguauguguguaaaugugaaggaggaaaccccaagaggcaggaggggggaggggugggaagaauguugaaauaaagcaaagcuuguuucugggcacaguggcuaagccuguaaucccagcacuuugggaggcugaggcaagaggauugcuugagcccaggggcuccagaccagaauuggcaacaaagugagaccuacaaaaaaacaaaaauaaaauaaaaauaaagcaaaguuugacuguuuaaaggguaauuuaaguaugagaaacuggugauuggaaaucacugccaaaaagggaagucuucccagagccuugcugcucacaguguggucugaagcugagaucccccgggagguuguaagaaagguaacaucccagcuuaucugaauccagaucugcauuuuaaaaagaucuccagauguuuguguccauauguacauuaaagguugagaaguccggcucuggagaguuccuucacuugcuuucugaagugauggacuccuuggauugggccuguucugaccaaccaacugagcacaggucugccaguuccuucacguagucaguuggagcauaaccagcacaugcuggggacaagcugcacaugugcagacaagaguggggaaauccccacucuuaccacuucaagaaagccacuuucugaaaauuucaagauucuacucuaguaauagcuuugacugggaaggagaugugguaucuacccuggagucugugggcaagacagguggucaugaucuggguuaggugagagacuguaacuauguugauucuggggauuuccuaaggacuagcagcacuagcuuuaacugcuuuaguaagcgaaaucuuaugucugcaauccgaggucaugggaaaucucuuucuggaccugagggaauccuaucucccuaaggucuucuacuagaugcagauccagguaggacuggcauucuacuccccaaguuucaccugaaccuagcuauucuguuuuuucuucuuuuucuuuuauucuuuuuuuuuuuuuuuuuuuuuuuuuuuuuuuuuuugagacggaguuuugcucuuucgcccaggcuggaguguaguggcccgaucuuggcucacugcaaccuccgccuuccgguuucaagcaauucugccucggcuucccgaguagcugggauuacaggcgccugccaccacgcccggcuaauuuuuguguuuuuaguacaggcgggguuucaucauguuggccaggcuagucucgaacucuugaccucaugauccacccgccucagccucccaaaaugcugggauuacaggugugagccaccgcgcccggccaccuagcuguucuuuaucaagugacuguagucaucaucccaccugccugcuuguauuuauuuaaauaucugcauuaauuacuguuaacuaacuuauuuauacauauaagaaguauucagaguaacuuucaaaaacacauaugagauaaauuauuaagugaggaaaccuuggcaauuggaguauuuguuuuaagagggcaauaguauuauaaugaaaaccuccugaccuguggcucugggguucauguuucuucuuaucgaggucucaggccuuccaguccaauauauuuugcuccaaauuuuacuucaaggagagaucaaguaucaaauaccucaucaaauuggagacuuuagggaguaaggcuuaggaaaaaucaagagaaucaagggacccaauuuucaguggguuuuauaaucauaaagccacaugaguaguugacuaucuuccugaauaaauuguuccauguuaucauuaaaugucucagccuggccagcucucgcauugguaaagcauugguggggauggaauaucccugagagauccauauucagagcucuuucacaaguccagaaauguucagugugcuuuucugcuuguccaacacuuucuugagcaauugauaucuucugaagcugacacaugacaggguggaaguauguuucaucucagagggagaaucuugagcuauaagugcuuaaaauuuaguuugguaagaucccuggugcauugauaugucaaagccuucugcccuccaaaaaaaaaaaaaaaagagagagagauagugucaucagacuugcaaggugguuuccgguuucguugaggcaaauacauccaacaauacauccaacaucaccugucauccugcagguccacuggauacucucuauuaauuacuaguguucagcuauuuuuuucaggcacccauauguaccuacaaaucugcagauacauucuauugaucugagacucacacuuucuccuuuuaaccuuccuaauucacacaucagcaaaguuaacucauguuuccaugacuuuauuaugauuuaguggcauaacagauauaagcagaguuguucaauuaucaucguuauaacuuacuuuugguauucauuuuuuaaauaauugcuaacuugacuuuugacuuguaguccuucauacaggguaguuagaauacccagguaaagccaaauugaaaaccccuagggccagguguggugguucacaccuguaaucccaacacuuugguaugucgaggcagaaggauugcuugagaccaggaguuugagaccacucugggcaauauagugagacccugucucugcaaaaaaaggaaggaagggaggaaagaaggaaaauagggagggaggaagggagggagggagggaaggaaggaaggaagggaggaaagaaggaaaauagggagggaggaagagagggagggagggaaagaaggaaggaagaaaggaaggacccuauaauagacagggaagauauugacacuggaacccuagacagggaccaagaaaaggaaaaggacuguccccaaaucaaagcacacacauaaagaggcuagccggauguagauggcaacuucccuccucacucccauugcccuugaguugauucugcaucucucacuauaaagcauuucaugugcaaucauauugggccaaaaaugguuuagaucagcauuacuggagagacagacaggaaguauaauagaucaguacacuugcaguagcggugugagggccagugcucguccaugguaaauugcaaauaaagucaauggcuccuuguagaacaaaaugcauucaauuuaaagaauuuuguuuauucugagauuacuuuuucaguggcaaggaaaauucuuucuuuucuaucuuuuaaaauaaaauauuggucagaauagaugguugguaucuuuucagauacauuagcagcccuauuugguucauaacuuuuuuucugaaauugugcuugucugugaaauccaaaaauaaggacacuugguuuaaugauuucuggagguucuuuccaaucuuauggugccgugacuccacugguaagaaggaagaagcacaaacucaagagugagggacauacagcccaagccccaggcaaauguagauaaugggaacacacuuagagaacucuugcaauuuauccagcuaaauaaggcaagugaucuccuuuaguaucuuccaacuacaaaacaaaaaugaguccauuuuguuuguuuguugcaacaaauucauucugucugggaaucuggccugugugguggggagacuacuucagucagacucaagcugagccuccgugggucuguuuguaagugguggaaaagaugaagggaaaaauaccuaaaucacauaacauguuggcagacauaucugggcuuuuauuucuuuacaugucuccuaacaaaacugaaagcaccuggcgggcagagaagguugggauaaucucuauuuuucuuaguauccauaauaucuaauaaagugacaaaaagagguaccccaauaaagagucaugggauagcuaaacaaaccuuacccagaauguacaaggaaugagaacugacuugguauuuuuuaauuuuuauucuuacuuuuauuuuuuuugaggcagggucccacucuaucacccuggcuggaguguaauggugugaucucagcucacuacaacuuuugccuccugggcucaagugauccuccugucucagccucccgaauggcgaggacuacaggcauguacuaccaucccuggcuaauuuuuguauuuuuaguagaggcaggcuuucgccauguugcccaggcuggucuugaauccugggcucaggugauccacccgccuuggccucccaaagugcuaggacuacaggcaugagucaccauuccuggcugacuugguaauugagcagcgugagagagaucucauuuccugucacugaagcugccuccucuuacccaucuuaccucaccuccugcauaucugcuuacacgguguaagggaugugcuuugugggugucugcacagacuguagcuaaagaaaagugaauguaggaagcaacuuacaauuuuuccaaccuugugaugguacaaaagugauaauuccauucuuguuuuucacuuaaaauacaguauucaauaaguuacaugagauacucaacacuuuaguauaaaauaggcuuuguguuaggugacuuugccccacuguaggcuaauguaaggguucugagcacauuuaagcuaggcuaagcuaugguagguuagauguauuaaaugcaucuuuuuauuuacaauguuuucaauuuaugauggguuuaucaggauauaaccccaucauaagucaaggaacaucuauauauaaagagauuuauuaugaggaauuggcucaccugauuauggagacuggcaagucccauaaucuguugucugcaagcuggagaccaaggaaaguugaugguguagucccaguccaagucuaaaagucugagaaccagguaagccaauggugaaaguucuaguccaagucuagucuaagggcagaaaaagaccaauguccuagcucaagcagucggucagagggagaauucucccuuccucugccuuuuuguucuauuaaggcccucaacagaauggauaaugcccacccauacuggggagagcaaucugcucuacucaguccaccaauucacauguucaugucuuccagaaacaaccucacauacauacccagaaauaauguuggaccaaauaucugggcauccuguggcccaguucaauugacauauaaaauuaaugaucacagggugcagugcuuggcaguguacaucacagugaccauguuuauuuucuccacagugaggucaccaagaauucccuggagaaaauccuuccacagcugaaaugccauuucaccuggaacuuauucaaggaagacagugucucaagggaucuagaagauagaguguguaaccagauugaauuuuuaaacacugaguucaaagcuacaauguacaacuuguuggccuacauaaaacaccuagaugguaacaacgaggcagcccuggaaugcuuacggcaagcugaagaguuaauccagcaagaacaugcugaccaagcagaaaucagaagucuagucacuuggggaaacuacgccugggucuacuaucacuugggcagacucucagaugcucagauuuauguagauaaggugaaacaaaccugcaagaaauuuucaaauccauacaguauugaguauucugaacuugacugugaggaaggguggacacaacugaaguguggaagaaaugaaagggcgaagguguguuuugagaaggcucuggaagaaaagcccaacaacccagaauucuccucuggacuggcaauugcgauguaccaucuggauaaucacccagagaaacaguucucuacugauguuuugaagcaggccauugagcugaguccugauaaccaauacgucaagguucucuugggccugaaacugcagaagaugaauaaagaagcugaaggagagcaguuuguugaagaagccuuggaaaagucuccuugccaaacagauguccuccgcagugcagccaaauuuuacagaagaaaaggugaccuagacaaagcuauugaacuguuucaacggguguuggaauccacaccaaacaauggcuaccucuaucaccagauugggugcugcuacaaggcaaaaguaagacaaaugcagaauacaggagaaucugaagcuaguggaaauaaagagaugauugaagcacuaaagcaauaugcuauggacuauucgaauaaagcucuugagaagggacugaauccucugaaugcauacuccgaucucgcugaguuccuggagacggaauguuaucagacaccauucaauaaggaagucccugaugcugaaaagcaacaaucccaucagcgcuacugcaaccuucagaaauauaaugggaagucugaagacacugcugugcaacaugguuuagaggguuuguccauaagcaaaaaaucaacugacaaggaagagaucaaagaccaaccacagaauguaucugaaaaucugcuuccacaaaaugcaccaaauuauugguaucuucaaggauuaauucauaagcagaauggagaucugcugcaagcagccaaauguuaugagaaggaacugggccgccugcuaagggaugccccuucaggcauaggcaguauuuuccugucagcaucugagcuugaggaugguagugaggaaaugggccagggcgcagucagcuccagucccagagagcuccucucuaacucagagcaacugaacugagacagaggaggaaaacagagcaucagaagccugcaguggugguugugacggguaggacgauaggaagacagggggccccaaccugggauugcugagcagggaagcuuugcauguugcucuaagguacauuuuuaaagaguuguuuuuug

SEQ ID NO: 18811 - RNA, 2557 nt, Homo sapiens
guucccucuacccuaauaaggcuuuggcgccucucccagaacucgguaaguucaaaguguaguaaagugcauguuuccaaggaaucaucugaaaugauuuuguagauaguuuauugcagguuggagaagggagaaaaugaaggaagggguagagggggcaauuaucacgcaucguuuugcuaucguauuugcaaggggaagaaaaucucaaugcauacaugguucgaaagugauuauuuagacaguaagcaguuuccccaggaaagcuccucagagggucuccucgcaggcugcagauucuagaaagucugcggaagaguaguucgcaggugcaugugucugggcgaagcgcugcguguggcucaguugguggcagucucugccucuguccgcagguccuggggaaugcucuuugccugguccagccccgacaaacguggucugagaacagcggagcgcggaaaccgcggagcaugacuccuccgaagcugcgagcgucgcugucgccgucgcugcugcugcugcugagugguugccuccucgcggcugcucggagggagaaaggggcggcuagcaacguggcggagccgguccccgggcccacuggcggcuccucgggucgcuuccucagccccgagcagcacgcgugcagcuggcagcuccugcugcccgccccggaggccgcagcgggcagcgagcuggcgcugcgcugccagagcccggacggggcgcgccaccagugcgccuaccgcgggcauccggagcgcugcgcagccuacgccgcucgccgcgcgcacuucuggaagcaggugcugggagggcugcgcaagaagcggaggcccugucacgaccccgcgccgcuccaggcccgcuugugcgcgggcaagaagggccacggcgccgagcugcggcuagugccccgcgcguccccgcccgcacgccccaccgucgcgggauucgcgggggaguccaagccccgggcccggaaccgggggcggacccgggagcgugcguccggcccagccgcugggaccccgccuccccaaagcgcaccgcccaaagaaaaccccucagagaggaagaccaacgagggcaagaggaaggcggccuugguccccaacgaggagcgacccauggggaccgggcccgaccccgacgggcuggacgggaacgcggagcucacggagaccuacugcgcugagaaguggcacucccucugcaacuucuuugucaauuucuggaacggcugagacugccugccggcuuagggaggguugaugggggaggcguggggaagggaaagcuaagggcgucuuagaccgggggguacugugauagagauuggggagaaguccagguucucgaaugggggugggggcaaggguaagggugagaugcuugggaugagaguguaagggguauggagaaucucugggauagcagagaaguuaaaaauuuugaaaagucucaguccugauuaagagcaggaaaaauaauggaaacagaaauaggcguacuuuaaaugugcaaaaacuggagacuggggagagaaaucgaugcagagggaggcugagaauaagggggagauagagugacuaaagugaugugagucccauguggggagggggaugcaauguuuauuguuuaacauuucuauuaaaugcagccaugagcaauugccaaccugagccagguugaaucaaugucuucucacuuaaucagcuaacaagacugcagacuuuuuuuccguuucugaauugguauaaacuuggaugcggcguggugggugucauagauaaccucuauagggacagaagccucacaggucaaaacuggcuccaaggaaaguuuugcagaaugauuuccuuuccauucuuuuagaagagcuaccuuuuuuuuuuuuuuucccugacagggucuggcuugcccaggcuggagugcgguggcuagucacagguguaauaauaggcacugcagucuccaacuccuggccucaagggauccucacaucuuagccuccagaauagcuaggaguaggaguagcugggacuacaagcaugcacagcugcacuuggcuuagaagugcuacuuuauuuuuauuuuugagacagggucuugugucauccagacuggagcaguggugcaauuauggcucacugcggccucgacauuccagucucaagugauccucugccucagccuccggaguagccaggacuacaggggugugccacuagaagugcuacuuuuuaacgaaauggugacuaauguucuggaacuuucccauuaaccuucugcauuuagaaggaauuauagauguugagugcuccaguaaacagugauucucuuuauaucugauuuuuuuuuuuaaacagcuaaaauguaaguauguaucucagagucauuuugaccauuauggaaguuguaucucucuguuucauguaacuaauuauuaauauauuucauuuuuagugugauguaaugagagacuguguguguauguuaggugcucaauaaaaacuguaugguuagauuuaaagaaguggcaaggcaaugg

SEQ ID NO: 18812 - RNA, 61151 nt, Homo sapiens
ccgcaggagaggcuggcuccagcgccgggggcuucggaaggaguuucugccacccccacugccgccacugaccgccccgacgccacggccggggccggggacccugauaagaaauggcccuucagcccccuccccucaccuggcucggucccaccugagggcaagagcggaggcaaaaacaaacaggcagggagggcugaccuuguugcuaccgacaguggagcggcgcauccugcugcuuccuggaaagcggcccgaaagacauuuuuucccccuggaggaaggaaacgggagggcgccggccagacggcggcaggcgcggaggcguugguccgggcgggcugugcagccucuaguggagacgguccgaagacuacaucucccaggcugcucugggccgcccugcgucguaacccuggcgcgcacggaggcggcgacucuuaccucacaaagguagcuccuccgccggcagcaacucggcgcccgcgguccauggaccggaaccucgggccgacggacgggaacccgggccgcgaucgccgccuccccgccucaggcuccuccuccucgcucuccgccgccuccgccggacucccgcaggcccugcaccgccgccgccaggcuagcggagcugccccgggaagcugggugacggguucgcggcugccgccggacugcggccuacuccgccgccucucagugcuauugucccugggccuggccuugagcggguccacuggggaaggccgugugcgccggcuccgcggaagaugccggaccaagcccuacagcagaugcuggacagguacgggcagcugugggggggaccgggagccgccgacccucgcucuggcccugcccgcgcccgcccucgaggcucuuggugagcagaacccggcgugccgggaggaguuccacggccagggggccgugagaggggcaaaaaguuuggagucuagaccugggggaggacagagcgagcggccugggucguagacuuugggugaaacuuagcuaaggaguggcgucugguuuccuuggaaccccguuuugaccugagagggacuccuguuaauccacaaaauuaguuuuccuuacccucuuccccucccccuucccccuccccaacuugugaaguguuugucagcgaugucacuggcaagaaccggguuaucuuucaggggaaugacccccuuauaauuuuaagucucugucugagaaccaaugauaagcauucuuuuggaaagccugauaggcugauuucauucucccacuuucccugaacccgcaccccccgucccccccgccccaucccguccccaccuccgaacuguaaggucagaguauccgcaagggagauuuaacggucagaccagaguagagguuauggaaaacagccaaaugaguccaacgcugaacauuuaguguacuugacgaucguugaguucauugaagacguuucagcucguacaggaguccaguugcccauucuuggggggccccagucgguaaaacucuuugugaagucgggugcaccgcccucugcuguugaaauucugguccguggguccuaccaugaguuuuuggagacucuagauccacauuucccccgagccaagucuuacuuccuggcauagcaaguuguacaagcuaauucaugauguuugugguugcuuacaauucucaauagacaccacuugccacccauuucagcaggugguaccaacucuuuguacucaguaaaauuccaacuguaagguguuaaaugaaggcccucccuuaauugaguuuauacccaguuaaaugcuuuugggccugccacacccagaacacaaaugacccaaggguacacauccuuccagagugacagacauuuuuuuggagcuuagaauuuugagccaucucaguuaauaggaauuaugucacugauuuuuuucaguugagauaacuggugauucauccagcccuuguuucaggucaacauccugacaauuguauugacugcuuuauauauauaugugugugauaugugugugguuuauaagcucuuggaagcagaaacuuacuauuguuuaucuugaaucccagaacagagccugguacucaguagguaaucaguaaguauuuguuguaugaacuaaugcacaaacuuauuugucaguuuccccaguugucuagggggucugauaauuuaccagguuuuccuuucauuguaaauuggcaaauuguggcaaauuaaaauaugcccagaggaaaccaccugccacugccaguucuauucuguugagacccuguucugaugugggguauuuuguaguuaauuuuuuuccuuugagggccuccugcuuuucauuuuuacauagugacuuuuuuucuucuuuuuuugagacagggucucuguugcccagacuggaaugcaguggcaguggcaguggcauuggcaugaucucaacucacugcaacccccgccucccaggcucaggugauccuccuaccucagccucccuaguagcugggaccacaacacauaccaccaugcccagcuaauuuuuuguauuuuuauagagccagaguuuugccauguugccugugcuggucucaaacuccugggcucaagugauccucccgccuagccucccaaagugcuggauugucaggcaugagccaucgugcccagccuagaaaaguucuuauguccaaaagcugaccuaacuuuucauaugcucuuuggauauuuccauaaaaguaagaagccaaagagugagccugggcacgguggcucacccuuguaaucccagcacuuugggaggccaaggcaggcagaucacuagagcucaggccuuugagaccagccuagccaacauggugaaacccugucucuacuaaaaaaaaaaaaaaaaauacaaaaauuaggcaggcguaguggcgugggccuguaguuccaacucucgggaggcugaggcaugagaauugcuugaaccugggagacggagguugcagugagcugagaucgcaccauuguacuccagccugagugacagaguggaacuccaucucaaaaaaaaaagcuagugaggcauuuaaaacuuauuaacagaaaugcgaagauucuggcugccauuuacugaaguaggugacuaugacacuggcuuacucucaucuuuguacuacucucaucuuuguacucuuuugacauaccuuaagguagauuuuuaacaugacuuucaaagaccguuauugucuagauuaguaguuggcaaccuacuuccauguuagaauuaccuggggagcauuucagaauaugcauggaugcuggacuguaagaccaauaagaucaaaaauuucuguaggguagagccugggcaucuauauuuuaaagcuuuuuaaauguuuuagauauggcagaaaccuacugcccuaaguccuaagucagugauaucuuucaugauaagagauaguaggguauagugaguaaagcuugggcucagagauagaaaguaugaaauucgaauuuugccacuuacuagcuaugugacuuugaacuuagauucugacacuauguauauuaucauuuauaaaaugagaacccuacuucacagggcuacagcaaaugaaacauacaucucuauaaaacagcaaaacacucuauguuagccaaauagaaggcacuuaagacuaauguaaaccaguuuggccauuuuucccccaucuacuuuauguuuacagcuuucuucaccugggcuggcccuacugcaaguugaacacaaagauacucaacaugguucacuugaggaauaccaacagggccaagagacuaaaauaugucagccuauuaggacccagaauucuuuucaugaauuuggcuucuccccaaccugguuuuugguggcaauuuuugagggacagaauuuagcucagauaacuguucauuuguuuauuucuuuaaugcagguuuuaucuucgugaagacuaaggaacuguguguuacauauuguucuguugcuuuuagguuaaguuacguauuuuauuuaggccaggcacaguagcucaugccuguaaucccagcacuuugggaggccgagaugagaggauugcuugagcccaggaguuagacaccagugugggcaacauggcaagacucagucuuuacaaaaauguuaaaaauuaggccaggccugguggcacaugccuguggucccaaauauucaggaagcugagguggaaggauuccuugggggucguggcuguagugagcuguguuugugccccuggguacuacagcccagguaacagagcaagacccugucuuaaaaaaaaauguuauuuuucaguaaaucaauuauuaaacauuuacacuuauugaauuuauuuaacaaauacugagugucuucauaugcccaguacuauucuaggcccuugguauauaguggugaauugaacauaacaaaaaugcccuuauggagcuucaauuccagggguguuuguguugucuaaacugucaaagugaagacuauuuuaauuguaauaugaaugguauguucaauuuauaccauuuaaucuuucaggguuuuuaaacuagaggcaacuuuucuuuuuuuuuuuuuuuuuuuuuuuuugaggcgaagucucacucugucacuugggccaacuggugacaacuucuuuuauuuauuuauuuauuuauuuuuuauuuuuuuuuuugagacagagucucgcucagucgcccaggcuggagugcaguggcgcaaucuuggcucgcugcaaacugugccucuuggguucacgccauucuccugccucagccucccgaguggcugggacuacaggcacccgccacuaaggccagcuaauuuuuuuguauuuuuaguagagacgggguuucaccguguuagccaggauggucucgaucuccugacgucguaaucugccggaauugaccucccacagugcugggauuacaggcgugagccaccgugccuggccuguggcaacuucuuaauagcugaaguugaauucccuuguccuuugcaaauaacucacuuuaguuuagcuauuauuuguuuauauugguaacuuugauuacuguaauauuuguagguggaaagaauacauauacauacguauauauauacauacauacauauauauauggaauuuuuuuuuuuuucauggaauuucgcucuuguugcccaggcugcuggagggcaguggcgcgaucucgguucaccacaaccuccgccucucggguucgcgugauucuccugccuuagcuuccggaguagcugggauuacaggcaugugccaccacgccuggcuaauuuuguauuuuuaguagagacuggguaucucuauguuggucaggcuggucucgagcuccugaccucaggugauccaccuaccucugcuucccaaagugcugggauuacaggggugagccaccacuccugaccauauggauauauauucuuuggauugccuuucguuuuuauaaacuauaaguguuuuauguaaauuuauuauuugaaccuuuuaaguuguuguggggaaacaagaaugguggaaaggggggugauuuuucuagugucgugaauguuucagugucacaaauaucauuucccugaaaugauaaccauucauaagcccaaacccuuuaugucaggccuuuugaaccuuaguuagcucuucugucuuucauugcuucaauucuuuaauaagaaguuguuauauauuacuuucucuuugaccaccgacauucucauuuuucucuaaaacuucucaaaguuaggagugaauuuacagagaacaaugcaaagaauauuauaacaaacugcaggaauggaccucugauuugaagccuggaccuacugagaaaugcuuuuggaaacuacuucugcuucccccgucuuaaaauaaacacgcauuaauuuguugagguuguuuugcaucacuuacuugcaucuaguaaauaggcaaggaguguagccagaauguccccagaauggucagauggcagaaagagcagagagaguggucuauucuuccagcccccucccacaaugguauagugaauuagaauucugccucugugagaguguuauccacagauguauaccccuuugaagaccaaggaagcuauacucugauaggagcaugcuguauaaacaauuucacauuuucuuugucaguugaccucuuuuucucaaucacaucaccauguugacaauuacagaccaaugcccagaauuaaaaaucaucaucaauuauauuuauuuccagauauauguaaaaaauggaaacaucauagauaaaauuaaauccccuuugaccaccauccccaauggcauaucuucucauccccacuccacuaucauaaaauggguuuauauucuuccauccuucuugguuuaaugcuuuuauauagaaaaguauauuaauagacuacuuuuuuuuuuuuuuuuuugagucagggucuuacuccauugcucaggcuggaguggagggucacagucacggcucacuacagccucaaccucccaggcucaagugauccucccaccucagcuuccagaguagcugggacuacuggugugcaccaccacaccuagcugauuuuuuguauuuuuuuuguggagauggaguuucaccacguugcccaggcuggucucaaacuccugggcucaagugauccgcucgccucggccucccaaagcucccaaagugggggacuacagguguguuccaccacauccagcuuucaacuuuuuuuuuuuuuuuuuuuuuuugagacagagucucacccugccacccaagcuggagugcaauggcguggucucggcucacuguugcaaccuccaccuccugaguucaauugauucucccaccucaaccucccaaguggcugggacuacaagcacgugccaccacacccagcuaauuuuuuguauuuuuaguagagacaggguuucacuguguuggccagacugguucaaacucccgaccucgugauccaccugccucggccucccaaagugcugggauuucaggcaugagccgccacaccuggccuuuuuucuuuuuuaauccagucucguuuaugacauuuagauucuuauuuucucuuuauuauuuuuccugauaauuugacuuucauuccccuuucuugucauuagcucuacugaaaguguacugaagggcugggugcaguggcucacaccuguaaucccagcacuuuggaagaccgaggcaggccaaucacuugagcucaggaguucaagaccagccuggccaacauggcgaauccccaucucuacaaaaaauacaaacauuaguagggcauaguggcacauaccuguaaucucagcuacucgggaggcugaggcacaagaaucgcuugaaccugggaggcaaagguugcagugagcugagaucgugccacugcacgaucucucucucuauauauguauauguauacuaaaggucaccaauaauuucuuaguaaauauaaugacauuuucuucaggacuuuuuauccuucagaaucacguuaccuuuuucuuccuucaauuucuauguaugguucaauucucagcauuuacuauuuugagaaaguacacuuacucacucucuuuccuguuuauucaaacaacucccagaucugugucuuuauuccugaccucuuuuccucauuuccuuuagcaccuaauuucuaccugcccaguggacauuuccauuuguguguauacaguauugccaaucaaucuaaaacuaagcuacuuaucuugacuucucaauuuuuggucuuugauauuaccagucuucuuguccaccagcuauaaaacauaaauuuuauuuguuuguuuguuuuugagacagggucuggcucugucgcccaggcuggagugcaguggcccaucucggcuuacugcaaccuccaucccccacccuccggcucaaaauauccucccaccucacccuccugacuagcugggacugcauguccagcuaauuuuuguauuuuuaguagagacgggcuuucgccguguugcccaggcuggucucaaacuccugagcuuaagugacccuccugccucagccucccauagugcugggauuacaggcaugaagcuagccaaaacauaaguuuuucuuguuuucuuuguuuuuguuaaagaaacagggucuugcacucccaggcucaagccucccaaguagcuaggagcacagggcaagccagcaugcccagcuaauuuuuuuuaaacuuuuuuuuuuuugguggggagggggauagagacgggucucacuauguugcccaggcugucucaaacuccuguucuccaccaauccuaccuuggccucccaaaguguuaggacuacagguaugagcuaccuugcccggccuauuuacauuuuuuugcugccuucuuuccuuccagauccacuuguucaucacauauuguugauuuuccuuuuucuagcuucaauuuuucacuugguccaguuuggccuacagaguggcacuagaauuagcgaaggcacaauuauaaucaugcgauuucuauacuuaaaaaucugccagucucugugucacguaaaaggauaaaacguaaacuuucaacgggguaacgugcuuugaucuguuacuauaauccagccccaaccuaccuuaaccauccuuuccugcacuccccuucauugaccccugaacauauccugcucuuucauuucuuuauuuuugcuuuaggugccuuccucccuccuaacaccuggugaagucuuacccauauugaauucagcugaaauaccacagugacaccuugcacagcucccccaaacagaguuaauaacuccuuucuguguuucaauagaaccuuguugcauuuauuauaguguaucacauuguacuguaaauuuuuuaauauacuugucccaugucucagagcuucccacacacacacauauucaucuggaaguucacugagaacagaaacugccuguauucccuauccuauuuucccacaagggccuuagugcauaggagacccucuuuuguaucaugaugucuuucuuuucauucuuugugacauaucagugcuuagaauaaucaugcagaagcaccauuuuuuuaaauugccucauuugcucaaaacuuguauuuucuuacugcuuauugagauuaaguucagggcugggcacuuugggaggcugaggcaggaggaucgccugaucucaggaguuugagacccaccugagcaaaauacuaagacccccgucucuacaaaaaauaaaaaaguaaccaguguaguggugcaugccuauacucccagcuacucaggaggcugaagcgggagguucacuugagccugggagauugaggcugcagcaagccauuaucacaucacugcacuccagccuggguauaacaaagcaagaccuugucucaaaaaaaaaaaagaaaagaaaagaaaaaaagaucuggccgggcucaguggcucaugccuguaaucccagcacuuugggaggccgagaggagcagauugcuugagcccaagaguuugagaccagcgugggcaacauggagaaacccugugucuacuuaaaaaaaaaaagaaagaaagaaaaaauagcugggugugguggcccacaccuguaauugcagcugcuggggaggcugagaugggaggaucaccugagcccagguuauggagguugcagugagcugagauugcaccaugccacugcacuccagccugggccacagagcaagacccugucucaaaaaaaaaaaagagaucauauucuuuagccuguccuucaggacacucaccauuauucacagaccauuuauuaugcucccuauuauguuuaagauaugccguacauagcuggcaccaacugccuuuuuaaagccuuucuucucuuuaugaauaaguguauaaguacccaagucuuuugcccaagccaaacuggcuugcgcacuuucuuccaaacauaaggugguuuuuguuuuuggguuuuguuuggcaucuuuucuuucaaagcucuacccauuuuucaagaccuaguuagguucugccuuguuuauaaugcucuucugaccaugucugcagaaauauuuuucucuucuucuccagacucauguagcaguucaucuucagugccuccuaauucuuuuuuuuuuuuuuuuuugaggcagagccuucacucuguugcccaagcuggaaugcaguagugcaaccuuggcucacugcagccuccggguucaagcgauucucaugcuucagccucccaaguagcugggauuacaggugugugccaucaugcucagcuaauuuuuuguauuuuuaguagaaacaggguuucacuguuuuggccaggcuggccuugaacuccuggucucaagcaguccuccccacucagccucccaaagugcugggauuacaggcaugagccaccacgccugaccugccuccuaauucuuuacaugccguaguucacauagaugacaauauuuauauggcccauuggaguaaacugaaagggauuugccucucuggaggaagcacauuauggcugcuuuaaaguaccuuaguaaaaugaaacacguauuuuuuguacugcuguaauuuucuaagaaaugggaaauguaaaugugaauuuuucucugaauacacuauacauagggcagcauggugcagugaaaaaagcugaugauuuggagucauggcccagguugcauccaugccucucugcuuacuguguggccuuggccagaucacuuaaccuuucugggcuuuugguucuuguuuaagaugggauuaauugugcuuucagaguuuaugaacaucaaagacaaaaggcacggcaugaauauacuauacucaauaaaugauugcucaguauucguggggaauugguucugggaccucccaaggaugccaaacucuguagaugcucaagucccugauauaaaaugguguaguauuugcauauaaccuaugcacauccuccuguacacuuuacguucucucuagauuacauauaauaccuaauacaggccgggugcaggggcucacgccuguaaucccagcacuuugggagccugaggcaggcggaucaucugaggucaggaguuugagaccagccuggccaacauggugaaaccccaucucuacuaaaaauacaaaaaaauuagcugggcaugguggcacacaccugcaaucccagcuacuugggaggcugaggcaggaggaucgcuugaacccgggaggcagagauugcggugagcugagaccacgccauugcacuccagccugggugacaagcaagacucugucucaaaaaaaaaauaccuaaugcaguguaaaugcuaugcaaauaguuguuauacuguauuguuaugaaauaauaacaaggaaaagucccuccauguucaguacagacucuuuuuuuuccaaauguauuuuaccugagauuaguugaaugaacagaugcagaacccucaguuggagggcugacuguauucucaccuuuucuuuuugguaaugugucaugauugugguuauaugucuuugauagauccagguacuuuaacuuccauuccacuaggaugaacggacauauuagucucccuaauagugugcuuucuguuucacaauucuugggugugacacuuuuaauccugagacaaaauaagcaacacguaguuuucuuuuuucuuuuuuuuucuuuuuuuuuuuuugagacggaguuuugcucuuguugcccaggcuggagugcaauggcacgaucucggcucacugcaaccuccgccucccgaguucaagcgauuuuccugccucagccuccugaguagcugggauuacaggcaugcaccaccacacccggcuaauuuuguauuuuuaguagagacgggguuucucuauguuggucaggcugguguccaacuccugaccucaggugauccacccaccucggccucccaaagugcugggauuauaggcgugagccaccgugcccggccuaacauguagucuuuuucuuugucaaauagagcccuccuuacauuaaccacaguaugaaucuccaaacuuguucuaaauugaggagugcuuguucucuuuccuuagagcagucauguaaauacacuauuauggcaccauauauaauacaacagcagcaauuuaaagcuuauuccacgcuugcuuucuauauucucacucuucuauucugcuacauuccaauuuucaucacagugauuucucaggcaggagucugauuucccagaauuuccuaagaauccaaaagaaacaccugcaguuugagucugcaaaggcuuuacuaccagcuguuuuuuaaguuacuguaccuaucuugcuuaauuuagugccagugagaaacuaucuuuuugauaaauaaagccccccucacuuuuuucuacauacuuuaaaaauaauuaaccuguuugaucagauagacuguaaauuagucacaaaugaacccugugaagugagauugucuuuguuauucauccuuucccaacugguuuguaauaucuagcuucaucuuaaaaucuuucugcuccaaccacauuggucuaugaauauauguucauuuccaucucuaagcuugcuuacucuguuuuucuucaaauaccuuuucuuuccacucuaacuugaauucucaucuguaguuauuuccuuuucuugaaaccucagcuguuucauccuguuucuuggucucucaucacauuucuguauuaagguuucuaacaacuuuucuuggcacuuaaugcuugguauagugguuuuuuugugauccucguaugcauguuuguucguuaacuagacuggaaguuccuuacauguaguuccuuguggcaucaaauaaugaauguacuuauuagguacucaaguggauuuaggaggagaucuugaauaauguuagauuuagggcaauuuugucauguauauuccuuaaacuguuuauaaauuuuacuguuuacucuuuauuaguuuacuauauaacuggcaaaaaccaucauaauuuuaaaaucacauggaauuauauuacccauaccaguaagacuauacaucuguucuuaggaauaaguaauaguccuuagauuugucuaguuuaguucucuucuguugucuucauauaaugacagugauuuguucuuuguucccugaaccaaucaugauacuucccagaucuccuuuugcuuuguaaaugaauaugccccaacuuggugaauaggaugguguaggaguaacaucagcaaguagguggcauuuagaaaagcuaccagaaggguaauaagggugaaagaaaaugaauugaaaggguuuaaaugaaucuuaagaucuuaaguaguggcguggccuguugaaaaauuggggaaaugacuaggaauccagaacauuuuccacugaaugccagggugccaaguagaauugcuuuaugugcuaaugguaagaaaacugcauccauaaauuuuaggaacuugaauggaaagcugacaccaucacugucaucauugucaauguuguuauugcuaguggucauauggagguuauauaugugcuaggcaauuuuuaagcaguuucuuaaucacauguuuaaucuuuuacaauaggggaccuuaacauaaaacauuuuuuaugcuaaaacuccuuugguggucugguuaagccuauggguuccuucucagaauguuuuugaaagaauaaaacaaaauauauaggauuagaaaugaaaccaauuauauugaaguacagcuaucaaaauauuaaaagccuaaaauaguaauaugaacuuuaacacauuaaaauacaagauuuaucaguuggccugauaacauuuagcucauuguaauuugaaauuaguuauuucgggaucucuacagcuguaaaguaauaugaaaauuucugguugcuauacucauuucuaauugcugugcugcuaauauuacugugguuugcuugcacucauuauugaagaaaagcuacauuuuauuuagagcuuagcaaaaauaaacgugaugguuuuucuccccucauucagauuuaccgauccccacccccuaaguuuuucauggaccccagauuaagaaccccugcuuugcaacaacucugugaaagagauucuaucauuaaaccuauguaguuagcagggguuugaacccagacaaucuggcuccaaaguccagguucuuuaaccagcuagaauauccugaauucgcauuaucuuuuuccccaaauuaauuuaaccuuguuuccuuaggaaaaaauaccuuaagcauuuuacuuauuguuuaaaauuaaaaaccaaauaauuuaaaaauguuuacagugagcauaaaacaauuugauuucuauguuacggugaguuaagaauauuuacagggccaggcacgauggcucacaccgguaaucccagcacuuugggaggccuaagcaggcagaucacaaggucaggagauggagaccauccuggcuaacaagugaaaccccgucucuucugaaaauacaaaaaauuagccagacgugguggcacgugccuguagucccagcuacucgggagggugagacaggagauuugcuugaaccuggaaggcagagguugcagugagcugagaucgcaccacuguacuccagccuggacaacagagcgagacuccgucuccaaaaaaaaaaagaauauuuacaaaggaaaaaucagaaaaaaggaaggaagaauggcuagagcagaaguuuucaaacuuucgggaucaugaucaccugaugggcuuauugaaacaaagugcuggguacccccagaguuucugauucuguaggucuggggcaaggccuaaagauuugcauuucuaaugaguccccaggugaugcuuaugcaucacacugaggacugaguucugagagagucagaggauuggagaaaacaagaggaaaaauagauguaaggagaaacucuuaguuuggucagaaauuacaacuuccuuuuuccuuggguauggacuuugaguguuuugguuuugacuaauaauuaauuggcuauuuuccauuucaaaagacaaaaccaaaaacuagucccaucuacucaggaggcggaggugggaggaucacuggagcccaggagguccaggcugcagugagccgugauugugccacugcagucucaccugagcaacagagugagacccugucucaaaaauaauaaaaacucuuuagaguuuacauucuaugauuguacugaggccaucucuuaguacccaacacaguaacaagaucauuuugguugcacaugaugcaaugcgaauugguuaagucaaaaacccaaaaaucuacugcuuuaugugaguuaacaguacaagaauauauuuagcuuuaggcacagcacaucuugauccaugucucaaugccgucaguuuccaccuucacuucuucuggauucuuaaggcuccacuuaguugguggcucuccugucagcaauagccucacauucucugcuucuaagcccagaagaagagagaaagucuguauaccacuuuucccagcaaaaguucugagguucacuaagaccagcuuuauggacccagccucccaaugauguagucuggaagauaggcuacagcggccaaucugaguguuucugggguugguuaugguauucacugccuaaaccacacacacggcuaauguuggagggaagagcgauuuuccauagaaagcaugggauacuauuuacuccuagaagguagaaggacuuguguuguauguacauuaaacaucaaauuucuacuguccccuccauuccaagauguugagaaauuauaaaugaaucauuuucaaauagcucuucuccaucuuaaaaggaaggggguagagaauuggggaauaaaucguugaaguagauuaauuacauagagugggagggguaggguauggagaagcaaaaagggaaagcauaauuauaagaccuucccaggugauguuccuggucagucggaugggcaggcgcaguggcucaugacuguaaucucagcacuuugggaggccgaggcagguggauuacuugaggucaggaguuuaagacgagccuggccaagguggugaaaccccaucucuacuaaaaauacaaaaaugagccaggcguggugguggaugccuguagucccaguuacuagggaggcugaggcaggagaaucacuugaacccaggaggcagagguugcagugagucaagauugcaccacugcacuccagccuagguggcagagugagacucagucucaaaaaagggcaggggagggggcaggaagcuagacuauaugccugcaguccuagguaaucaggacacugaggcaggaggaucaccugagcccaggauuucaguuggagucuagccuggacaacagagccagacccaucucauaaaauaaggaaagaaaacaucugugugugugugugugugugugugugugugugugugugcgcgugcaugcacgcacgugcccuccccuccuuuuuuuuagcccuuaagacuagucacacucuuauaugcugauaucggccuaaagacauuugugugaccauuuuuacaugcuuuaauuuccccuuugcccaguccucauuucauagacugcuauucuuuccauacuagguagauuaaauuuaaacaacuaguaagauagcaaaucaguuaauaaauucuuuagaacuuaacauauuuggccaggcacaguggcucacgcccaaaacuuugggaauccaaggcaggagaauugcuugagcccaggaguuugagacuggucuaggcaacauaaggagauccugucucuaaaaaaaaaauuuuuuuuuaauuagcuguguguggccaggcgcagugggucaugccuguaaucccagcauuugggagccugaggugggcagaucacuugagguaaggaguucaagaccagccuagccagcauggugaaacccuaucucuacuaaaaauacaaaaacuagcugggcaugguggcgggcacccuguaauccuacuacuugggaggcggaggcaugagaaucgcuugaaccgggaggcggagguugcagugagccgagaccaccacugcacuccagccugggcaacagagcaagacuuugggcugcugguugcccauuuuuaugguuauuucuugaugauaugcuaaacaaggagaggauuauuuaugcuuccccccuuuuuuuuuuuuuugagauggagucucacucugucacccaggcuggagugcaguggcacgaucucagcuuacugcaagcucugccuccuggguucacaccauucuccugccucagccucccgaguagcugggacuacaggcaccugccaccacgccuggcuaauuuuuuuguauuuuuaguagagacggaguuucaccauauuagccaggauggucucgaucuccugaccucauaauccgcccuccucagccucccaaagugcugggauuauaggcaugagccaccgcgcccagccuaugcuuccccuuucuagaucauauaggguaacuucgugacguugccguggcauuuguaaacugucauggugcuggugggaguguagcagugaggacgaccaggggucacucgugagcaucuugguuaugguggguuuuagcuggcuuuacugcaaccuguuuuaucagcaguaucuuuaugaccuguauuuugugcugaccucauauaucaucuugugacuuagaaugccuuaaccaucugggaaugcagcccaguagguuucagccucauuuuacccagcuccuauucaaucaagacggaguugcucugguucacaugccucuaauacugcuauuucaacugaaagccuaacuccugauaaguacgcacucugaaucaucauucagcuaucuuauuuaccauaguugugaaauuaauuagaaaaaaaacugaaagugcauaagugcgugcguuguuuguuuuuuguuuuuuuuuuuuuuugagacggagucuugcucuguugcccaggcuggagugcaguggcgcgaucuuggcucacugcaagcuccgccucccggguucacgccauucuccugucucagccuccugaguagcugggacugcagacacccgccaccaugcccaacuaauuuuuuuguauuuuuaguagagacaggguuucaccguguuagccaggauggucucaaucuccugaccuugugauccgcccgcuucagccucccaaagugcugggauuacaggcuuaagccacggcacccggccaagugcaugcuuuaaaugucaguucuaaaaaguaaaucuguacaaguauuuaggacugaaauauacugaugccugcaacuuugaaaugcagcaaaaaauaagaauaaugaauggaugugugagaaagcaaauauagcagaauaagaauuauagaaucuaaauguuggguauauggguagucacugaacaguuuuuaacuuuuuuuggaaaguuugaaauuuuucauaauaaaauguuugggaaaaauaaaccuuaucuagaauuuauaaggaauauaauagcuacacaaguauucucauuagaucaaaauaugaaauuugaccuaucuuuucuguaagucagaaacagauuaauguagacuauuucaguugguucaaccuaguccuaacauuguauuuuauuuuucugaugacugaaauuggauuaauuuaaaaugugauucaccauaauacugauuaauuaugcugauguagcuauucuuauuuacguuuguguuaagaaaguaugagacuaaagagucucuaaauauucugccaguauuuuguugcuaaaaugauacauuccauuuccuagauguauacaaauauguccacaaaauuaccucaguuguggggaaaaauauauacuaacaacaucuuaaccagccugugugcuaguauacuuaccaauugaaauuuuaugcaaaaaucauagguuagaacccaguccuacuauggguagucuuggugguugcacaacaguaugaauauacuuacugccacugaauuauacaccuaaaaaauggcuaaaaugguagauuuuaugcuaugucuauuugacgauaaaauuuuuuaaaaaagaacaaaguauuuuuggacaaccauaagacaaugugaaggcccagacagcuuagcuaaagugggucaaaagggucagaaugcuaaacaaaugcuaccuacguucuaauuuuacuuagaucuuaugaaaccugacugaauuugaaagcugaauaaaacaacuauuuuggauauugaugcccuggauucaguucaacuuuuuuucuguucuaauugaaaaauuguaauuggagcacacaauugaaauucauguuguuccacaaggacuggagaaccucacccaucuauaauaccugaguauauagucuuucccacugagcauaguuaagcuaguuguucugacagaagccacuuauccaauuaauuaaaaagugcacaguagguaacaugcuuuaauuagcaguuguuuccacuuguacaaguucuaauggaggggaggagcgaagggucucauugaauugaacuguauuugcccugauggaaaucgaugucaaaacuuguguuaauugggagaaaaacugaggaauuacaaccuaauuccacaagaaaaaauuacaauucaugaaguacccuuaaaagcaaagugggaaaauguuuuaaaauuaccgaucucaauagaauuuuauuuuuauuaauauaagcaccccagacuugauacuucuagauuucagauuucaagcauacacgcccaaauuuaucauauugcuauucuaaaaaaaaaaaucuugauauauuuaucuccuuugugcuuuuuugaaaauguaauauuguuuucucucauguuuauacuuuaccggaaagaaaaauggguuuuuuuuuccucagcugaaaaauggaaugagacuguaugugaaaucacucguguaauacuuuguuuuuccaaguucaagggauuggugguggugaacuggggagaacacugaauuuaauauauuacugugcuuacuauuccucaaagaauuauuaggucuuauaacaaaaacaacuugagguuugucuccuugcacucugguucauuagagaaggugaagaauuacugaaaagauagaggagauuacauaaaaacaaaguucagaaaacauaaguucuguagaggaagacaaggaaaaacagaaaaaguagaaacugcucuagugggaauguauugguuguuuugucuccuuagucuuuuaauauaggacagagauucuguaauauaacauagcaggcucaucccauuaaguaagagcugcaguauagaggaggcuggaguccuaaagauauaaaugucauccuuuucucuuuuaauuuacagaaguugcuggguuuguuuugcuacugaugaagaugauagaacagcugaaugggugagaccaugcaggugcagaggaucuacaaaauggguucaccaggccugucuacaacgcuggguggaugaaaagcaaagaggaaacaguacagccagaguggcauguccucagugcaaugcugaauaccuaauaguuuuuccaaaauuggguaagaauaucuuuaaaaacaacacagauauaguugauguuauuauauauaacuuuauaaguucauuuuaaaaugaaccaccucuuuuuuuuagggugugaauuucuauauucccuuucucuuguuuccucucugaaugucagacauuuauuucuuuugcuaacaguuuacaguauccuuaauauauccccaaauuuauccauuugccuguguauuaacugucuguuugauagaaaggagaaagaacuugcauaccuguguggauauaauugaauaacaaagcucuaauaaaaagcugacuuuuaaaaaaaaaacuaacuuagcuuaauuaucuggagacgguguaagagaaagaaagcaguaguauguucuaauacuucuccuuaauucuuccuuuuaaggaauaaaaguagagaaauuaaauauuuaauaagaugugacguuaaacucaucuuuggaauccaauuuaugugguuucuuucaugaacccugcuaucccuuuucugugaaguggcagguaagaaauaaccaaagaucuuugagaacaggccuagcauggaaaaaaaguauagcagacugcuuacaagaagcauucuaaggcugcuucuuuagcagcaguauaacuaaggcugauauuuagugagccuguuccauuacagccauacaguuauaaauuggugucaaucucuugguuugguguuuauaccaugccaguuguuaaacauuuuuuuauaacccuugacuguaaccaagagguauaggaaggcagcuuggguucugggaaggucauaaggaaagaaugucuuugggggcagagggaauucaggaaaaauuggaaauaauuauuauauauauuguuuuuuauaagugcuauucauacugaaaucagaccaauguuuuugaaaauguggcaacauaaaugcagauaaugaagugcuuuucuaauaugagaagauuaauaauaagggcaaacaaaauguccuugguucucuguuuuucucuaacaugcacaggaagaaaugauagcuuccuuugaaggggaaguaguguaguagagaaaguaguguuuucaaacauuuggaauuuguggaccaugugaugggucuucagugcauaccacugauuuuagauaaacacaaaagaauaauucaaaauguuuuuauuguaagaucaaagaaguauuuuuaaaucaguaucaggaaaagcaaugauuguucacauuauuguaccaccacaugaauggugaaagacucacuaaaguccaaguuaagguuucauauuuaacugauuucuuuucuugcucuuaguuguacuaaauuagauagccccaccuuugaauuauagaguugggaagagcaacaauuaaauauuucuauuagauguuuuagauauucaaauggacacaaaaauuauuacaagaauucucacugaaaacuacaucaaguugacaaguguauggcacucgaaagcaaaguugaguauuuuaauuuuggagauggcaauguguagaucuguccuuuugguugaauucaguucuaggaaauauguuuucagguuuagugcaguaauugaauaugguuuuaagucuaccuaguuguuagaaaagaguaaaucuuggcugggcguggcggcucacgccuguaaucccagcacuuugggaggcagaggcgggcagaucacgaggucaggaguucgagaccaacccggccaauauggugaaacuaugucuuuacuaaaaauacaaaaguuagcuggacaugguggcgugugccuguagucccagcuacucaggaggcugaggcagaagaguugcuugaacccaggaggcaaagguugcagugagccaagaucgugccacugcacacaagccugggcgacagagccgagacuccaucucaaagaaaaaagaaaagaguaaaacucuuugguuaagccauuuguaucauuauuuagucugcauauuuuguuacuaagaauuguggccgggccgggcgcgguggcucacaccuguaaucccagcacuuugggaggccaaggcuggcagaucacgaggucaggagaucgagaccauccuggcuaacacagugaaaccccaucucuacuaaaaauacaaaaaaauuagccagccuugguggcaggugccucuaguuccagcuacucgggaggcugaggcaggagaauggcguaaacccgggaggcagagcuugcagugagccaagauagcgccacagcacuccagccugggagauagagcgagacgccgugcuaaaaaaaaaaauuguggcgggucacaguggcucacaccuguaaucccaacacuuugggaagcuggggcgaguagauugcuugagaccagccugggcaacagggugaaacuccaucucuaccaaaaauaacaaaaaaaaauuagcugggcaugguggcacacaccuguagucccagcuacucaggaggcugaggugggaggauugccuuagccugugagguggaggccacagugagcugugauugcgccacuguacuccagcuugggagacagagugagacccugucugaacaacaaaaaagaauuguggccagucaugguagcucacaucuguaaucccagcacuuuugaggcucagguggguggauugcuugugguuacgaggucaggaucagccuaggcaacauagcaaaaccuugucucucuacaaaaaagaaaaagaaaaagaaaaaaaauuagccaagugugauggagcacaccuguuguaaguccuagcuacucgggaggcucagcugggaggaucacuugagcccaggaguuuggggcugcauugagcuaugauugcgccacuacccucuagccugggugacagagugaaaccaaucuuaaauaaaagagagaauuauaauuuuacucucaaaugauauguucaagcuggucacuauacugucugucauagagguauggcacuugaguuagccgcuuaaaaucauagauauguuuuaaugacaucaguguuauaaaaaaaaaugaauauccgcugggcacgguggcucacgccuguaaucccaacacugggaggccaaggcaggcggaucaccugauaucaggaguucaagaccagcuuggccaacauggugaaaccuugugucuacuaaaaauacaaaaauuagccaggcgugguggcaggcgccuguaaucccagcuacuugggaggcugagguaggacaaucacgugaaccugggaggcagagguugcugugagccaagcucacaccauugcacuccagccugggcgacagagcaagacucugucucaaaaaaagaaaaaaaaaaguauauccuucauuugaguagguauuguuagcauauuuccucuugacaaaacagaaaaacagaguauuugcugcugcugcuuccccccgcccccccccgccaauagagguugggucuugcuauguuguccaggcuugucucaaacuccugggcucaagcaauccaccuaccuuggccucccaaagugcuaggaucacaggcaugagccacugugugcccagccugccgcugcauucuuaacaugcugaagauaccuauucaagggcugcaauuuuaauuauauucacaauuuuccaugcaguuauuaacaaugacucaagccagcuguugucuguaaaugaagccaugugugaauuggcuuucagguggugggcucuucauugcugcacacaaagcuagugcucuagcuaugcugauuccagcacaacuuuucaauucaaguuucaaaaauaauuguugguuaaaagaaaauaucuucuucuaaaacuuuuaaaaaguugcuuguauuucuugauuaacauguuacauucguauauacuaagaguugauucguacucuguacgcuaguggcuucaugcagccauuaaacaaaauacuuaagagccugcaucugugauaauaauuguucuuccucucuguauaacacacguagcacguaauguccgauagugucaucugaugauagaauuuugccaguagauuguuuuguuucugucugagcacauuugucauuaauuuugcagcugacaguaguugaaucuguuuuguuaaaagaaguaccuuugacuauuauuuugaucuuuuaaugacagaauucauaguggaggcuuugguugguuuacuggaguuguugaaaaugauaugaacacuucaguggcuucuugucccuauuuaauaauguaucacaauacggugggaacaaggaugucuccuaguacaguguuaucacuccuaguucacuggucacagcucauucuaagaucagucuucacuauaaaaucauacuauuaucauuuauggcauucugaguuaaauguauuuuucacuuuuacucuuuugaaccauugauucauuucccuaaauuugggauuuaacacaauaugauaguaacaauaaaauacauauuuaaccaauguaaacaacucacaugauguggaaguauguuagcccuuuccuuuucauuuuccuuauuaugauaguguuuucuuaacuuacccuaguagagcuugggugauccuuagaauguaacagcaauaaagaaccuaaaaggauuucugugaaagucauaaucuccucaaauuugugaaauauuugugaucaaaacuuuuaucacuuuuuucucaaacugucuguagaccaaauagauugccagggacugccauugguccccaaagacacuugauaaacacugacuagaagaaggaauaaaagaagauacagagagggaaaggugaugaugguuaauauucuaugggaugaucucuaugcagcagauuuuguguuuuuuuuuuaacuuuucaaaugaauuuagccccagucuggaugaugcuagcuggccaauucugcaucuuuucugguacuuagucauggcaggaaugaagagguaauauaaguguauguucuucauuguuaauagggaguuacuuauuguacucaguugugaaaaacuuaagaggauucgucagaguuuuauccuucucacuguuugccacccauguuacaguuugcuuuuuucuuuuuuucuggugagccaagccaguuguauguauguaccuacuuaaaaccuugcuacucaaaguaugaucugaggaccagcaacauuagcauugucuggcaguuauuaggaaugcagaacaccacccccuuccuccaccccacuuuuacugaauagaagucugcuuuuuuuaauuuuuauuuuuuaaagacaguguuuugcuuuguugccuacgcuggaguacagcagcaugaucauagcucacugcagccucagacuccugggcucaagcagucuucuugccucagccuuccaaguagaugggguuacaggcacgugccaccacacccagcuaauuuuuuuuuucuuuuuagagagggggaucacuauguugcccagucucaaacuuccuggccucaagggaucccccucccaaaccccguuggccuuccaaaguacugagaauguaggcaagaaccaccacacccagcugaaaugugcauuuuaaugagauaauugagugauuucuaugcacauuaaauuuaaaaaccauugcuuuaaaacaugaaaggaauaccaacugaaaaaaguuuguuuuauaaauaaaaccuguccauaaacuuugagaccugguaauaaccuuguucaggcagaagaauucagaggagagcaucucaaagguagagagaucuugacucccaagggacugauucacacuagauuuauuuucuuuuauuauuauuauuuuuugagacggaucucgcacugucaucuaggcuagagugcaguggugcgaaguuggcucacugcaaccucugccuccuggguucaagcaguuucuccugccucggccucccugggauuacagacaugcgccagcacgccugacuaauuuuuguauuuuuuguagagacaggguuucaccacguugcccaggcuggucucaaauuccugaccucaggugauccacccaccuuggccucccaaaauccugggauugcaggugugagccaccacgcccaggcaagauuuauuuucuuuaacuucucucaacauuguuuuauaguuuuuagauuuuuuuuuuaguuuuuaaauuuguuucuaaauauuuuguucuuuuugauacauuguguaaauggaauuguuuucuuaacuuuguuuuuagauuguuuaaguauguagaauacaauuuuuguuuucugucuuggaacacaaucagcaacaauugauuuuuguaaauugaccuuguauccugugaccuugcugaacuugcuuaauaauuuggauacuucuugauggauuccuuaggauuuucuaauauaagaucaugucauuguugaacagaaauaguuuuacuuuuuguuucccaaucugaaugcuuuuuuuuuuuuuuuugaggcacagucucgcucuguugcccaggcuggaguacagcgccaugaucucagcucacugcaaccucugccuccuggguucugucaguucuccugucucacccucuccaguagcugggauuacaggcacacgccaccaugcccagcuaaguuuuguaguuuuaguagagacaguguuucaccauguuggccaggcuggucuagaacuccugaccucaggugauccacccgccuaagccucccaaagugcugggauuacaggugugagccaccaugccuggcccaaugugaaucauuuauuucauuuucuuggcuaauugcccugguuauaaccuuuagugcaguauuaaauagaagugaugaaagcagauauccuuggcugggagccguggcucauaccuguaaucccagcacuuugggaggcugaggcaggcagauugcuugagugcaggaguuugaaaccagccucggcaacauagcaaaacuccaucucuacuaaaaauacaaaaaauuagccaggucuaagagcacaccuauagucccagcuacucaggaggcugaggcgcuagaaucacuugaacccgagaggcggagguuucaguguaucaagagaaugccacuggacuccagccugggcaacuggagugagacccugucucaaaaaaaaaaaaaaaaauggcuaggggcccacaacuguaaucccagcauuuugggaggacaaggcaggcagauugcuugagcccaggaguucgagaccagccuggggaacauggcaaaacccagucuccacaaaaaaauacagaaaauuagccagguaugguggugugcaccuggggucgcagcuacaaacaauaaagggagagagaaagaacggaaaaaaaaaaaacagacauccuuaucuuguucuuguucuuagggggaaaucauccaaucuuuucuuuuuuuucuaagauggaaucucacucuugucucccaggcuggagugcaguggcacaaucucggcucacugcaaccucugccuacugcagagguugguacacgugauucuccugccucggccucccaaguagcuggaauuacaggcacccaccaccaagccuggcuaauuuuuguauuuuuaguagaguugggguuucaccauguuggccaggcuggucucaaacuccugaccucaggugauccacccgccucggccuccuaaagugcugggauuacaggcgugagccgcugugccugacgacuuuucaccguuaacuauagccguacuacacuguacuuaauguuuaggucaauaacaaccacaguggugguccccuaagauuauaauugagucgaaaaauucccaucaccuuguggcauuguagcugugguaacauaguagugcaaugcaucauucaccugauuguggugaugaagguauaaacaaaccuguacuagcagucauauaaaaauauaacauguaacaguuuuauacaguacauaaugcuugguaauaaaugacuguguuacugguuuauguaucuacuuuacuuuuuuuuuuuuuuugagacggaguuucgcucuugucgcccaggcuggagugcaguggcgcgaucucgacucacugcaagcuccgccucccggguucacgccauucuccugccucagccucccguguagcugggacuacaggcgcacgccaccaugcccggcuaauuuuuguauuuuuaguagagacgggguuucaccguguuagccaggauggucucgaucuccugaccucgugaucugccugucucggccucccaaagugcugggauuacaggcgugagccaccgcgcccggccucuacuuuacuuuuuaucauuacuuuuaaaaaauuuuguguguuuguuuuuuguuuuuuuguuuuuuguuuuuuuuucugagagggagucuuacucuguugcccagguuggagugcaguggcgcaaucucggcucacugcaaccuccgccucccagguugaagcaauucuccugccucagccuccugaguagcugggauuacaggcaccugccaccgugcccagcuaauuuuuguauuucaguauagacaggguuucaccauguugaucaggcuggucucgagcuucugaccucaugaucugcccgucuuggccucccaaagugcugggauuacaggcgugagccacugcaccuggccaaaaaaaaaaaaaaauuucuuuucuuuuuuuuuuuuuugagacagagucucacucuguugcccaggcuggagugcaguggugcaaucucagcuuacugcaaaaaaaauuuuuuuaauauagagacagggucuuacugugucacccaggcuggagugcagugucaugaucauagcucauuguaaucuugaacuccugggcucaagggauccuccugcuucagccucccaaauagcugggacuacaggugcaugccaccaaaccuggcuaauuuuuuuuuuauuuuuuguagagacaaggucgugcuuuguugcccaggcugauuucucucuucugacuuacaggggccuuccuuccuuggccucccaaagcacugugauuacaggcaugauccaccauacccaaccacuuguuaucauuauuuuagaguauacuucuuuuacuuaaaaaguaacuguaaaacagccucaggcauauccuucaggagguguuucagaagaaggcauuauucucauaggagauaguagcuucauguuuguuuuugccccugaagaccuucuagugggacaagauguagagauggaagacaaugauauuaauugaugauccugacccuguguaggccuaggcuaauguguguauuugugucuuaguuuuuaacaaaaaaguuuaaaaaguaagaauaauaaauuuuaaaaauagaaaaaagcuuauaaaauaaggauaaaaaauuuuucgcacaacuguacaauauguguuuuaagcuguuaauacaaaagagucaaaguuaaaguuaaaaguguauagaguuuaaaaguuacaguaagcuaagguuaauuuauuauuaaaaauuauaaauucaguguaauaaguguacaauguguauaaagucuauaauaguguauaguaaugucuuaggccuucacauucacucaucacccauucacugaaucacccagagcaacuuccagacuuccagccuuggaagcuccauucaugauuaaguguucuauacagguauaccaucuuuuaucuuuuauaccauauuuuuacuguaccuuuccuauguuuaggaacgcaaauaccauuguauuugccuacaguauucaauacaguaacaugcugugcagguuuguaggcuaagagcaguaggcuauaccauauagccuagguguguaaauaggcuacaccauaccgacucugugaugugcacaaaacuacaaaauggccuaaggacacauuuaucccuguguguggauacccaucauugaguaacacgugaguguauguuaacuggguuuuucagagauggccuuuaucagguugaggaugucccaucuauuuguaguuuguugagggcuuuugucaugaaaaaguguuggguuuugucaaaugcuguuucucugucuauugauaaucaugugaguauuguucuguauucuaauaauauggcauauugguugauuuucauauuagacucgccugggguuccugggauaaguucuacuuggucauguuugcuaguacuuuguugggaacuuuugugucuguacucauaauggguauuggucuguaguucuuuugugacaucuuugguuuuggugcuggaaucauacuggcucauaggauaaguugggaagugaucccuccuuuauguuuuuuaaaagaguuugugaaggauugguguuuuaaauguuugggagcagugaagccauuugguccugggcuuuucuucauggaaaauguuuuaauuacuaauucaaucucauuacuuacaggucuauucagauuuucuauuucuucuugaauuaguuuugauaguuuguaucauacaaauuuguccauuucauguauauuaucuaauuuguuggcauauaguuauuuauaguauuuuuuaauaauccuuuucauuucuguaagauugguaguaaugccccuuccuuaauucaugauuuuagucauuugaaucuucucuuuuuuucuggucagucuagcuaaagauuugucaggguuggccaggcgugguggcucaugccuguaaucccagcacuuugggaggccgaggcgggcggaucaccugaggucgggaguucaagaccagccugaccaacauggaaaaaccccgucucuacuaaaaauauaaaauuagccgggcaugguggcgggcaccuauaaucccagcuacuugggaggcugaagcagcagaaucacuugaacccaggaggcgaagguuucagugagccgagaucacaccacugcacuccagccugggcaacaagagcgaaacuccgucucaaaaaaaaaaaaaaaaaaaaaaaaaaaagauuugucagaguuuuuucuuucuauucuugcauucucuguuucauuuuuauccacccuaauauuuauguccuuucuuccuucugcuugauuuggguuuaguuugcuuuucuccuuuuaguuucuuaagguagaagauuaguugacuugggaucuuucuuuuuguccuuuuuuuuuuuuuuuuuugagacagggccucacucugucaaacaugcugggaugcaguggcacaaucucagcuugcuguaaccuugacuuccugggcucaagugauccucccaccucagccucccaaguagcugggacugcaggugcucaucaccauacccagcuaguuuuuguauuuuuuuuuuuuuuuauagugacaggguuuugccauguuguccaggcuggucucauacuccugagcucaaguaaucagcccagcuaggccucccaaagugcaccaucacaucuagcccuuuuuuuuuucuuucuuuguuuuugagauggagugucgcccugucgccaggcuggagugcaguggcaugaucucagcucacugcaaccuccgccuccuggguucaagcaauucuccugccucagccuccugaguagcugggacuauaggcgugcaccaccacgcccagcuaauuuuuauauuuuuaguagagacgggguuucaccauguuggccaggauggucuugaucucuugaccucgugauccacccaccuuggccucccaaagugcugggauuacaggcgugagccaccgguccccagccaccuucuuuauucuuuuucagucuugccauguugcucaggcuggagugcaguagcuguuaacaggugcagucauaguacacugcagccuugaacucaugggcucaagugaucuuccugcgucaguauccugguuagcugggaguacagguguaugccacugcacccagccccucuuucuguuucuguuauuuuuaaauagauuuuagagccuuuuuagguucacaguaaaccauaugccagccuccaccccugaccacacacacacagagugcugacuacuuuccccacuaucaacaucuuguaccagaguguuacauuuuuuacagucagcgaacuuaaguugacacaucauuaccacccagaguguccauaguuuacauuaggguucacucuugguuuugacaacuguauaauuuauaauguauaaaggguugauucaggguuuugacaacuguauaauaacauguauccaccauuauaguauuauacagaauaguuucacugaccuaaaaauccucuaugcuccaucuguucaucccuccccgagcuccuggccaccauacaucuuuuuuuuucuccaugguuuucccuuuuccacaaggucauauaguuggacucguacaguauguagccuuuucagauugucuuucauuuaguaacaugcauuuaauuuccucugugucuuuuuguagcuugguagaucauuucauuuuaguacugaauacucuuacauugucuggaugucccacaguuuauccauucauguacugaaagacaucuugguugcuuucaaguuuuggcuauuaugaauaaagcuguacacauccauguacagaauuuuguguggacauaaauuuucaacucauugggguaaauaccaaggagcaugauugcuggauuguaugauacaaguauguuuaguuuuguaagaagccuugaaacuauccuccaaaguggcuguaccauguaccauuuugcauuuucaccagcaauggaugggaguuccuguugcuccacauccuugccaguguuuuugauuugggucauucugauagauguauagagguaucucauuuuaauuugaaauuuucuaaugacauaugaugugaaacaucuuugcauuuguuuauaugccaucuguauaucuucuuugaugagguguacacuuuaaaaucagagugauaguuuucucauuguugaccuuuaagaguucuuuggauauuuuggauaaaaguucuuugucagaugucuugggcagaucuuuucuccuugguugucuucucauucucuuaaucuuucuccuuuucuuucuuucuuucuuucuauuuauuuaucuauuuaugagacggagucucacucuguugcccaggcuagagugcaguggcacagucuuggcucacugcaagcucugccuccuggguucaugccauucuccugccucagccccccgaauagcugggacuacaggcgccugcuaccacgcccggcuaauuuuuuuguauuuuuaguagagacaggguuucacuguguuagcuaggauggucuugaucuccugaccucaugccgcacccggccucucauuuucuaaugucauuuacaacuagaaguuuuccucuaagcacugcuuuagcuguauaucauaauuuuuguuggguuuucauuuaucucaaaauauuuucuaauuuuucuugugauuucuucuuugacucacugauuauuuaggaauguaguguuuaauuuucacauauuuguaaauuucccagauguccuucuguuacugauuuuuuuuuuauuucauugugaucagagagcauacucugucugauuuuuuaacuauauuaaaacuuuuuuuaauggccuaacguagguuuauccuggagaauguuccaugugcacuugagaaaaacauguauucugcugcuguuggaguagucuauaaaugucuaguugauucugguauuuucaaguuuuccauuuccuuguuaucuuuuaccuguuuauuauuuaaaauagaguggugagugguggcuugugccuauaaucccagcacuuuggaaggucgaggcggggggaucauuugcgccuagaaguuaaagaccagccugagcaacauagugagacccugucucuacaaaaaaaaagaaaaagaaaaacuuuagccaggcaugguggcacaugccuguggucucugcuagcucaggaggcugaagcaggaggauugccugagcccaagaguuccagacugcaacgagcuguuauugcacugcugcacuccagccugggcaacagaguaaaaccuuaugucuuaaauaaaaagagagagaguggggcauagaagucuccaauuacuguuaaauugccuguuccucugguuccauacgucuuugcuuaauuuauuuuggcgcucuguuaagugcacauauuuauaauuguuaggucaagugcacauauuuauaauuguuacgucguccugauggauugucccuuuaccauuauaaaauauccuuuuuuguuucuaauagcaauuuugucauaaaaaucccuugaccaauauuuguauagcuauuucagcucucuuauaucucauuaagaguaaauucuuaguuuucaaguuaaauuuuugucaucuuuauuuuauuauuuauguauuauuuauuugagauggagucuugcugugucgcacaggcuggagugcagcugcacgaucuuggcucucugcaaccucugccucccagguucaagcaauucuccugccucagccucccgaguagcugggauuacaggugugcaccaccacaccuggcuaauuuuuuguauuuugaauagagaugagguuucaccauguuggccaggcuggucucaaacuccugaucuccagugauccgccugccuuggccucccaaaguucugggauuacaggcaugagccaccgugcccagcuacucuuauuuuauuguugcucuuauaacuaaacauuaauugaaacuucuuauauagaauuuuaccaguaaccauccucaaaaagugguugucaaauguuaaguggaguguaaaugcuuagaagggaaagauuuucacuagggaugaauaggaccaauuccugggagaaaccuuccuagagaaucuaggauauaaaauuaauaguuguaacuauuuuauuuuauuuuacaauaaauaucaauagcuaucauuugcuaauaggccccuauugccuauucuuccauucucuguuucauucuaggcacuaugucgaucacuuugccuauauuauuuaaaccucucgaaagcucugcauaauagauauuguccucaguuuguagauaagaaguagacucagcaaauuuauguaauggaagcccaugggcuuccagcaaauaaagcaaggagccagaauuuuacacuggcaaauuucuuguuacugucacucagugagucagcuaauaggccacauauggauaaguaguuucuaguaccauaagaacuaauagagauaaugugaauuugaauuaauuugagagacuguuaauaaauuacacaaaugauguguaaguaacaaaaauuuuaugaguugguaccacuagaauugaaagacaaguguauugccaaaaaacaaaaugauagcuaggugccugcacuaacaaauugccuguucucuuuucuuucuugauauuugcuuugcuagaaauggaaaggaauagcaaauacaucaaagagaagauggagcaacugcaauaucucauaagcaguuuuuuuuuuuuuuaacucauuugauguuuaaguuuauauuuuucccccagguaaugcauugacacagucaaaaauucaaagacacgagguacaguaggauauuuaaugaaaagucuuucuacuaugucugccagccauggugccaaguaaguuuucuuacuugguuauaaauuauaacuaucguuauaaauuucugguauuucauugcaguuuguuucucuuuuucuucucucuccuucauucuucuccucucccucucucccuacacuuacacagaaucuacaaacguaagaguuaaaggaacaucaagggagagggaaguacccaggguuuagcaagcuacuugcaagcuacuugcaaugagggaaccagggaaaaaaacuuuaacacuuuuaccacucucugauguucuggucucuccuaucauuugaacacaucagaaacuagagggcaagguugccuaaacuuuuuuuuuuucuuagcaguauaucguagauaccauuuuguauucauauaugaagagcuuuuuuuuuuuucuauuaaaaguagccuggauaaagagcuuuuuaaaaaaaaaaacuguguucauacauagauguaugauuacuuauauaaucagucuuccuccauugauggacauacaggcuuguuuccaaucuuuuacuguuauagacaguacuuucauaaacaacuuugggaaguaauuuuaugcaugugugcaaauacaucuguaagauaaaugacuagaaauagaauuacugggucaaagguaugugcauuuauaacauaauggauauccuauaauuggcuuuuguagagauuacacccauuuaaucucccaacgguguauuggagugccugcuuccccauugccuuugccaacaugcugcuaucaauacacagaacuaguuauaucugcugccuuagcauugaccaaagcucagcagaaugcucacucagguauuuuuuuucucuuuuauuaugaaauauuucauuuguggaaaaggaauauaucgcaguuucaugugagaagagauaaacagggcgaagucaacaacacccuugaaaaagcuagcauaaaagggaaaaaaaaaguaaguuuacaguggagaaauguggcaaacacuacaacagccaaauaaucaaggucauuaucaccaguaaugauucauguagguauuauguacauuugaucugaugcaaugagaauugcacuuugccucucuggucuucuucccugaaacuccuaacuccaagagauaaugagaaaaacaccagacaaauuccaguugagggauauuauacaaaauaccuggucaguacuccucaagauugucaaggucaucaaaagcaaagaagucugagaaacugucauagccaagaggaguguaaggagacaugacuaaauguaauucacaugucuuuauucuguuccagaaucuuauccaagauaccacauuacauuuagucaugucuccuuacacuccucuuggcuaugaccuugauuauuuggcuguuguaguguuugccacauuucuccacuguaaaguuacuuuuuuuuuuuuuuuugcccuuuuuugccagcuuuuucaauggugguguugauuuugcccuguuuaucucuucucauccuuuuauuuuuaauucuuuuggguucuuuuuuacauuuauugugauacugauauagcuggauuuuuaucaucagauuuugugcauucuauuuguccuacuuuuuccuuuaaguuuuaugcuuuauuucucuaccuaagugguuauucuugaaaagucuuggcuuuuaucacuucagauauugcuuuucccccauucuuuccauucucauuuuguagaacucugaguagaguuauauuagacauuuuuccuuuuuuuguuaugauagaauuuuucauuuccugggcuuuguuaugcugauacacuacgaacacuuggcuguuuaauauguugcccuauccucugcauuuuguguaaacugguguuuagaucuugucagugagguuauuauauauauauauauauauauuuuuuuuuuuuuuacaggaauaucugauagauaguuugugugcuucuuauugcaucacaucacaaggcacauaauguguaguuguucuuuuuaugauaagaccgaucaguguguauagguguuaucagccugauccauucaguaaaguugccuauucauuuccaccuaguuuuagcagagauugauaauuuauuuuucauugccucuagguccauuguuucauuaaguaauacaaaacauugucacucuaauguuuucauucuuucuucauuuauuggcuuagaaaauuuauguuaucaaucaagaagagauugcugagucagaggguaaauugaacauagaauuuugcuggguauugccaaauuuccugccacaggugcugaaucauuuuguguauucaccugcaauaugugagugugccuauuuccucaugcuuugccaguaggauguguuagcaaacugagauuuuagccagucuguuaagaaaagauaacuuauuguaguuuuaauacacauuucuuuaucagugaggaggcuaaaccauuuuaaaguaagaauacuuagauuguaaaaggguacuauagaguaagaaauauauuuuccccaaacuuaaaacuucauggcuucaauuuuauggggguuuuauauuuuugacugauaaaucccaagguaucaguuacuccauaaaaauacuccccauuguuuuuccucuagccacauggccuucugucacucacaugaacucaaccuauuucuuuucugccugcucauaaaauauaucauugguuuauuucacuaccuaaaaaacaaauauggacuuaagaacucaaguacucucuucauauuaauaaaaguuucuaguaauauuuacacuuagccuucagagaaauguuuucuuuuuacuuugcuauauagaaguuccuauguaugaucaaaauaaagaaaaauuuaaaaaccuaaguccuauuccauagugauuuagucuuugaauaaucuuuguugucaaaguuuauaguuagagaacucauuuagucuuuuuugagacagagauuugcucuuguugcccaggcuggagugcaauggcacaaucuuggcucacuguaaccuccgccucccggguucaagcaguucugccucagccucccgaguagcuggaauuacaggcuccuaccaccacgcccaacuaacuuuuguauuuuuauuagagacgggguuucaccagguuggccaggcuggucuuaaacuccugaccucaggugauucacccgccuuggccuccaaaagugcugggauuacaggcaugagccaccaugccuggcccuucauuuagucuuuuguagcccucauugguuaccuucuugugaggcaaaugacuaggauaccuucagaauaagaguuccuuuuguuuacugcuggaucauguuuggucuugcucccuaagucuuaaaaguagauuaguuuuaagaaguaucuuucaacagugugagacuuucuggguacacacuguauaugaauaaaaguagcugaauuacagguccaaaacauaacuauacaaucuuuuuuuaaaaggaggggaggauaacugcucuuuaucaagagaaucuaaauucucuugaugucuucauuuucccuuuacauugccagauuucuuggcuccuuugacuccuuccuuugcuccuuguccuggaucuuuaaggaaaagggcaccuauucuuuauuucucaccugaggauuuccugaaauugucuuauuuguauuccagagcuauauaccacaaguuuuuucucagacaccugcugucuuugauuaugccuucuacuccacuguccuauaauguuuaacaucguuugcccuuuuggggugaccauauaguuuagaacuggaagaaauaauagcugacacaagaucguuacuacguaacauuaaguacuaagagcuucauaugaauuauuuuaauuuuuacaaaaacucugauauacauaacaccuucauuguacagaugcagaaauucaggcccagagauggcacuuugucccaauucacacagcagacccaaccuaauccuuacccaccuuguuuuguuacagccuaaugagccuaauacacaaccuucucauauacagggaagaagaaaauucagugguaaugucagguuaccuuccucaggguaaugguuaccugaaguuuauaacucauuguucuuuucuaaaauacaguuuuucuuauuaauaagaacaauuauauuaucaucauggaaaaugugaaaaauauacacauauguuuaaagaaaaaaagacuguguuauacaguuaacuggcauauauguaguaugugcauaauuagugcugccagcuguuuuuauguguuaauaaaggaugauuggugguggugacuuuuuucagcaaaguuuuucacuuccaguuagaaggcucuucuuagcaugcccugcuugguuuuaccuugauucaguugugcuuuuucuucuucacuuggaauuggccuucuuuucacaucagagacuucaaguuuaggucaagauucauuuauuuaaaaaaacaaacaaaacaaacagcaauuuuuaaaaacuguuuguauccuuaccuccuccccccccauaaucuuuaccuaaaauuuucuuaacaucuguauaguuuguaccauacuaucauaucuuuauuaauuuugcauuggaaguuuucaguuguuuuauguauauuguuugucccuaacuagauuguagacuccuagggggcagcagcuaguguguuaaauauaauuuacauuuauuuuaauacguaguaaaauguguuuacaauagaugcuuaauaaguacuuaguaguugaccuuacagcucacaaguauucuguagccuauuauuuuaugaguauaaauuuaaaauuucccuuggcauaaauuauauaaucauaaggaacuacuguggugaucuucagugauuaaucauggaaaugcaauauaugaauuuauagauauagcauauauaacuauguaccauauauauuuucauauauaaucauauauauguuuuuauauauaaucauauauauguauauauaaucauauauauguauauauaaucauauauauguauauauaaucguauauauauguauauauauaaucguauauauauauguauauauauaaucacucaucugcuuugaccugaagucuuuuauucuucaggguuguuuggguuaguugguuuguuuguggguccuuuuuuuuuucuuuuuuuggucagauacuauuuuggaccaggcauagugucucaugucuauaaucccagcacuuugggaugccagucacuugaagccaagagguugagaccagcuggggcaacauagcaagauaccauuucuacaauaaaauauauauaauuaacuuaguuaucuaaaaaguuguccaagaacauaucccuucuuuacaaucuaaugauuaaccuuuuguuauuaagcaaaguaacuuacagcguaaguuugcaggauguuuguucuuacauaaagauggugaaaucucaaacuaccagcagagcagucaaucagagaugaaacuuacauaagcgacuuuucuggggcucuuggaccuagccuccaaaguguaguguuuaaaacaguggggaaugcuagagaaagagguaaaacucuuuacuaucgcauuaggauuccccauccuuuuuuuuuuuuuuuuuuuuuugagacggaguuuggcucuuguugcccaggcuagagugcaauggcgcaaucuuggcucacuacaaccuccaccuccuggguucaagugauucuccuaccucagccucccaaguagcugggauuacaggcgcacgccaccaugcccagcuaauuuuuguauuuuuaguagagacaggguuuccccauguuggccaggauggucucaaucucuugacuuugagauccaccugccucagccucccaaaguucugggauuacaggugugagccaccgcacccagccucccacauacuuuuaaucaaguuuguuguauuacuugauaucuucaauaaaauucacauuuguuggccgggugcgguggcucacgccuguaaucccagcacuuugggagggcaaggcgggcggauuaccugaggucaggaguucgagaucagccugggcaugugaaaccacgucucuacuaaaaauacaaaauuagccaggcauggugacacaugacuguaaucccagcuacucgggaggcugaggcaggagaaucgcuugaaccugggaggcggaggaugcggugagccaagaucgcaccauugcacuccagccugggcaacaagaguaaaucuccgucuugccaaaagaaaaaaaaaaaaagaaaaaaaaaauucacguuuguuggcuugggaccauauaauuaauacuuuuuuuuuuuucccuuaaaauguccauuuaacaacagauugagucaaguacuggccacagaguacuguggcuagguccugugccauuauauuccagugccuuguagaaaaggccaaagugccccauacugccaaguaccaugugcugagauagcuguggcccagaggguccuugagagugaugccaaucaucauuaaaaagcauuuuuuaagcaccgaucuguacaugguucuguccuaggcacuguacaaaacgaguuaaacagacauggcccuugcccccugggaguuuucagucuaagaugaugcugacauggacagacauaaaggauauugagacaacugaacaaacauugaacaagaacauaaaguacuaacauuaugcacaagcaaagggguaaguguauuuugugggguaguauguaaaggaagccucaugggacauggacagggugggguagucagccucuaucaaguuaaguuagucuuugcugagaaguuggauuuuuauacagauuuaaucaaaguaaggacaggacauuccagacauguagcaaaaagacuuggagcaaggaugaaaguuuauauuguuaaacugucaguggccucaaaaaucuguacuucuggguggcucugaaaaugggguuggugucuuagcuuuagaaaguugccauuugagggccgggugcagugccucacgccuguaaucccaucacuuugggaggccgaggcggguggaucauuugagaccagaaguucuagaccagccugggugacauggcaaaaccccaucuccgcuaaaaauaaaaaaauuagcuaggugugguggcauguaccuguaaucuuagcuacuugggaggcugaggugggagaaucgcuugaacccgggaggcagagguugcugugagcugacauugcgccagugcacuccagccugggcuauagagcgagacucugucucggaagaaaguuggcauuugaguuuggucuaggucgaaaucaguucaaugcaaagcaaaaagcaaacagaaaaaacaugggaacuugaguggcuucugugagcagucugucuugcuuguugaaucucuuuuauaaauuauuggccacuuaacagaaggaacuuaucgucucagaaacuuauaccagguugucuuguaaaguaccuguuuaugcucauuaaaucauguucuguguuagaaacuuucgcacaacaaaguauagaauuauguuucucugccaguccaagugcauugguauuuacaacuaauugaucacaaccaguuacauauuucuuuguuucuucuccacuccaacagcuucacuugacuagccucuaggaguucuggguguuauuauaagcaaugccagcaaaugcugaacauuaaguauuaccuaccugcccuucagucauugacuucugaacuuccaagguguaccuuuagcagccaaaauauaaauuuuaauuuauauuacaguggcagcaaaaaucuacuuuuguuugcuaugucugccagacaaaacugauuacuucuuuuuuaguagacauugacuuacaagccccaguaguucucagcucacuuuuuuaugucauucaugucugaaacgugaaaacuugaauuuacccagaauauuaggguguaguuguucucuuuacaaaagcuucuuuauuauacaaaagaaguaauaguuucccugcuaauuccaagcuucucuggugcccuuuaaauuaauagauuuucaaaacuuaauauuuauacaaagcuucaguugccauucguuauguaaauacagugcuauuagaaacauaaguguugaggcccacuaaggcauuaaaaauucaauaauaccuuuugaaaauauugaaacuuucucaagccccuauauauuuaacuuguaagguacauuuauuauaguucuuccucuccaccagaauuaagguuuucaaaggcugcugucuugccuuuuucuacuucccauaacuuuuugugguguaaucugacagcaauaagaaucuaauaaauguugcuuuuuuccuaaguuuacaaccccuggccccaaaucaugagauaguagcacauaaacuucauaggaagaguaugaauuagagacuguccuccaaaagauuucagugauuguucuuacucaccaaauagcuugccagauaaucuuuagcucucagaaauaccuccccuggguggcaguuuauuauucuaaugguaugcuuagcacuaggcauuuaucuuuucuuuuaaguauuaagcuaaucuuagacuagugucuggaaaagccuuaagagauuuagacaaaguaaacuuaagagaaaagccaagacagaauuuugucagaaaaacuagaauuaggugcuauaaaaugcaaccuuugccuccauuuuaucugguacaucuuuugccuauaacacaagagaugaguagaaaauuuccaaagaggaaauaugaagacuuuuuuuucuuauucaaaagaauucacacccaaugauucaggaagaaaauugagcuuguuagaagcuucugagaucuuccaaggaaaaacaagaaaaacaauucaaacaucuguaggcugucacuguucaugauagauaaaaguaauagugauggguuauauuuuaggaauuaugcuuucauucaaauauuugaauuuuguuuuaaggaauuauauugcuuuacuccaucaguagguaguuccaaguacaagacaauucaguucaacaaaugauugagaguaguaggaacuugggguaaaucaaugaugaaaacaaagaucauuuucccuuuggagguuuguuuuuguuuuuuugguuuuuucugagacggaguuucgcucuuguugcccaggcuggaaugcaauggugccaucucagcucacugcaaccucugccucccagguucgagcgauucuucugccucagccuccugaguagcugggauuacaagcacacaccaccacgcccggcuaauuguuuguauuuuuaguagaaacgggguuucaccauguuagccaugcuggucucaaacuccugaccucaggugauccgcccaccuuggccucccaaagugcugggauuacaggugggagccaccaugcccggccuggagcuuauuuuccgaugcaaaaaucagcaaaccuuucuguaaagaaccagauaguaaauauuuuagacuuugcaugugcccauguuccaauaaaacuuaauuuacaaaaacaggcagaugucugaauuuagcauacaggcccuaguuucccaaccucuguuacaguaaguggaaacauaauuaauauguaaauuaggguauguuaugugauaagugcuuuaggaaaaagaaaaauagagcaagguaaucaaauggggagugugaugaaguagggguucguagggugggcuucauugaggucaagaagaagaggaaggggcaugguggcacacaccuguagucucagcuacucaagaggcuuagaugggaggaucacuucagccagggguuaagccagccugggcaauauaauagugagacuccaugucuaaaaagagaaagaaccagcaaaggagacugaaaauugaguagugaaauagaaagaaaaacgagagauguucugggauuggcccaguggcucacugcuguaaucccagcacuuuggaaggccaaggugggcagaucgcuugagccuaagaauuugagaccagccuaggcaacguggcaaaaccucaucucugcaaaaaauacaaagguuagccaggcgugguggugcacaccuguagucccagcuacuugggaggcugaagcagaggacugcuugagcccaggaggcggaaauuacagugagccaagaugacgccauugcacuuccgccugggugacagagugagacucugucucaaaaaaaaaaaaaagaggaaaacugagauuagauuuggcuaaauggagguugcuagugaccuugauaagcaguuuugguggaguggguucaaaacuaaggagagagauagagggccgggcgcaguggcucacaccuguaaucccaacacuucgggaggcugaggugggcggaucaccugaagucggaguucaagaccaaucugacaaacauggagaaacccugucucuacuaaaacuacaaaauuagccgggcgugguggcacauaacuguaaucccagccacucaggaggcugaggcaggagaaucgcuugaacccaggaggcaagagguugcagcagugagccgagaucgugccauugcauuccacccugggcaacaagagcaaaacuccgucucaaaaaaaauaaaaauaaauaaaacauauacaguucuucuggggaauuuuguugcaaagggagcaaugaaaugaagcaguggggcaaaaaggcucaagaaaauaauuugguuuuaauuuuuuuuuuuaacacugaagaaauaauagcauguuuguuugaugaggauccaguaaagaguagggagaaauuauguaggauagugggagauaauugcuggagcuguggccuugaguuggugaggggauaggaucaucuagugcauaagugaggggauugacuucagauggguggaauauugguugaugaguacaugugcuggagagcgucgauaaauguucucuuauggcuucaguuuucugauuaaaaaauuaccaggccaggcauggugguacaugccuguaauccuagcacuuugggaaacugaagugggaggauugcuugagccuaggaguuccagaccagccugggcaacacagggagaccccaucucuacaaaaaaaaaaaaaaauuuaaauaaagaaaauuagccaagcaugguggcgcacaucuguggucccagcuacuugggggcugaggugggaggcucgcuugagcuggggaggucaaggcugcagugagccauaaucaugccacuguacucuagugugggugacagagcaagacccugucucaaaaaaaaaaucgaauuaucaaccauacgaagguugaagugcugagguuuuauauauacuuacggucuuuaacuucuacuacuagcauuugagggaucuuuggugacuaagaugacuuuuauugugcuuucugaaggaguuauaaacuuaacccagcaaauuuguaugucuugagaauucagcacuauauucugagauuaaauaaugaugcauguaauaaugccuuuggcacagcacacagucucuuauagacccucaagaaaugcuaacuauuuauuagaggauauagaguuggugugcacuaaauuagacuuauuucaucucucuggucccagaagauaccuuaucauuguuuuaaauguuauguaaguuagagcuugacaguaauaaguaaauaugcuauacauauuauaaaugacaguccuuugacaucucuucuaauguucucucuacuuuacaauguauagucugucuucauacagugacauagcgauauuauuggcuccagugaucagcagggagucuugaucagaggcuccauagauggaugcuuuguucuuacauguuucauuauuuuaucaucagaauccuauguuaauuuauuuguauagggaaaauaaacaguuuuuguguauagcaucugccuuuagauuauaagcucccagaagguagguaauaauucuuacacauuucuaagaaguuuucauauuuuuuugguagcucacacacaccuguaaucucaguuacucgggaggcugaggcaggagaaucacuugaacccaggaggcggagguuguagugagccgagauugugccacugcacuccagccugggcaacaaagcaaaacucugucucaaaaaaaaaaaaauuaaaaauuaaauuaaaaaaauaaacuuagggccagaugcaguggcucaugccuguaaucccagcacuuuuggaggccgagguggguggaucaccugaggucgggagcucaagaccaaccuggccaacagggugaaaccccaucucuacuaaaaauacaaaaauuaguugggcgugguggcacaugccuguaaucccagcuaccugggaggcugaagcaggaggaucacuugagcccaggaggcggagggugcagugaaccaagaucccaccauugcaccccagacugggugacacagugagacucugucucaaaaauaaauaaauagcuggcugggugcgguggcucacaccuguaaucccagcacuuugggaggcugaggcggguggaucaccugaggucaagaguucgagaccaaccugacuaacauggugaaaccccgucucuacuaaaaauacaaaaauuagcugggcaugguggcagacgccuguaauccuagcuacucaggacgcugaggcaggaaaauugcuugaacccaagaggcggagguugcagugagccaugaucgcaccauugcacuccaaccugggcgacagagcgagacuccaucucaaaaaaaaauaaaaauaauaaauaaauaaacuuagauauucaguuauauuuggccuuuaaaucagggcugagacccuuccauucuucuggaaaauucuggagcuaaauuauacugggcuuaguggcagucagaauaccuccaaaugcugcuuuuccaaauaacuuucagaaggaaguaguagucagauuucagaguaagcauauaauaauagaacauaauugguacauagagcuguuggaaugcuauaaaaacuggcuucauaaucauaaaaagaaauuuguuagagaauaauauucaauuaaauacagcauauugaaaaucaaagagagauaaauugacauuauguaaauacaagaaaauggcccugguuaccuuuauguacuguaucaagguauacagugagugaagucagagaaaugauauucuuacuaaauacgagaaucuaauuguugccaggaauuugauggaaaaagcaagcugaaaugaccauuucacucuaccguggccaguaugauuaagagaugaaagugagaggacuauuuccuuuauaagaaguaacuauauuugagacucuaauuuuagguucaauaauaaagauaauuugaggaggcuguuuacgagaauuuaugaaguaauauuuagcuauucgugcaaaugacugagaaauucucaacuauucuagucuagguucccaucaaauuuauaacaguuauuucuaaagcaucaaaacauccaacuucaugaaaguauuuuaggcugaguguaguagcucaugccuguaaucccaacauuuugggagaccaaggcaagaggaucacuugaacccagaaguuugaggcuguagugagcuaugaucaugccacugcacuauaaucuggaugacaaagugagacccugugucuuguuggggggaagguauuuuagaucuauagaaaauaucaaacaagucauuuuaaaaguucacccuguguugaaccuuuacuucuuuucuguguguuauagguccagugguuuacgucuuggaucuugcagauagacugaucucaaaagccuguccauuugcugcagcaggaauaauggucggcucuaucuauuggacagcugugacuuauggagcagugacagugaugcagguucacuauuuuaccuauauagugauauuacuuggugugaagaucuauuaaaacauuuuuuguuagacauuuaaaaguguauuauuuugaauaagaaauaacauucucauguucuuucuaaauguuauuuccccuacuuuuucuuuacccaaaaaggagcauauuauagcuguaucucccuuuuuucauagugaaucuuagagaucauuucauauaaguaugcagaaaucugcauaacguucuaucuauagaauuacagccauuuacuaaccaacuugucucuuguggauagacguuuaguuaguccaauguuuugcuauaaaaacagugcugcauagcuugcaaucccagcacuucaggaggccgaggcagguggaucaccugaggucaggaguucgagaccagccuggcaaacauggugaaaccccaucucuacuaaaaauacaaaaauuagcugggagugguggcagguuccuguaaucccagcuacucaggaggcugaggcaggagaauugcuugaacccaggagccggagguugcagugagccaagaucacaccacugcacuccagcacaggcgacagagcgagacuccaucucaaaaaaaacagugcuacauagaacuuggauaaguggucaaaaauaaaaauuaaaaaaaaggaaagaaaaacagugcuacaaucaguaacugcugcugaauauuagagagacauaaauuucaaaauuuagucccaagccguugacucuucuuuuuauaccuucuucuuaaagauuuccagcuaucaacuuaguuuuuuuguguguucaggucuuuuguccuguucuuuucucaaauccagugcugcaaugaucucuugugacuucauacucaaaauuauugaaaucaaacuugucacuucuuccauuugaaaccuaaauuuauucuccgucaucguuccuuuguuucuguuucuauuuucccaucuauaguuuacauccuuuuuuuuuuuuuuuuuuuuuuuuugagacaaggucuugcucugcauagcccagauugggcaugugguggcacagucauggcucacugcagccucaacuuccugggcucagucaucuguccaccuuagccuccauaguagcuggaacuaugggugugugccuccaugccuagcuacuuuuuucuaaggauggugggaggggucucacuauguuaccaaggcugaucucaaacuccugggcucaagugauccucccacuucagccucccaaagugucccaaagugcuggagguacggguguaagccacugcacccagcccauccuauauuuuuagaauuacguuugacucuucaccccccucaauacuccccacaaaccgccccccgacaaaacaaagucuuacucugucaccaaggcuggaguacaguggcgcaaucaagggucacugcagccuuacuccugggcucaaacgauccuccugccucaaccucccaaguagcugggacuacaggcacacaccacuaugcccagcuaauuuuuuauuuuuuguagagauggggucuugcuguguuguacagacuggucucaaccuccuggccucaagugauccucccaccucagcuucccaaagugcugggaucacaagccuagugagcccaucuggccuagucuuucuauuuuauagccuucuauucaguccacugaccaaauacaagcaguuuuuccacuuugaugugucuugugucuguggcuuccuuuccacagucuuuaccaccugacuucuugucacuucaucauaccuggauggcuaaaggaccuucuugguuuaucugacuucauguucuucugucaauccauccuuccaaaugaauccucuuaaaauaguaccuucaaaaucuuacuccccagcuuaacaucuccauugccuuaaguaguagucuucaagagcagcaucuagauugguuaaguguuuccuaaguaacucuguaguagugaacacacuuagguuuguagaugauauaauuugcuuuucuuuaauauaaauuagaauuuacaugaacaaaaaaggaaugcuuggaauuuuaccuaauauuccaggaacugcauauguaucuaugccagggucaaaccuuuauggcuugcuccauuaauggucauggugagacagaguauuaugagacuuccuuauaaaaugaugaugacaucccaaaaauauggauacaguuaaaugaaucacaaacagugaaacauaucugacaugaguguagugaauaaaguuugagaaccacugacuugaacuuuagcaugauuugauacacaggguccucuguaaucguacuucguucugcuuuaaggcuguugggcugucuccuccaacccauccuuauguuguguaguuuuucaccucuguccuuuggcuuacgucaccuucccaaccuaauaccugcccuucuagucuucuguguacuuauccaaaucuaaacccuccuuccaggcuuagcuagcuuuccuccauagaacuuacaggcaacuccugccugcugugauuccuucuucccccacauucaugacauuuuuauuccucaaauggcagcuaguccugcccugaugaagugacauuucuuauauagauuaucuguuuaacuuuucuuguuuuuaggccuuauuuuuccuguuaggagguaauuuccuugaaagcagaguccauuuuaugcuucuguauucccuguuacagcaucuacauagaaacuaacacauuaaaggguuucauaaaucuuugugguuuuguuuuuuguuuuuuuguuugagacagaguuucgcucuuguuguccaggcuggaguacgguggcgugaucucagcucaccgcaaccuccgcuuuccggguucaagcgauucuccugccucagccucccgaguagcugggauuacaggcaugugccaccacgcccagcuaauuuugucuuuuuaguagagaugggguuucaccauguuggucaggcuggucuggaacuccugaccuuagaugaucugccugccucugcuucccaaagugcugggauuacaggugugagccacugcacccggcagucuuuauguuuuuuaugugaccacuucaaauaaugaguauuaguacaucaccugaggagggaggaucaggaugauuuacuaagacugagaaagacauagaaacuuagagcagauuauacauuauuuaauguacaaauacauuauauagauauauauauuuugcaaaugagauugaguuauuuucuuaagacuuuauugaccauaagaagugagauggcucuuuuuuaagaaagauuuuuaggcuggcacaauguuaaaagaauuuugauaauuaauggggcacuuguuaaaacacaaauaaauugaaaacucugauccccagcaucaagggauauaguccaagacaagacguucauaaaugaaaccacuggagaacaguuacagguuagauagauaaaugugauaagagggcagaagacuauauaaacaauauuuuaauucaguaaaagugaaagauaauuugauuugaaauuaugagaaaagucuugagcuaacccuuaaaggaaauaauuugaauugguagaaugaaauaagcaaggaagcaaaaacuauaguacacauauguguuaccauuuagaaauaaccuucacauguaaugucucacuugaaaagauuuuuuuuuuuuagcccagaaaugagacuagcuaugacaguagguggauaguguugugugauuuaagaguauugggaagaugacuuuuaccuuccugagcacauaugauagagaaugugccccucuacaccaucaguaguauuuaggguuugccuucuaacacuugauuguuuuucucugauuccuuaacaacccugcaguacaaguaaaccaaaucaaggaaucagaucacuguuauuuucccauuuauuuucuuuccuucuccauggaccugucauagaaucaauacuuuuuaguuguggggaacuugaauaggaccuuccucuugcauuuuuauugaaaagacaacacaauaauuuuuuuuucucggcacuguauugaacaccuagcacugaugcauuuaacccuugcaacaauuuuaugacauagauuauuguuauaaauuauuccuaguuuacugguuuagagaguuuacagguccagugccacacagcagagaagcauuaggacuccugucccuuggcuccuuaagugaagccuggucccagaggcagcuggaacauuuuauccuggaacaguggaaccuuaauauguuuagccuaguucccauuuuugccucuagugcaaagacagcccccauuagcauugcccauucuuaauuacaguacuuacuuauccuugauucugaguuaaaaaaaaaaaaacccuguuauuucaucacuguuucauccucuuguuaggauucuggccaggugcuguagcucaugccuguaaucccagcacguugggaagcugaggcaggcagaacccuugaggccaggaguuggagaccagccuggucaacaugaugaaaccccaucucuaccaaaaauacaaagaaaaaauuaggcauaguggcuguauucccagcuacuccggaugcugaggcgugagaaucgcuugaaccugggaggcagagguuguagugagccaagauugcacuccagccugggcgacagagcaagacucugucucuaauuaauuaauguagaauucuaauaauaauuuaaaagcucagaccuuaauuaaaacuguuagccuuucagcagcaaugaacugcaggccuaccuagauaugaaaaucuagcuuuuagcccuucugcaggaaaaacaaaaaauuauuuuucucuaaaccugcaauucuauaggucuuuuguuuuucucuuuuuuuuuuuucuuuuuuuuuuuuuugagacagagucucauucuguuacccaggcuggaaugcaguggcgcagucacggcucacugcauccucgaacucccugggcucaggugauccucccaccucagccuccugcacagcugggacuacauacacaugccaccacgcccugcuaauuuuuguauuuuuuguagagacaggguuucaccauguugcccagucucaaacuccuagacucaaguuacccaccuaccucagccucccaaagugcuuggauuacaggcgugagccacugugcccagccaggccuuuauuuuauacauagauaacaaauucuuagacauucuauauaauuccuggagcuuaccccaaaaucgaagucuuaaaaauaauguuuuuaaaucuugggacaagaaagcagaauguaugugauuacacacagguucacugacuuuguauuggccaaaauuaaaucaggccuauugcuuaaucaccuuucauuuauugccccugaguaugacuguuuuagcaagugguguacugcagguguuauacuaccuuauuucuucacaguguauauauuugcacacuuguuugguuugauuuucucucacuuucaaaagacaucuguuuaaccugccauuuuagccccagcacaaaaucauuauucagugaaugaaugaaugcaugugugaaugaugagccucaucccacuucuaacuugcuugagcauggggcaucucucuucacuuuaguuguaacaagugaaauacugggccuuugcucauucuuugcccuauuuccuucuuuuuuuuuuuuuuuuuuuuuuugagauggaguuucacucuuguugcucaggcuggugcaaucucggcucacugcaaccuccaccucuuggguucaagcgauucuccugcuucagccucccgaguaguugggauuacagaugaccaccaccacgccuggcuuguauuuuuaauagaaacgggguuccaccauguuggucaggcuggucucaaacuccugaccucaggugauccgccugccucagccucccaaagugcuaggauuacaauugugagucacagugcccaaccccuacuuccuuuuuguuuccuuauucuuaaacaccuuauaagguuuuuacugcuacccaugagaaacaaacuuccucuuguucgcucuagucuauaccugaauauucacucuucuuuauauuucuaaacccaaaaaaaggacacauaacccgacaaaggauuuuuucaaauauucugaauuuauuugcuaacacuuugagaauauuuaaucauauuuaguuauaauguuagagugaucauuauauugaaauuuuuaaugauauaaaaauagaauuucuuagccagacgugguggcacucaucuguaguuccagcuacucaggagggugaggugggaagauugcuugagcccaggaguacaaagccaaccugggaaacguagcaagacccugucuuuuuuuuucuuuaaaggaauuuccuggccgggcguggugggucacgccuauaaucccagcacuuuggggggccaaggcaggcggaucaccugaggucaggaauucgagaccaaccuggcuaacguggugaaaccccauuucuacuaaaaauacaaaaaaguagccagguguugugccaugugccuguaaucccaucuacucaggagguugaggcagaagaauagcuugaacucaggagguggagguugcagugagccaagaucaugccaagacugaaacuccgucucagauagauagauagauagauagauagauagauagauagauagauagauagauagauagaugauagauauauagauagauagauagauagauagauaaagaaauuuccugggaaaucauuauagguaaaacagucauggccagcuaacuuuugcuaccauuauggaauugggguuuaugaaauaucauaaaccagaccauuucacuuuagggcaacucaaaaggaucaccuuccacaugcaagauaggaaguuguuaaguucuaccuggagacacagaagaauaucaaauucgaugacauuauugaccauuaggaagaggcuagccuccugcccuuuaauauuacaucuuaauuagauaaauuaaccaaguggaaaucuggacuauauccauagcucaaauuugguccucuccacacacuuucauaaaacauuucuggggccgggcgcaguggcucacgccuguaaucccagcacugucggaggccgaggcggguggaucaccugaggucaggaguucgagaucagccugaccaauguggagaaaccccgucucuacuaaaaauacaaaaauuagcugggcguggaggugcacaccuguaaucccagcuacucgaaaggcugaggcaggagaauugcuugaaccugggaggcagagguugcagugagccaagaucgugccauugcacuccagccugggcaacaagagcaaaaaauuccgucucaaaaaaaaaaaaaaaauuuuuggccaggcacgguggcucgcgccuguaaucccagcacuuugagaggccgaggcaggcugaucaccugaggucaggaguucgagaccaaccuggccaacaugaugaaaccucgucucuacuaaaaauacacaaauuagcugggcaugguggcaugccccuguaaucccagcuacucgggaggcuaaggcagaagaaucgcuugaauccaggagccggagguugcagugagccaagaucacaccacugcacuccagccugggcaacacagcgagacuccaucucaaaaacaacaacaaaaagagguaaauuuaaggccaagauugauguggaagugaaaaggauuuuggagagagggaaaagguagaaguucacaaaugccaauuuuguauuucucgccuucugggaucuacaccaauuuagaaauagccccaagacuaggauaggguaaggaaaagauuguauuagcuucauuacccccauagauaggguacccuagaguuccugaauugggaaaaaugccugggaucuguaaccaaaacuggaccuccuacuacagucccucaauucuagaccuuggaagugcacuuaaggaggguuaggucuguaggguagacacuuagccagccagagacaucacacccuaucuuacacaccacuaaguaaggagaaagagccaaagagaaaugagcuuucaggccaucucuugaaggccgguccuaccucuuggcuggcuaugcuuaaucuccuagaaggaagaucaggaaaacaguuguuuugcuggaagacaaauaggacuuagaauuauaucccaguuccguagcccagucuaaccaaaucaaauaaaggaauagaagcaacaaucagagguccccgccccucuauuguaauguaaucagucugggucagccauuuuaauuuuuauuccugugugguaugaaauggcuugggaacuuuguuuuucccuugaaugagacauuucuuauaaauaaaucaggacugauagcuuuccagcuuauuuuuuaaacuuuuuauuucuguguauucuuuugaaauuaagcauuuucuauuaaaaaaauagagcuuaacaugcaacaccucauuugaaaaagaaguaauucuaauauaugcuaucuguuucacagguuguaggucauaaagaaggucuggauguuauggagagagcugauccuuuauuccuuuuaauuggacuuccuacuauuccugucaugcugauauuaggcaagaugauucgcugggaggacuaugugcuuagacuguggcgcaaauacucgaauaaacuacaaauuuuaaauaguauauuuccagguaaggcacugaacugugguuguaaagugcauaccaaauugaucuugaagaacaauaacaugcuuuuuuagccauguuugaagguagucuaacucuucugauuuauuagcacuaacgcacugcauuuuuuuccucuagggauagguuguccuguuccucgaauuccagcugaggccaauccuuuagcagaucaugucucugcuacucgaaucuuguguggagcccuugucuuuccuacuauugcuacaauaguugguaaauugauguucaguaguguuaacucuaauuuacaaaggacaaucuugguaagacggcuuuaacauuacuuauauuaccuugcaaaagagaaugaaguguauuuguuuuuaaaagguggggaacuguauaaauauucggucuguggcuccuaugcauuaagccucuauuugagccucacuaucauucaauagcuugaguggaaauaaaaagaggagaaaccacugcagcaguucuggccuuuuggaacuauguuguaggugcuuucucuccuggcauaugcaugaaucaucacaccugucccucuugccagugggauuacaguacuuuacgaucagaccaccugguucaaaucccaucacagaaauugucuugcugugaaaucuaaaucaaaugucuggacuuuuuguuccuguaguauggugaugguaauaaucaggauuauugugaggauuguauaaguacuagcacauaguaagcacucauguuguuugcuauuauuguuacucccacuucuccccucugguggcauguaaccugcacggaccuuggaggacugaacaaagggggcaaacgugggaauaaaagacaaagacaagagaguauauuuggaagaaggggucagggggcaccuugccucuaguggacaagggcccugagcuuuacacagcccucuguauuuauuaggcaaaagagauagugagaagcaggggugauugucggguaauugucaguccauuuggcaguuugguucacagcaggcuugcgagacugcaucauuugaacaguaggcgcuagauuucccaguagauaaguucaaggagcccugcaccagggagugauggcccccagcaaacccuuugguggcaggcucagugugaguuuacucacauccugcauucaugauaaacaguuugcuguuuggucauauagccuccaguggaaugcugaguuggucacgaucccuuuggccuuucuugcucccaacaguggcagucugcacauagugcccuagcauucuucuuuguauaucagaguauauguagaacuacauggaagaaagacuagucagaaaggauaauggagaaggcaucuguguccccuguuaccuguaguaacagcguauagucugucucucucccuaucucaucuccuaguagaaaaagaaaacuguuucauuugcagucaucugaauuaguuuagcaucaaagccuacgucuuuugugaucuaaauaaaauuauuuuuauuacucuguuucucuaaaucugcauuauaaaaagcuaauuuuccuuuuuauuuuaggguggaauugcguuuguugccauaaaaggagcauuuaaaguuuacuucaaacagcagcaauauuuacgacaggcacaccgcaaaauucugaauuauccagaacaagaagaagcauaaaacugacuucugguuguucugcaguucucucauccuuaugaaucuguuguguuguuuugauuccaucauuaaugcacuuguggagacuugugauaagcugcugcuccuauauuuuuuaagaaauauaauaaagcacuuagggcaggggaaaucaucucgguaaucauggaaccuaaggaugugauuuguuuucauuguuuguauguacuacuuuuauggcagucauaugaaccauuaucuuagcaugguaaaccuggguuuuguucauauuuucuccagacagaaaugcaaagaucaaacugugcaaauauuaaaaaaaugcacaugcuguuuuauucaaaugccucuuuuguacauguucauguuuaguguuuucucagaaucagcaacucaagguacuaugaggauuuuucucacugacauaauuugauuacauacuaaauaagaggauauguuaauaugaggaaauguaaauuaaauuaguuauaaauaaauaaccaaaaauguauguaaacauucaaaugauuaucugaacaaaugagauuuugugguguuuucuuuaacccaugugauguccuccaaaauguguaggguaaaaauucacagggcuuccagaucacuuuuucaauauuaaauuuuauuuacauaauguugacaucucauacuuc

SEQ ID NO: 18813 - RNA, 61151 nt, Homo sapiens
gaaguaugagaugucaacauuauguaaauaaaauuuaauauugaaaaagugaucuggaagcccugugaauuuuuacccuacacauuuuggaggacaucacauggguuaaagaaaacaccacaaaaucucauuuguucagauaaucauuugaauguuuacauacauuuuugguuauuuauuuauaacuaauuuaauuuacauuuccucauauuaacauauccucuuauuuaguauguaaucaaauuaugucagugagaaaaauccucauaguaccuugaguugcugauucugagaaaacacuaaacaugaacauguacaaaagaggcauuugaauaaaacagcaugugcauuuuuuuaauauuugcacaguuugaucuuugcauuucugucuggagaaaauaugaacaaaacccagguuuaccaugcuaagauaaugguucauaugacugccauaaaaguaguacauacaaacaaugaaaacaaaucacauccuuagguuccaugauuaccgagaugauuuccccugcccuaagugcuuuauuauauuucuuaaaaaauauaggagcagcagcuuaucacaagucuccacaagugcauuaaugauggaaucaaaacaacacaacagauucauaaggaugagagaacugcagaacaaccagaagucaguuuuaugcuucuucuuguucuggauaauucagaauuuugcggugugccugucguaaauauugcugcuguuugaaguaaacuuuaaaugcuccuuuuauggcaacaaacgcaauuccacccuaaaauaaaaaggaaaauuagcuuuuuauaaugcagauuuagagaaacagaguaauaaaaauaauuuuauuuagaucacaaaagacguaggcuuugaugcuaaacuaauucagaugacugcaaaugaaacaguuuucuuuuucuacuaggagaugagauagggagagagacagacuauacgcuguuacuacagguaacaggggacacagaugccuucuccauuauccuuucugacuagucuuucuuccauguaguucuacauauacucugauauacaaagaagaaugcuagggcacuaugugcagacugccacuguugggagcaagaaaggccaaagggaucgugaccaacucagcauuccacuggaggcuauaugaccaaacagcaaacuguuuaucaugaaugcaggaugugaguaaacucacacugagccugccaccaaaggguuugcugggggccaucacucccuggugcagggcuccuugaacuuaucuacugggaaaucuagcgccuacuguucaaaugaugcagucucgcaagccugcugugaaccaaacugccaaauggacugacaauuacccgacaaucaccccugcuucucacuaucucuuuugccuaauaaauacagagggcuguguaaagcucagggcccuuguccacuagaggcaaggugcccccugaccccuucuuccaaauauacucucuugucuuugucuuuuauucccacguuugcccccuuuguucaguccuccaagguccgugcagguuacaugccaccagaggggagaagugggaguaacaauaauagcaaacaacaugagugcuuacuaugugcuaguacuuauacaauccucacaauaauccugauuauuaccaucaccauacuacaggaacaaaaaguccagacauuugauuuagauuucacagcaagacaauuucugugaugggauuugaaccagguggucugaucguaaaguacuguaaucccacuggcaagagggacaggugugaugauucaugcauaugccaggagagaaagcaccuacaacauaguuccaaaaggccagaacugcugcagugguuucuccucuuuuuauuuccacucaagcuauugaaugauagugaggcucaaauagaggcuuaaugcauaggagccacagaccgaauauuuauacaguuccccaccuuuuaaaaacaaauacacuucauucucuuuugcaagguaauauaaguaauguuaaagccgucuuaccaagauuguccuuuguaaauuagaguuaacacuacugaacaucaauuuaccaacuauuguagcaauaguaggaaagacaagggcuccacacaagauucgaguagcagagacaugaucugcuaaaggauuggccucagcuggaauucgaggaacaggacaaccuaucccuagaggaaaaaaaugcagugcguuagugcuaauaaaucagaagaguuagacuaccuucaaacauggcuaaaaaagcauguuauuguucuucaagaucaauuugguaugcacuuuacaaccacaguucagugccuuaccuggaaauauacuauuuaaaauuuguaguuuauucgaguauuugcgccacagucuaagcacauaguccucccagcgaaucaucuugccuaauaucagcaugacaggaauaguaggaaguccaauuaaaaggaauaaaggaucagcucucuccauaacauccagaccuucuuuaugaccuacaaccugugaaacagauagcauauauuagaauuacuucuuuuucaaaugagguguugcauguuaagcucuauuuuuuuaauagaaaaugcuuaauuucaaaagaauacacagaaauaaaaaguuuaaaaaauaagcuggaaagcuaucaguccugauuuauuuauaagaaaugucucauucaagggaaaaacaaaguucccaagccauuucauaccacacaggaauaaaaauuaaaauggcugacccagacugauuacauuacaauagaggggcggggaccucugauuguugcuucuauuccuuuauuugauuugguuagacugggcuacggaacugggauauaauucuaaguccuauuugucuuccagcaaaacaacuguuuuccugaucuuccuucuaggagauuaagcauagccagccaagagguaggaccggccuucaagagauggccugaaagcucauuucucuuuggcucuuucuccuuacuuagugguguguaagauagggugugaugucucuggcuggcuaagugucuacccuacagaccuaacccuccuuaagugcacuuccaaggucuagaauugagggacuguaguaggagguccaguuuugguuacagaucccaggcauuuuucccaauucaggaacucuaggguacccuaucuauggggguaaugaagcuaauacaaucuuuuccuuacccuauccuagucuuggggcuauuucuaaauugguguagaucccagaaggcgagaaauacaaaauuggcauuugugaacuucuaccuuuucccucucuccaaaauccuuuucacuuccacaucaaucuuggccuuaaauuuaccucuuuuuguuguuguuuuugagauggagucucgcuguguugcccaggcuggagugcaguggugugaucuuggcucacugcaaccuccggcuccuggauucaagcgauucuucugccuuagccucccgaguagcugggauuacaggggcaugccaccaugcccagcuaauuuguguauuuuuaguagagacgagguuucaucauguuggccagguuggucucgaacuccugaccucaggugaucagccugccucggccucucaaagugcugggauuacaggcgcgagccaccgugccuggccaaaaauuuuuuuuuuuuuuuugagacggaauuuuuugcucuuguugcccaggcuggagugcaauggcacgaucuuggcucacugcaaccucugccucccagguucaagcaauucuccugccucagccuuucgaguagcugggauuacaggugugcaccuccacgcccagcuaauuuuuguauuuuuaguagagacgggguuucuccacauuggucaggcugaucucgaacuccugaccucaggugauccacccgccucggccuccgacagugcugggauuacaggcgugagccacugcgcccggccccagaaauguuuuaugaaaguguguggagaggaccaaauuugagcuauggauauaguccagauuuccacuugguuaauuuaucuaauuaagauguaauauuaaagggcaggaggcuagccucuuccuaauggucaauaaugucaucgaauuugauauucuucugugucuccagguagaacuuaacaacuuccuaucuugcauguggaaggugauccuuuugaguugcccuaaagugaaauggucugguuuaugauauuucauaaaccccaauuccauaaugguagcaaaaguuagcuggccaugacuguuuuaccuauaaugauuucccaggaaauuucuuuaucuaucuaucuaucuaucuaucuauauaucuaucaucuaucuaucuaucuaucuaucuaucuaucuaucuaucuaucuaucuaucuaucuaucugagacggaguuucagucuuggcaugaucuuggcucacugcaaccuccaccuccugaguucaagcuauucuucugccucaaccuccugaguagaugggauuacaggcacauggcacaacaccuggcuacuuuuuuguauuuuuaguagaaaugggguuucaccacguuagccagguuggucucgaauuccugaccucaggugauccgccugccuuggccccccaaagugcugggauuauaggcgugacccaccacgcccggccaggaaauuccuuuaaagaaaaaaaaagacagggucuugcuacguuucccagguuggcuuuguacuccugggcucaagcaaucuucccaccucacccuccugaguagcuggaacuacagaugagugccaccacgucuggcuaagaaauucuauuuuuauaucauuaaaaauuucaauauaaugaucacucuaacauuauaacuaaauaugauuaaauauucucaaaguguuagcaaauaaauucagaauauuugaaaaaauccuuugucggguuauguguccuuuuuuuggguuuagaaauauaaagaagagugaauauucagguauagacuagagcgaacaagaggaaguuuguuucucauggguagcaguaaaaaccuuauaagguguuuaagaauaaggaaacaaaaaggaaguagggguugggcacugugacucacaauuguaauccuagcacuuugggaggcugaggcaggcggaucaccugaggucaggaguuugagaccagccugaccaacaugguggaaccccguuucuauuaaaaauacaagccaggcguggugguggucaucuguaaucccaacuacucgggaggcugaagcaggagaaucgcuugaacccaagagguggagguugcagugagccgagauugcaccagccugagcaacaagagugaaacuccaucucaaaaaaaaaaaaaaaaaaaaaaagaaggaaauagggcaaagaaugagcaaaggcccaguauuucacuuguuacaacuaaagugaagagagaugccccaugcucaagcaaguuagaagugggaugaggcucaucauucacacaugcauucauucauucacugaauaaugauuuugugcuggggcuaaaauggcagguuaaacagaugucuuuugaaagugagagaaaaucaaaccaaacaagugugcaaauauauacacugugaagaaauaagguaguauaacaccugcaguacaccacuugcuaaaacagucauacucaggggcaauaaaugaaaggugauuaagcaauaggccugauuuaauuuuggccaauacaaagucagugaaccuguguguaaucacauacauucugcuuucuugucccaagauuuaaaaacauuauuuuuaagacuucgauuuugggguaagcuccaggaauuauauagaaugucuaagaauuuguuaucuauguauaaaauaaaggccuggcugggcacaguggcucacgccuguaauccaagcacuuugggaggcugagguagguggguaacuugagucuaggaguuugagacugggcaacauggugaaacccugucucuacaaaaaauacaaaaauuagcagggcgugguggcauguguauguagucccagcugugcaggaggcugaggugggaggaucaccugagcccagggaguucgaggaugcagugagccgugacugcgccacugcauuccagccuggguaacagaaugagacucugucucaaaaaaaaaaaaaagaaaaaaaaaaaagagaaaaacaaaagaccuauagaauugcagguuuagagaaaaauaauuuuuuguuuuuccugcagaagggcuaaaagcuagauuuucauaucuagguaggccugcaguucauugcugcugaaaggcuaacaguuuuaauuaaggucugagcuuuuaaauuauuauuagaauucuacauuaauuaauuagagacagagucuugcucugucgcccaggcuggagugcaaucuuggcucacuacaaccucugccucccagguucaagcgauucucacgccucagcauccggaguagcugggaauacagccacuaugccuaauuuuuucuuuguauuuuugguagagaugggguuucaucauguugaccaggcuggucuccaacuccuggccucaaggguucugccugccucagcuucccaacgugcugggauuacaggcaugagcuacagcaccuggccagaauccuaacaagaggaugaaacagugaugaaauaacaggguuuuuuuuuuuuuaacucagaaucaaggauaaguaaguacuguaauuaagaaugggcaaugcuaaugggggcugucuuugcacuagaggcaaaaaugggaacuaggcuaaacauauuaagguuccacuguuccaggauaaaauguuccagcugccucugggaccaggcuucacuuaaggagccaagggacaggaguccuaaugcuucucugcuguguggcacuggaccuguaaacucucuaaaccaguaaacuaggaauaauuuauaacaauaaucuaugucauaaaauuguugcaaggguuaaaugcaucagugcuagguguucaauacagugccgagaaaaaaaaauuauuguguugucuuuucaauaaaaaugcaagaggaagguccuauucaaguuccccacaacuaaaaaguauugauucuaugacagguccauggagaaggaaagaaaauaaaugggaaaauaacagugaucugauuccuugauuugguuuacuuguacugcaggguuguuaaggaaucagagaaaaacaaucaaguguuagaaggcaaacccuaaauacuacugaugguguagaggggcacauucucuaucauaugugcucaggaagguaaaagucaucuucccaauacucuuaaaucacacaacacuauccaccuacugucauagcuagucucauuucugggcuaaaaaaaaaaaaucuuuucaagugagacauuacaugugaagguuauuucuaaaugguaacacauauguguacuauaguuuuugcuuccuugcuuauuucauucuaccaauucaaauuauuuccuuuaaggguuagcucaagacuuuucucauaauuucaaaucaaauuaucuuucacuuuuacugaauuaaaauauuguuuauauagucuucugcccucuuaucacauuuaucuaucuaaccuguaacuguucuccagugguuucauuuaugaacgucuugucuuggacuauaucccuugaugcuggggaucagaguuuucaauuuauuuguguuuuaacaagugccccauuaauuaucaaaauucuuuuaacauugugccagccuaaaaaucuuucuuaaaaaagagccaucucacuucuuauggucaauaaagucuuaagaaaauaacucaaucucauuugcaaaauauauauaucuauauaauguauuuguacauuaaauaauguauaaucugcucuaaguuucuaugucuuucucagucuuaguaaaucauccugauccucccuccucaggugauguacuaauacucauuauuugaaguggucacauaaaaaacauaaagacugccgggugcaguggcucacaccuguaaucccagcacuuugggaagcagaggcaggcagaucaucuaaggucaggaguuccagaccagccugaccaacauggugaaaccccaucucuacuaaaaagacaaaauuagcugggcgugguggcacaugccuguaaucccagcuacucgggaggcugaggcaggagaaucgcuugaacccggaaagcggagguugcggugagcugagaucacgccaccguacuccagccuggacaacaagagcgaaacucugucucaaacaaaaaaacaaaaaacaaaaccacaaagauuuaugaaacccuuuaauguguuaguuucuauguagaugcuguaacagggaauacagaagcauaaaauggacucugcuuucaaggaaauuaccuccuaacaggaaaaauaaggccuaaaaacaagaaaaguuaaacagauaaucuauauaagaaaugucacuucaucagggcaggacuagcugccauuugaggaauaaaaaugucaugaaugugggggaagaaggaaucacagcaggcaggaguugccuguaaguucuauggaggaaagcuagcuaagccuggaaggaggguuuagauuuggauaaguacacagaagacuagaagggcagguauuagguugggaaggugacguaagccaaaggacagaggugaaaaacuacacaacauaaggauggguuggaggagacagcccaacagccuuaaagcagaacgaaguacgauuacagaggacccuguguaucaaaucaugcuaaaguucaagucagugguucucaaacuuuauucacuacacucaugucagauauguuucacuguuugugauucauuuaacuguauccauauuuuugggaugucaucaucauuuuauaaggaagucucauaauacucugucucaccaugaccauuaauggagcaagccauaaagguuugacccuggcauagauacauaugcaguuccuggaauauuagguaaaauuccaagcauuccuuuuuuguucauguaaauucuaauuuauauuaaagaaaagcaaauuauaucaucuacaaaccuaaguguguucacuacuacagaguuacuuaggaaacacuuaaccaaucuagaugcugcucuugaagacuacuacuuaaggcaauggagauguuaagcuggggaguaagauuuugaagguacuauuuuaagaggauucauuuggaaggauggauugacagaagaacaugaagucagauaaaccaagaagguccuuuagccauccagguaugaugaagugacaagaagucaggugguaaagacuguggaaaggaagccacagacacaagacacaucaaaguggaaaaacugcuuguauuuggucaguggacugaauagaaggcuauaaaauagaaagacuaggccagaugggcucacuaggcuugugaucccagcacuuugggaagcugaggugggaggaucacuugaggccaggagguugagaccagucuguacaacacagcaagaccccaucucuacaaaaaauaaaaaauuagcugggcauaguggugugugccuguagucccagcuacuugggagguugaggcaggaggaucguuugagcccaggaguaaggcugcagugacccuugauugcgccacuguacuccagccuuggugacagaguaagacuuuguuuugucggggggcgguuuguggggaguauugaggggggugaagagucaaacguaauucuaaaaauauaggaugggcugggugcaguggcuuacacccguaccuccagcacuuugggacacuuugggaggcugaagugggaggaucacuugagcccaggaguuugagaucagccuugguaacauagugagaccccucccaccauccuuagaaaaaaguagcuaggcauggaggcacacacccauaguuccagcuacuauggaggcuaagguggacagaugacugagcccaggaaguugaggcugcagugagccaugacugugccaccacaugcccaaucugggcuaugcagagcaagaccuugucucaaaaaaaaaaaaaaaaaaaaaaaaaggauguaaacuauagaugggaaaauagaaacagaaacaaaggaacgaugacggagaauaaauuuagguuucaaauggaagaagugacaaguuugauuucaauaauuuugaguaugaagucacaagagaucauugcagcacuggauuugagaaaagaacaggacaaaagaccugaacacacaaaaaaacuaaguugauagcuggaaaucuuuaagaagaagguauaaaaagaagagucaacggcuugggacuaaauuuugaaauuuaugucucucuaauauucagcagcaguuacugauuguagcacuguuuuucuuuccuuuuuuuuaauuuuuauuuuugaccacuuauccaaguucuauguagcacuguuuuuuuugagauggagucucgcucugucgccugugcuggagugcaguggugugaucuuggcucacugcaaccuccggcuccuggguucaagcaauucuccugccucagccuccugaguagcugggauuacaggaaccugccaccacucccagcuaauuuuuguauuuuuaguagagaugggguuucaccauguuugccaggcuggucucgaacuccugaccucaggugauccaccugccucggccuccugaagugcugggauugcaagcuaugcagcacuguuuuuauagcaaaacauuggacuaacuaaacgucuauccacaagagacaaguugguuaguaaauggcuguaauucuauagauagaacguuaugcagauuucugcauacuuauaugaaaugaucucuaagauucacuaugaaaaaagggagauacagcuauaauaugcuccuuuuuggguaaagaaaaaguaggggaaauaacauuuagaaagaacaugagaauguuauuucuuauucaaaauaauacacuuuuaaaugucuaacaaaaaauguuuuaauagaucuucacaccaaguaauaucacuauauagguaaaauagugaaccugcaucacugucacugcuccauaagucacagcuguccaauagauagagccgaccauuauuccugcugcagcaaauggacaggcuuuugagaucagucuaucugcaagauccaagacguaaaccacuggaccuauaacacacagaaaagaaguaaagguucaacacagggugaacuuuuaaaaugacuuguuugauauuuucuauagaucuaaaauaccuuccccccaacaagacacagggucucacuuugucauccagauuauagugcaguggcaugaucauagcucacuacagccucaaacuucuggguucaagugauccucuugccuuggucucccaaaauguugggauuacaggcaugagcuacuacacucagccuaaaauacuuucaugaaguuggauguuuugaugcuuuagaaauaacuguuauaaauuugaugggaaccuagacuagaauaguugagaauuucucagucauuugcacgaauagcuaaauauuacuucauaaauucucguaaacagccuccucaaauuaucuuuauuauugaaccuaaaauuagagucucaaauauaguuacuucuuauaaaggaaauaguccucucacuuucaucucuuaaucauacuggccacgguagagugaaauggucauuucagcuugcuuuuuccaucaaauuccuggcaacaauuagauucucguauuuaguaagaauaucauuucucugacuucacucacuguauaccuugauacaguacauaaagguaaccagggccauuuucuuguauuuacauaaugucaauuuaucucucuuugauuuucaauaugcuguauuuaauugaauauuauucucuaacaaauuucuuuuuaugauuaugaagccaguuuuuauagcauuccaacagcucuauguaccaauuauguucuauuauuauaugcuuacucugaaaucugacuacuacuuccuucugaaaguuauuuggaaaagcagcauuuggagguauucugacugccacuaagcccaguauaauuuagcuccagaauuuuccagaagaauggaagggucucagcccugauuuaaaggccaaauauaacugaauaucuaaguuuauuuauuuauuauuuuuauuuuuuuuugagauggagucucgcucugucgcccagguuggagugcaauggugcgaucauggcucacugcaaccuccgccucuuggguucaagcaauuuuccugccucagcguccugaguagcuaggauuacaggcgucugccaccaugcccagcuaauuuuuguauuuuuaguagagacgggguuucaccauguuagucagguuggucucgaacucuugaccucaggugauccacccgccucagccucccaaagugcugggauuacaggugugagccaccgcacccagccagcuauuuauuuauuuuugagacagagucucacugugucacccagucuggggugcaauggugggaucuugguucacugcacccuccgccuccugggcucaagugauccuccugcuucagccucccagguagcugggauuacaggcaugugccaccacgcccaacuaauuuuuguauuuuuaguagagaugggguuucacccuguuggccagguuggucuugagcucccgaccucaggugauccacccaccucggccuccaaaagugcugggauuacaggcaugagccacugcaucuggcccuaaguuuauuuuuuuaauuuaauuuuuaauuuuuuuuuuuuugagacagaguuuugcuuuguugcccaggcuggagugcaguggcacaaucucggcucacuacaaccuccgccuccuggguucaagugauucuccugccucagccucccgaguaacugagauuacaggugugugugagcuaccaaaaaaauaugaaaacuucuuagaaauguguaagaauuauuaccuaccuucugggagcuuauaaucuaaaggcagaugcuauacacaaaaacuguuuauuuucccuauacaaauaaauuaacauaggauucugaugauaaaauaaugaaacauguaagaacaaagcauccaucuauggagccucugaucaagacucccugcugaucacuggagccaauaauaucgcuaugucacuguaugaagacagacuauacauuguaaaguagagagaacauuagaagagaugucaaaggacugucauuuauaauauguauagcauauuuacuuauuacugucaagcucuaacuuacauaacauuuaaaacaaugauaagguaucuucugggaccagagagaugaaauaagucuaauuuagugcacaccaacucuauauccucuaauaaauaguuagcauuucuugagggucuauaagagacugugugcugugccaaaggcauuauuacaugcaucauuauuuaaucucagaauauagugcugaauucucaagacauacaaauuugcuggguuaaguuuauaacuccuucagaaagcacaauaaaagucaucuuagucaccaaagaucccucaaaugcuaguaguagaaguuaaagaccguaaguauauauaaaaccucagcacuucaaccuucguaugguugauaauucgauuuuuuuuuugagacagggucuugcucugucacccacacuagaguacaguggcaugauuauggcucacugcagccuugaccuccccagcucaagcgagccucccaccucagcccccaaguagcugggaccacagaugugcgccaccaugcuuggcuaauuuucuuuauuuaaauuuuuuuuuuuuuuuguagagauggggucucccuguguugcccaggcuggucuggaacuccuaggcucaagcaauccucccacuucaguuucccaaagugcuaggauuacaggcauguaccaccaugccuggccugguaauuuuuuaaucagaaaacugaagccauaagagaacauuuaucgacgcucuccagcacauguacucaucaaccaauauuccacccaucugaagucaauccccucacuuaugcacuagaugauccuauccccucaccaacucaaggccacagcuccagcaauuaucucccacuauccuacauaauuucucccuacucuuuacuggauccucaucaaacaaacaugcuauuauuucuucaguguuaaaaaaaaaaauuaaaaccaaauuauuuucuugagccuuuuugccccacugcuucauuucauugcucccuuugcaacaaaauuccccagaagaacuguauauguuuuauuuauuuuuauuuuuuuugagacggaguuuugcucuuguugcccaggguggaaugcaauggcacgaucucggcucacugcugcaaccucuugccuccuggguucaagcgauucuccugccucagccuccugaguggcugggauuacaguuaugugccaccacgcccggcuaauuuuguaguuuuaguagagacaggguuucuccauguuugucagauuggucuugaacuccgacuucaggugauccgcccaccucagccucccgaaguguugggauuacaggugugagccacugcgcccggcccucuaucucucuccuuaguuuugaacccacuccaccaaaacugcuuaucaaggucacuagcaaccuccauuuagccaaaucuaaucucaguuuuccucuuuuuuuuuuuuuugagacagagucucacucugucacccaggcggaagugcaauggcgucaucuuggcucacuguaauuuccgccuccugggcucaagcaguccucugcuucagccucccaaguagcugggacuacaggugugcaccaccacgccuggcuaaccuuuguauuuuuugcagagaugagguuuugccacguugccuaggcuggucucaaauucuuaggcucaagcgaucugcccaccuuggccuuccaaagugcugggauuacagcagugagccacugggccaaucccagaacaucucucguuuuucuuucuauuucacuacucaauuuucagucuccuuugcugguucuuucucuuuuuagacauggagucucacuauuauauugcccaggcuggcuuaaccccuggcugaagugauccucccaucuaagccucuugaguagcugagacuacaggugugugccaccaugccccuuccucuucuucuugaccucaaugaagcccacccuacgaaccccuacuucaucacacuccccauuugauuaccuugcucuauuuuucuuuuuccuaaagcacuuaucacauaacauacccuaauuuacauauuaauuauguuuccacuuacuguaacagagguugggaaacuagggccuguaugcuaaauucagacaucugccuguuuuuguaaauuaaguuuuauuggaacaugggcacaugcaaagucuaaaauauuuacuaucugguucuuuacagaaagguuugcugauuuuugcaucggaaaauaagcuccaggccgggcaugguggcucccaccuguaaucccagcacuuugggaggccaaggugggcggaucaccugaggucaggaguuugagaccagcauggcuaacauggugaaaccccguuucuacuaaaaauacaaacaauuagccgggcgugguggugugugcuuguaaucccagcuacucaggaggcugaggcagaagaaucgcucgaaccugggaggcagagguugcagugagcugagauggcaccauugcauuccagccugggcaacaagagcgaaacuccgucucagaaaaaaccaaaaaaacaaaaacaaaccuccaaagggaaaaugaucuuuguuuucaucauugauuuaccccaaguuccuacuacucucaaucauuuguugaacugaauugucuuguacuuggaacuaccuacugauggaguaaagcaauauaauuccuuaaaacaaaauucaaauauuugaaugaaagcauaauuccuaaaauauaacccaucacuauuacuuuuaucuaucaugaacagugacagccuacagauguuugaauuguuuuucuuguuuuuccuuggaagaucucagaagcuucuaacaagcucaauuuucuuccugaaucauugggugugaauucuuuugaauaagaaaaaaaagucuucauauuuccucuuuggaaauuuucuacucaucucuuguguuauaggcaaaagauguaccagauaaaauggaggcaaagguugcauuuuauagcaccuaauucuaguuuuucugacaaaauucugucuuggcuuuucucuuaaguuuacuuugucuaaaucucuuaaggcuuuuccagacacuagucuaagauuagcuuaauacuuaaaagaaaagauaaaugccuagugcuaagcauaccauuagaauaauaaacugccacccaggggagguauuucugagagcuaaagauuaucuggcaagcuauuuggugaguaagaacaaucacugaaaucuuuuggaggacagucucuaauucauacucuuccuaugaaguuuaugugcuacuaucucaugauuuggggccagggguuguaaacuuaggaaaaaagcaacauuuauuagauucuuauugcugucagauuacaccacaaaaaguuaugggaaguagaaaaaggcaagacagcagccuuugaaaaccuuaauucugguggagaggaagaacuauaauaaauguaccuuacaaguuaaauauauaggggcuugagaaaguuucaauauuuucaaaagguauuauugaauuuuuaaugccuuagugggccucaacacuuauguuucuaauagcacuguauuuacauaacgaauggcaacugaagcuuuguauaaauauuaaguuuugaaaaucuauuaauuuaaagggcaccagagaagcuuggaauuagcagggaaacuauuacuucuuuuguauaauaaagaagcuuuuguaaagagaacaacuacacccuaauauucuggguaaauucaaguuuucacguuucagacaugaaugacauaaaaaagugagcugagaacuacuggggcuuguaagucaaugucuacuaaaaaagaaguaaucaguuuugucuggcagacauagcaaacaaaaguagauuuuugcugccacuguaauauaaauuaaaauuuauauuuuggcugcuaaagguacaccuuggaaguucagaagucaaugacugaagggcagguagguaauacuuaauguucagcauuugcuggcauugcuuauaauaacacccagaacuccuagaggcuagucaagugaagcuguuggaguggagaagaaacaaagaaauauguaacugguugugaucaauuaguuguaaauaccaaugcacuuggacuggcagagaaacauaauucuauacuuuguugugcgaaaguuucuaacacagaacaugauuuaaugagcauaaacagguacuuuacaagacaaccugguauaaguuucugagacgauaaguuccuucuguuaaguggccaauaauuuauaaaagagauucaacaagcaagacagacugcucacagaagccacucaaguucccauguuuuuucuguuugcuuuuugcuuugcauugaacugauuucgaccuagaccaaacucaaaugccaacuuucuuccgagacagagucucgcucuauagcccaggcuggagugcacuggcgcaaugucagcucacagcaaccucugccucccggguucaagcgauucucccaccucagccucccaaguagcuaagauuacagguacaugccaccacaccuagcuaauuuuuuuauuuuuagcggagaugggguuuugccaugucacccaggcuggucuagaacuucuggucucaaaugauccacccgccucggccucccaaagugaugggauuacaggcgugaggcacugcacccggcccucaaauggcaacuuucuaaagcuaagacaccaaccccauuuucagagccacccagaaguacagauuuuugaggccacugacaguuuaacaauauaaacuuucauccuugcuccaagucuuuuugcuacaugucuggaauguccuguccuuacuuugauuaaaucuguauaaaaauccaacuucucagcaaagacuaacuuaacuugauagaggcugacuaccccacccuguccaugucccaugaggcuuccuuuacauacuaccccacaaaauacacuuaccccuuugcuugugcauaauguuaguacuuuauguucuuguucaauguuuguucaguugucucaauauccuuuaugucuguccaugucagcaucaucuuagacugaaaacucccagggggcaagggccaugucuguuuaacucguuuuguacagugccuaggacagaaccauguacagaucggugcuuaaaaaaugcuuuuuaaugaugauuggcaucacucucaaggacccucugggccacagcuaucucagcacaugguacuuggcaguauggggcacuuuggccuuuucuacaaggcacuggaauauaauggcacaggaccuagccacaguacucuguggccaguacuugacucaaucuguuguuaaauggacauuuuaagggaaaaaaaaaaaaguauuaauuauauggucccaagccaacaaacgugaauuuuuuuuuucuuuuuuuuuuuuucuuuuggcaagacggagauuuacucuuguugcccaggcuggagugcaauggugcgaucuuggcucaccgcauccuccgccucccagguucaagcgauucuccugccucagccucccgaguagcugggauuacagucaugugucaccaugccuggcuaauuuuguauuuuuaguagagacgugguuucacaugcccaggcugaucucgaacuccugaccucagguaauccgcccgccuugcccucccaaagugcugggauuacaggcgugagccaccgcacccggccaacaaaugugaauuuuauugaagauaucaaguaauacaacaaacuugauuaaaaguaugugggaggcugggugcgguggcucacaccuguaaucccagaacuuugggaggcugaggcagguggaucucaaagucaagagauugagaccauccuggccaacauggggaaacccugucucuacuaaaaauacaaaaauuagcugggcaugguggcgugcgccuguaaucccagcuacuugggaggcugagguaggagaaucacuugaacccaggagguggagguuguagugagccaagauugcgccauugcacucuagccugggcaacaagagccaaacuccgucucaaaaaaaaaaaaaaaaaaaaaaggauggggaauccuaaugcgauaguaaagaguuuuaccucuuucucuagcauuccccacuguuuuaaacacuacacuuuggaggcuagguccaagagccccagaaaagucgcuuauguaaguuucaucucugauugacugcucugcugguaguuugagauuucaccaucuuuauguaagaacaaacauccugcaaacuuacgcuguaaguuacuuugcuuaauaacaaaagguuaaucauuagauuguaaagaagggauauguucuuggacaacuuuuuagauaacuaaguuaauuauauauauuuuauuguagaaaugguaucuugcuauguugccccagcuggucucaaccucuuggcuucaagugacuggcaucccaaagugcugggauuauagacaugagacacuaugccugguccaaaauaguaucugaccaaaaaaagaaaaaaaaaaggacccacaaacaaaccaacuaacccaaacaacccugaagaauaaaagacuucaggucaaagcagaugagugauuauauauauacauauauauauacgauuauauauauacauauauauacgauuauauauacauauauaugauuauauauacauauauaugauuauauauacauauauaugauuauauauaaaaacauauauaugauuauauaugaaaauauauaugguacauaguuauauaugcuauaucuauaaauucauauauugcauuuccaugauuaaucacugaagaucaccacaguaguuccuuaugauuauauaauuuaugccaagggaaauuuuaaauuuauacucauaaaauaauaggcuacagaauacuugugagcuguaaggucaacuacuaaguacuuauuaagcaucuauuguaaacacauuuuacuacguauuaaaauaaauguaaauuauauuuaacacacuagcugcugcccccuaggagucuacaaucuaguuagggacaaacaauauacauaaaacaacugaaaacuuccaaugcaaaauuaauaaagauaugauaguaugguacaaacuauacagauguuaagaaaauuuuagguaaagauuauggggggggaggagguaaggauacaaacaguuuuuaaaaauugcuguuuguuuuguuuguuuuuuuaaauaaaugaaucuugaccuaaacuugaagucucugaugugaaaagaaggccaauuccaagugaagaagaaaaagcacaacugaaucaagguaaaaccaagcagggcaugcuaagaagagccuucuaacuggaagugaaaaacuuugcugaaaaaagucaccaccaccaaucauccuuuauuaacacauaaaaacagcuggcagcacuaauuaugcacauacuacauauaugccaguuaacuguauaacacagucuuuuuuucuuuaaacauauguguauauuuuucacauuuuccaugaugauaauauaauuguucuuauuaauaagaaaaacuguauuuuagaaaagaacaaugaguuauaaacuucagguaaccauuacccugaggaagguaaccugacauuaccacugaauuuucuucuucccuguauaugagaagguuguguauuaggcucauuaggcuguaacaaaacaagguggguaaggauuagguugggucugcugugugaauugggacaaagugccaucucugggccugaauuucugcaucuguacaaugaagguguuauguauaucagaguuuuuguaaaaauuaaaauaauucauaugaagcucuuaguacuuaauguuacguaguaacgaucuugugucagcuauuauuucuuccaguucuaaacuauauggucaccccaaaagggcaaacgauguuaaacauuauaggacaguggaguagaaggcauaaucaaagacagcaggugucugagaaaaaacuugugguauauagcucuggaauacaaauaagacaauuucaggaaauccucaggugagaaauaaagaauaggugcccuuuuccuuaaagauccaggacaaggagcaaaggaaggagucaaaggagccaagaaaucuggcaauguaaagggaaaaugaagacaucaagagaauuuagauucucuugauaaagagcaguuauccuccccuccuuuuaaaaaaagauuguauaguuauguuuuggaccuguaauucagcuacuuuuauucauauacaguguguacccagaaagucucacacuguugaaagauacuucuuaaaacuaaucuacuuuuaagacuuagggagcaagaccaaacaugauccagcaguaaacaaaaggaacucuuauucugaagguauccuagucauuugccucacaagaagguaaccaaugagggcuacaaaagacuaaaugaagggccaggcaugguggcucaugccuguaaucccagcacuuuuggaggccaaggcgggugaaucaccugaggucaggaguuuaagaccagccuggccaaccuggugaaaccccgucucuaauaaaaauacaaaaguuaguugggcguggugguaggagccuguaauuccagcuacucgggaggcugaggcagaacugcuugaacccgggaggcggagguuacagugagccaagauugugccauugcacuccagccugggcaacaagagcaaaucucugucucaaaaaagacuaaaugaguucucuaacuauaaacuuugacaacaaagauuauucaaagacuaaaucacuauggaauaggacuuagguuuuuaaauuuuucuuuauuuugaucauacauaggaacuucuauauagcaaaguaaaaagaaaacauuucucugaaggcuaaguguaaauauuacuagaaacuuuuauuaauaugaagagaguacuugaguucuuaaguccauauuuguuuuuuagguagugaaauaaaccaaugauauauuuuaugagcaggcagaaaagaaauagguugaguucaugugagugacagaaggccauguggcuagaggaaaaacaauggggaguauuuuuauggaguaacugauaccuugggauuuaucagucaaaaauauaaaacccccauaaaauugaagccaugaaguuuuaaguuuggggaaaauauauuucuuacucuauaguacccuuuuacaaucuaaguauucuuacuuuaaaaugguuuagccuccucacugauaaagaaauguguauuaaaacuacaauaaguuaucuuuucuuaacagacuggcuaaaaucucaguuugcuaacacauccuacuggcaaagcaugaggaaauaggcacacucacauauugcaggugaauacacaaaaugauucagcaccuguggcaggaaauuuggcaauacccagcaaaauucuauguucaauuuacccucugacucagcaaucucuucuugauugauaacauaaauuuucuaagccaauaaaugaagaaagaaugaaaacauuagagugacaauguuuuguauuacuuaaugaaacaauggaccuagaggcaaugaaaaauaaauuaucaaucucugcuaaaacuagguggaaaugaauaggcaacuuuacugaauggaucaggcugauaacaccuauacacacugaucggucuuaucauaaaaagaacaacuacacauuaugugccuugugaugugaugcaauaagaagcacacaaacuaucuaucagauauuccuguaaaaaaaaaaaaaauauauauauauauauauauaauaaccucacugacaagaucuaaacaccaguuuacacaaaaugcagaggauagggcaacauauuaaacagccaaguguucguaguguaucagcauaacaaagcccaggaaaugaaaaauucuaucauaacaaaaaaaggaaaaaugucuaauauaacucuacucagaguucuacaaaaugagaauggaaagaaugggggaaaagcaauaucugaagugauaaaagccaagacuuuucaagaauaaccacuuagguagagaaauaaagcauaaaacuuaaaggaaaaaguaggacaaauagaaugcacaaaaucugaugauaaaaauccagcuauaucaguaucacaauaaauguaaaaaagaacccaaaagaauuaaaaauaaaaggaugagaagagauaaacagggcaaaaucaacaccaccauugaaaaagcuggcaaaaaagggcaaaaaaaaaaaaaaaaguaacuuuacaguggagaaauguggcaaacacuacaacagccaaauaaucaaggucauagccaagaggaguguaaggagacaugacuaaauguaaugugguaucuuggauaagauucuggaacagaauaaagacaugugaauuacauuuagucaugucuccuuacacuccucuuggcuaugacaguuucucagacuucuuugcuuuugaugaccuugacaaucuugaggaguacugaccagguauuuuguauaauaucccucaacuggaauuugucugguguuuuucucauuaucucuuggaguuaggaguuucagggaagaagaccagagaggcaaagugcaauucucauugcaucagaucaaauguacauaauaccuacaugaaucauuacuggugauaaugaccuugauuauuuggcuguuguaguguuugccacauuucuccacuguaaacuuacuuuuuuuuucccuuuuaugcuagcuuuuucaaggguguuguugacuucgcccuguuuaucucuucucacaugaaacugcgauauauuccuuuuccacaaaugaaauauuucauaauaaaagagaaaaaaaauaccugagugagcauucugcugagcuuuggucaaugcuaaggcagcagauauaacuaguucuguguauugauagcagcauguuggcaaaggcaauggggaagcaggcacuccaauacaccguugggagauuaaauggguguaaucucuacaaaagccaauuauaggauauccauuauguuauaaaugcacauaccuuugacccaguaauucuauuucuagucauuuaucuuacagauguauuugcacacaugcauaaaauuacuucccaaaguuguuuaugaaaguacugucuauaacaguaaaagauuggaaacaagccuguauguccaucaauggaggaagacugauuauauaaguaaucauacaucuauguaugaacacaguuuuuuuuuuuaaaaagcucuuuauccaggcuacuuuuaauagaaaaaaaaaaaagcucuucauauaugaauacaaaaugguaucuacgauauacugcuaagaaaaaaaaaaaguuuaggcaaccuugcccucuaguuucugauguguucaaaugauaggagagaccagaacaucagagagugguaaaaguguuaaaguuuuuuucccugguucccucauugcaaguagcuugcaaguagcuugcuaaacccuggguacuucccucucccuugauguuccuuuaacucuuacguuuguagauucuguguaaguguagggagagagggagaggagaagaaugaaggagagagaagaaaaagagaaacaaacugcaaugaaauaccagaaauuuauaacgauaguuauaauuuauaaccaaguaagaaaacuuacuuggcaccauggcuggcagacauaguagaaagacuuuucauuaaauauccuacuguaccucgugucuuugaauuuuugacugugucaaugcauuaccugggggaaaaauauaaacuuaaacaucaaaugaguuaaaaaaaaaaaaaacugcuuaugagauauugcaguugcuccaucuucucuuugauguauuugcuauuccuuuccauuucuagcaaagcaaauaucaagaaagaaaagagaacaggcaauuuguuagugcaggcaccuagcuaucauuuuguuuuuuggcaauacacuugucuuucaauucuagugguaccaacucauaaaauuuuuguuacuuacacaucauuuguguaauuuauuaacagucucucaaauuaauucaaauucacauuaucucuauuaguucuuaugguacuagaaacuacuuauccauauguggccuauuagcugacucacugagugacaguaacaagaaauuugccaguguaaaauucuggcuccuugcuuuauuugcuggaagcccaugggcuuccauuacauaaauuugcugagucuacuucuuaucuacaaacugaggacaauaucuauuaugcagagcuuucgagagguuuaaauaauauaggcaaagugaucgacauagugccuagaaugaaacagagaauggaagaauaggcaauaggggccuauuagcaaaugauagcuauugauauuuauuguaaaauaaaauaaaauaguuacaacuauuaauuuuauauccuagauucucuaggaagguuucucccaggaauugguccuauucaucccuagugaaaaucuuucccuucuaagcauuuacacuccacuuaacauuugacaaccacuuuuugaggaugguuacugguaaaauucuauauaagaaguuucaauuaauguuuaguuauaagagcaacaauaaaauaagaguagcugggcacgguggcucaugccuguaaucccagaacuuugggaggccaaggcaggcggaucacuggagaucaggaguuugagaccagccuggccaacauggugaaaccucaucucuauucaaaauacaaaaaauuagccaggugugguggugcacaccuguaaucccagcuacucgggaggcugaggcaggagaauugcuugaaccugggaggcagagguugcagagagccaagaucgugcagcugcacuccagccugugcgacacagcaagacuccaucucaaauaaauaauacauaaauaauaaaauaaagaugacaaaaauuuaacuugaaaacuaagaauuuacucuuaaugagauauaagagagcugaaauagcuauacaaauauuggucaagggauuuuuaugacaaaauugcuauuagaaacaaaaaaggauauuuuauaaugguaaagggacaauccaucaggacgacguaacaauuauaaauaugugcacuugaccuaacaauuauaaauaugugcacuuaacagagcgccaaaauaaauuaagcaaagacguauggaaccagaggaacaggcaauuuaacaguaauuggagacuucuaugccccacucucucucuuuuuauuuaagacauaagguuuuacucuguugcccaggcuggagugcagcagugcaauaacagcucguugcagucuggaacucuugggcucaggcaauccuccugcuucagccuccugagcuagcagagaccacaggcaugugccaccaugccuggcuaaaguuuuucuuuuucuuuuuuuuuguagagacagggucucacuauguugcucaggcuggucuuuaacuucuaggcgcaaaugauccccccgccucgaccuuccaaagugcugggauuauaggcacaagccaccacucaccacucuauuuuaaauaauaaacagguaaaagauaacaaggaaauggaaaacuugaaaauaccagaaucaacuagacauuuauagacuacuccaacagcagcagaauacauguuuuucucaagugcacauggaacauucuccaggauaaaccuacguuaggccauuaaaaaaaguuuuaauauaguuaaaaaaucagacagaguaugcucucugaucacaaugaaauaaaaaaaaaaucaguaacagaaggacaucugggaaauuuacaaauaugugaaaauuaaacacuacauuccuaaauaaucagugagucaaagaagaaaucacaagaaaaauuagaaaauauuuugagauaaaugaaaacccaacaaaaauuaugauauacagcuaaagcagugcuuagaggaaaacuucuaguuguaaaugacauuagaaaaugagaggccgggugcggcaugaggucaggagaucaagaccauccuagcuaacacagugaaacccugucucuacuaaaaauacaaaaaaauuagccgggcgugguagcaggcgccuguagucccagcuauucggggggcugaggcaggagaauggcaugaacccaggaggcagagcuugcagugagccaagacugugccacugcacucuagccugggcaacagagugagacuccgucucauaaauagauaaauaaauagaaagaaagaaagaaagaaaaggagaaagauuaagagaaugagaagacaaccaaggagaaaagaucugcccaagacaucugacaaagaacuuuuauccaaaauauccaaagaacucuuaaaggucaacaaugagaaaacuaucacucugauuuuaaaguguacaccucaucaaagaagauauacagauggcauauaaacaaaugcaaagauguuucacaucauaugucauuagaaaauuucaaauuaaaaugagauaccucuauacaucuaucagaaugacccaaaucaaaaacacuggcaaggauguggagcaacaggaacucccauccauugcuggugaaaaugcaaaaugguacaugguacagccacuuuggaggauaguuucaaggcuucuuacaaaacuaaacauacuuguaucauacaauccagcaaucaugcuccuugguauuuaccccaaugaguugaaaauuuauguccacacaaaauucuguacauggauguguacagcuuuauucauaauagccaaaacuugaaagcaaccaagaugucuuucaguacaugaauggauaaacugugggacauccagacaauguaagaguauucaguacuaaaaugaaaugaucuaccaagcuacaaaaagacacagaggaaauuaaaugcauguuacuaaaugaaagacaaucugaaaaggcuacauacuguacgaguccaacuauaugaccuuguggaaaagggaaaaccauggagaaaaaaaaagauguaugguggccaggagcucggggagggaugaacagauggagcauagaggauuuuuaggucagugaaacuauucuguauaauacuauaaugguggauacauguuauuauacaguugucaaaacccugaaucaacccuuuauacauuauaaauuauacaguugucaaaaccaagagugaacccuaauguaaacuauggacacucugggugguaaugaugugucaacuuaaguucgcugacuguaaaaaauguaacacucugguacaagauguugauaguggggaaaguagucagcacucuguguguguguggucagggguggaggcuggcauaugguuuacugugaaccuaaaaaggcucuaaaaucuauuuaaaaauaacagaaacagaaagaggggcugggugcaguggcauacaccuguacucccagcuaaccaggauacugacgcaggaagaucacuugagcccaugaguucaaggcugcaguguacuaugacugcaccuguuaacagcuacugcacuccagccugagcaacauggcaagacugaaaaagaauaaagaagguggcuggggaccgguggcucacgccuguaaucccagcacuuugggaggccaagguggguggaucacgaggucaagagaucaagaccauccuggccaacauggugaaaccccgucucuacuaaaaauauaaaaauuagcugggcgugguggugcacgccuauagucccagcuacucaggaggcugaggcaggagaauugcuugaacccaggaggcggagguugcagugagcugagaucaugccacugcacuccagccuggcgacagggcgacacuccaucucaaaaacaaagaaagaaaaaaaaaagggcuagaugugauggugcacuuugggaggccuagcugggcugauuacuugagcucaggaguaugagaccagccuggacaacauggcaaaacccugucacuauaaaaaaaaaaaaaaauacaaaaacuagcuggguauggugaugagcaccugcagucccagcuacuugggaggcugaggugggaggaucacuugagcccaggaagucaagguuacagcaagcugagauugugccacugcaucccagcauguuugacagagugaggcccugucucaaaaaaaaaaaaaaaaaaggacaaaaagaaagaucccaagucaacuaaucuucuaccuuaagaaacuaaaaggagaaaagcaaacuaaacccaaaucaagcagaaggaagaaaggacauaaauauuaggguggauaaaaaugaaacagagaaugcaagaauagaaagaaaaaacucugacaaaucuuuuuuuuuuuuuuuuuuuuuuuuuuuugagacggaguuucgcucuuguugcccaggcuggagugcaguggugugaucucggcucacugaaaccuucgccuccuggguucaagugauucugcugcuucagccucccaaguagcugggauuauaggugcccgccaccaugcccggcuaauuuuauauuuuuaguagagacgggguuuuuccauguuggucaggcuggucuugaacucccgaccucaggugauccgcccgccucggccucccaaagugcugggauuacaggcaugagccaccacgccuggccaacccugacaaaucuuuagcuagacugaccagaaaaaaagagaagauucaaaugacuaaaaucaugaauuaaggaaggggcauuacuaccaaucuuacagaaaugaaaaggauuauuaaaaaauacuauaaauaacuauaugccaacaaauuagauaauauacaugaaauggacaaauuuguaugauacaaacuaucaaaacuaauucaagaagaaauagaaaaucugaauagaccuguaaguaaugagauugaauuaguaauuaaaacauuuuccaugaagaaaagcccaggaccaaauggcuucacugcucccaaacauuuaaaacaccaauccuucacaaacucuuuuaaaaaacauaaaggagggaucacuucccaacuuauccuaugagccaguaugauuccagcaccaaaaccaaagaugucacaaaagaacuacagaccaauacccauuaugaguacagacacaaaaguucccaacaaaguacuagcaaacaugaccaaguagaacuuaucccaggaaccccaggcgagucuaauaugaaaaucaaccaauaugccauauuauuagaauacagaacaauacucacaugauuaucaauagacagagaaacagcauuugacaaaacccaacacuuuuucaugacaaaagcccucaacaaacuacaaauagaugggacauccucaaccugauaaaggccaucucugaaaaacccaguuaacauacacucacguguuacucaaugauggguauccacacacagggauaaauguguccuuaggccauuuuguaguuuugugcacaucacagagucgguaugguguagccuauuuacacaccuaggcuauaugguauagccuacugcucuuagccuacaaaccugcacagcauguuacuguauugaauacuguaggcaaauacaaugguauuugcguuccuaaacauaggaaagguacaguaaaaauaugguauaaaagauaaaagaugguauaccuguauagaacacuuaaucaugaauggagcuuccaaggcuggaagucuggaaguugcucugggugauucagugaaugggugaugagugaaugugaaggccuaagacauuacuauacacuauuauagacuuuauacacauuguacacuuauuacacugaauuuauaauuuuuaauaauaaauuaaccuuagcuuacuguaacuuuuaaacucuauacacuuuuaacuuuaacuuugacucuuuuguauuaacagcuuaaaacacauauuguacaguugugcgaaaaauuuuuuauccuuauuuuauaagcuuuuuucuauuuuuaaaauuuauuauucuuacuuuuuaaacuuuuuuguuaaaaacuaagacacaaauacacacauuagccuaggccuacacagggucaggaucaucaauuaauaucauugucuuccaucucuacaucuugucccacuagaaggucuucaggggcaaaaacaaacaugaagcuacuaucuccuaugagaauaaugccuucuucugaaacaccuccugaaggauaugccugaggcuguuuuacaguuacuuuuuaaguaaaagaaguauacucuaaaauaaugauaacaagugguuggguaugguggaucaugccuguaaucacagugcuuugggaggccaaggaaggaaggccccuguaagucagaagagagaaaucagccugggcaacaaagcacgaccuugucucuacaaaaaauaaaaaaaaaauuagccagguuugguggcaugcaccuguagucccagcuauuugggaggcugaagcaggaggaucccuugagcccaggaguucaagauuacaaugagcuaugaucaugacacugcacuccagccugggugacacaguaagacccugucucuauauuaaaaaaauuuuuuuugcaguaagcugagauugcaccacugcacuccagccugggcaacagagugagacucugucucaaaaaaaaaaaaaagaaaagaaauuuuuuuuuuuuuuuggccaggugcaguggcucacgccuguaaucccagcacuuugggaggccaagacgggcagaucaugaggucagaagcucgagaccagccugaucaacauggugaaacccugucuauacugaaauacaaaaauuagcugggcacgguggcaggugccuguaaucccagcuacucaggaggcugaggcaggagaauugcuucaaccugggaggcggagguugcagugagccgagauugcgccacugcacuccaaccugggcaacagaguaagacucccucucagaaaaaaaaacaaaaaacaaaaaaacaaaaaacaaacacacaaaauuuuuuaaaaguaaugauaaaaaguaaaguagaggccgggcgcgguggcucacgccuguaaucccagcacuuugggaggccgagacaggcagaucacgaggucaggagaucgagaccauccuggcuaacacggugaaaccccgucucuacuaaaaauacaaaaauuagccgggcaugguggcgugcgccuguagucccagcuacacgggaggcugaggcaggagaauggcgugaacccgggaggcggagcuugcagugagucgagaucgcgccacugcacuccagccugggcgacaagagcgaaacuccgucucaaaaaaaaaaaaaaaguaaaguagauacauaaaccaguaacacagucauuuauuaccaagcauuauguacuguauaaaacuguuacauguuauauuuuuauaugacugcuaguacagguuuguuuauaccuucaucaccacaaucaggugaaugaugcauugcacuacuauguuaccacagcuacaaugccacaaggugaugggaauuuuucgacucaauuauaaucuuaggggaccaccacugugguuguuauugaccuaaacauuaaguacaguguaguacggcuauaguuaacggugaaaagucgucaggcacagcggcucacgccuguaaucccagcacuuuaggaggccgaggcggguggaucaccugaggucaggaguuugagaccagccuggccaacauggugaaaccccaacucuacuaaaaauacaaaaauuagccaggcuugguggugggugccuguaauuccagcuacuugggaggccgaggcaggagaaucacguguaccaaccucugcaguaggcagagguugcagugagccgagauugugccacugcacuccagccugggagacaagagugagauuccaucuuagaaaaaaaagaaaagauuggaugauuucccccuaagaacaagaacaagauaaggaugucuguuuuuuuuuuuuccguucuuucucucucccuuuauuguuuguagcugcgaccccaggugcacaccaccauaccuggcuaauuuucuguauuuuuuuguggagacuggguuuugccauguuccccaggcuggucucgaacuccugggcucaagcaaucugccugccuuguccucccaaaaugcugggauuacaguugugggccccuagccauuuuuuuuuuuuuuuuugagacagggucucacuccaguugcccaggcuggaguccaguggcauucucuugauacacugaaaccuccgccucucggguucaagugauucuagcgccucagccuccugaguagcugggacuauaggugugcucuuagaccuggcuaauuuuuuguauuuuuaguagagauggaguuuugcuauguugccgaggcugguuucaaacuccugcacucaagcaaucugccugccucagccucccaaagugcugggauuacagguaugagccacggcucccagccaaggauaucugcuuucaucacuucuauuuaauacugcacuaaagguuauaaccagggcaauuagccaagaaaaugaaauaaaugauucacauugggccaggcaugguggcucacaccuguaaucccagcacuuugggaggcuuaggcggguggaucaccugaggucaggaguucuagaccagccuggccaacauggugaaacacugucucuacuaaaacuacaaaacuuagcugggcaugguggcgugugccuguaaucccagcuacuggagagggugagacaggagaacugacagaacccaggaggcagagguugcagugagcugagaucauggcgcuguacuccagccugggcaacagagcgagacugugccucaaaaaaaaaaaaaaaagcauucagauugggaaacaaaaaguaaaacuauuucuguucaacaaugacaugaucuuauauuagaaaauccuaaggaauccaucaagaaguauccaaauuauuaagcaaguucagcaaggucacaggauacaaggucaauuuacaaaaaucaauuguugcugauuguguuccaagacagaaaacaaaaauuguauucuacauacuuaaacaaucuaaaaacaaaguuaagaaaacaauuccauuuacacaauguaucaaaaagaacaaaauauuuagaaacaaauuuaaaaacuaaaaaaaaaaucuaaaaacuauaaaacaauguugagagaaguuaaagaaaauaaaucuugccugggcgugguggcucacaccugcaaucccaggauuuugggaggccaagguggguggaucaccugaggucaggaauuugagaccagccugggcaacguggugaaacccugucucuacaaaaaauacaaaaauuagucaggcgugcuggcgcaugucuguaaucccagggaggccgaggcaggagaaacugcuugaacccaggaggcagagguugcagugagccaacuucgcaccacugcacucuagccuagaugacagugcgagauccgucucaaaaaauaauaauaauaaaagaaaauaaaucuagugugaaucagucccuugggagucaagaucucucuaccuuugagaugcucuccucugaauucuucugccugaacaagguuauuaccaggucucaaaguuuauggacagguuuuauuuauaaaacaaacuuuuuucaguugguauuccuuucauguuuuaaagcaaugguuuuuaaauuuaaugugcauagaaaucacucaauuaucucauuaaaaugcacauuucagcuggguguggugguucuugccuacauucucaguacuuuggaaggccaacgggguuugggagggggaucccuugaggccaggaaguuugagacugggcaacauagugaucccccucucuaaaaagaaaaaaaaaauuagcugggugugguggcacgugccuguaaccccaucuacuuggaaggcugaggcaagaagacugcuugagcccaggagucugaggcugcagugagcuaugaucaugcugcuguacuccagcguaggcaacaaagcaaaacacugucuuuaaaaaauaaaaauuaaaaaaagcagacuucuauucaguaaaagugggguggaggaagggggugguguucugcauuccuaauaacugccagacaaugcuaauguugcugguccucagaucauacuuugaguagcaagguuuuaaguagguacauacauacaacuggcuuggcucaccagaaaaaaagaaaaaagcaaacuguaacauggguggcaaacagugagaaggauaaaacucugacgaauccucuuaaguuuuucacaacugaguacaauaaguaacucccuauuaacaaugaagaacauacacuuauauuaccucuucauuccugccaugacuaaguaccagaaaagaugcagaauuggccagcuagcaucauccagacuggggcuaaauucauuugaaaaguuaaaaaaaaaacacaaaaucugcugcauagagaucaucccauagaauauuaaccaucaucaccuuucccucucuguaucuucuuuuauuccuucuucuagucaguguuuaucaagugucuuuggggaccaauggcagucccuggcaaucuauuuggucuacagacaguuugagaaaaaagugauaaaaguuuugaucacaaauauuucacaaauuugaggagauuaugacuuucacagaaauccuuuuagguucuuuauugcuguuacauucuaaggaucacccaagcucuacuaggguaaguuaagaaaacacuaucauaauaaggaaaaugaaaaggaaagggcuaacauacuuccacaucaugugaguuguuuacauugguuaaauauguauuuuauuguuacuaucauauuguguuaaaucccaaauuuagggaaaugaaucaaugguucaaaagaguaaaagugaaaaauacauuuaacucagaaugccauaaaugauaauaguaugauuuuauagugaagacugaucuuagaaugagcugugaccagugaacuaggagugauaacacuguacuaggagacauccuuguucccaccguauugugauacauuauuaaauagggacaagaagccacugaaguguucauaucauuuucaacaacuccaguaaaccaaccaaagccuccacuaugaauucugucauuaaaagaucaaaauaauagucaaagguacuucuuuuaacaaaacagauucaacuacugucagcugcaaaauuaaugacaaaugugcucagacagaaacaaaacaaucuacuggcaaaauucuaucaucagaugacacuaucggacauuacgugcuacguguguuauacagagaggaagaacaauuauuaucacagaugcaggcucuuaaguauuuuguuuaauggcugcaugaagccacuagcguacagaguacgaaucaacucuuaguauauacgaauguaacauguuaaucaagaaauacaagcaacuuuuuaaaaguuuuagaagaagauauuuucuuuuaaccaacaauuauuuuugaaacuugaauugaaaaguugugcuggaaucagcauagcuagagcacuagcuuugugugcagcaaugaagagcccaccaccugaaagccaauucacacauggcuucauuuacagacaacagcuggcuugagucauuguuaauaacugcauggaaaauugugaauauaauuaaaauugcagcccuugaauagguaucuucagcauguuaagaaugcagcggcaggcugggcacacaguggcucaugccugugauccuagcacuuugggaggccaagguagguggauugcuugagcccaggaguuugagacaagccuggacaacauagcaagacccaaccucuauuggcgggggggggcggggggaagcagcagcagcaaauacucuguuuuucuguuuugucaagaggaaauaugcuaacaauaccuacucaaaugaaggauauacuuuuuuuuuucuuuuuuugagacagagucuugcucugucgcccaggcuggagugcaauggugugagcuuggcucacagcaaccucugccucccagguucacgugauuguccuaccucagccucccaaguagcugggauuacaggcgccugccaccacgccuggcuaauuuuuguauuuuuaguagacacaagguuucaccauguuggccaagcuggucuugaacuccugauaucaggugauccgccugccuuggccucccaguguugggauuacaggcgugagccaccgugcccagcggauauucauuuuuuuuuauaacacugaugucauuaaaacauaucuaugauuuuaagcggcuaacucaagugccauaccucuaugacagacaguauagugaccagcuugaacauaucauuugagaguaaaauuauaauucucucuuuuauuuaagauugguuucacucugucacccaggcuagaggguaguggcgcaaucauagcucaaugcagccccaaacuccugggcucaagugauccucccagcugagccucccgaguagcuaggacuuacaacaggugugcuccaucacacuuggcuaauuuuuuuucuuuuucuuuuucuuuuuuguagagagacaagguuuugcuauguugccuaggcugauccugaccucguaaccacaagcaauccacccaccugagccucaaaagugcugggauuacagaugugagcuaccaugacuggccacaauucuuuuuuguuguucagacagggucucacucugucucccaagcuggaguacaguggcgcaaucacagcucacuguggccuccaccucacaggcuaaggcaauccucccaccucagccuccugaguagcugggacuacaggugugugccaccaugcccagcuaauuuuuuuuuguuauuuuugguagagauggaguuucacccuguugcccaggcuggucucaagcaaucuacucgccccagcuucccaaaguguugggauuacaggugugagccacugugacccgccacaauuuuuuuuuuuagcacggcgucucgcucuaucucccaggcuggagugcuguggcgcuaucuuggcucacugcaagcucugccucccggguuuacgccauucuccugccucagccucccgaguagcuggaacuagaggcaccugccaccaaggcuggcuaauuuuuuuguauuuuuaguagagaugggguuucacuguguuagccaggauggucucgaucuccugaccucgugaucugccagccuuggccucccaaagugcugggauuacaggugugagccaccgcgcccggcccggccacaauucuuaguaacaaaauaugcagacuaaauaaugauacaaauggcuuaaccaaagaguuuuacucuuuucuuuuuucuuugagauggagucucggcucugucgcccaggcuugugugcaguggcacgaucuuggcucacugcaaccuuugccuccuggguucaagcaacucuucugccucagccuccugaguagcugggacuacaggcacacgccaccauguccagcuaacuuuuguauuuuuaguaaagacauaguuucaccauauuggccggguuggucucgaacuccugaccucgugaucugcccgccucugccucccaaagugcugggauuacaggcgugagccgccacgcccagccaagauuuacucuuuucuaacaacuagguagacuuaaaaccauauucaauuacugcacuaaaccugaaaacauauuuccuagaacugaauucaaccaaaaggacagaucuacacauugccaucuccaaaauuaaaauacucaacuuugcuuucgagugccauacacuugucaacuugauguaguuuucagugagaauucuuguaauaauuuuuguguccauuugaauaucuaaaacaucuaauagaaauauuuaauuguugcucuucccaacucuauaauucaaagguggggcuaucuaauuuaguacaacuaagagcaagaaaagaaaucaguuaaauaugaaaccuuaacuuggacuuuagugagucuuucaccauucauguggugguacaauaaugugaacaaucauugcuuuuccugauacugauuuaaaaauacuucuuugaucuuacaauaaaaacauuuugaauuauucuuuuguguuuaucuaaaaucagugguaugcacugaagacccaucacaugguccacaaauuccaaauguuugaaaacacuacuuucucuacuacacuacuuccccuucaaaggaagcuaucauuucuuccugugcauguuagagaaaaacagagaaccaaggacauuuuguuugcccuuauuauuaaucuucucauauuagaaaagcacuucauuaucugcauuuauguugccacauuuucaaaaacauuggucugauuucaguaugaauagcacuuauaaaaaacaauauauauaauaauuauuuccaauuuuuccugaauucccucugcccccaaagacauucuuuccuuaugaccuucccagaacccaagcugccuuccuauaccucuugguuacagucaaggguuauaaaaaaauguuuaacaacuggcaugguauaaacaccaaaccaagagauugacaccaauuuauaacuguauggcuguaauggaacaggcucacuaaauaucagccuuaguuauacugcugcuaaagaagcagccuuagaaugcuucuuguaagcagucugcuauacuuuuuuuccaugcuaggccuguucucaaagaucuuugguuauuucuuaccugccacuucacagaaaagggauagcaggguucaugaaagaaaccacauaaauuggauuccaaagaugaguuuaacgucacaucuuauuaaauauuuaauuucucuacuuuuauuccuuaaaaggaagaauuaaggagaaguauuagaacauacuacugcuuucuuucucuuacaccgucuccagauaauuaagcuaaguuaguuuuuuuuuuaaaagucagcuuuuuauuagagcuuuguuauucaauuauauccacacagguaugcaaguucuuucuccuuucuaucaaacagacaguuaauacacaggcaaauggauaaauuuggggauauauuaaggauacuguaaacuguuagcaaaagaaauaaaugucugacauucagagaggaaacaagagaaagggaauauagaaauucacacccuaaaaaaaagaggugguucauuuuaaaaugaacuuauaaaguuauauauaauaacaucaacuauaucuguguuguuuuuaaagauauucuuacccaauuuuggaaaaacuauuagguauucagcauugcacugaggacaugccacucuggcuguacuguuuccucuuugcuuuucauccacccagcguuguagacaggccuggugaacccauuuuguagauccucugcaccugcauggucucacccauucagcuguucuaucaucuucaucaguagcaaaacaaacccagcaacuucuguaaauuaaaagagaaaaggaugacauuuauaucuuuaggacuccagccuccucuauacugcagcucuuacuuaaugggaugagccugcuauguuauauuacagaaucucuguccuauauuaaaagacuaaggagacaaaacaaccaauacauucccacuagagcaguuucuacuuuuucuguuuuuccuugucuuccucuacagaacuuauguuuucugaacuuuguuuuuauguaaucuccucuaucuuuucaguaauucuucaccuucucuaaugaaccagagugcaaggagacaaaccucaaguuguuuuuguuauaagaccuaauaauucuuugaggaauaguaagcacaguaauauauuaaauucaguguucuccccaguucaccaccaccaaucccuugaacuuggaaaaacaaaguauuacacgagugauuucacauacagucucauuccauuuuucagcugaggaaaaaaaaacccauuuuucuuuccgguaaaguauaaacaugagagaaaacaauauuacauuuucaaaaaagcacaaaggagauaaauauaucaagauuuuuuuuuuuagaauagcaauaugauaaauuugggcguguaugcuugaaaucugaaaucuagaaguaucaagucuggggugcuuauauuaauaaaaauaaaauucuauugagaucgguaauuuuaaaacauuuucccacuuugcuuuuaaggguacuucaugaauuguaauuuuuucuuguggaauuagguuguaauuccucaguuuuucucccaauuaacacaaguuuugacaucgauuuccaucagggcaaauacaguucaauucaaugagacccuucgcuccuccccuccauuagaacuuguacaaguggaaacaacugcuaauuaaagcauguuaccuacugugcacuuuuuaauuaauuggauaaguggcuucugucagaacaacuagcuuaacuaugcucagugggaaagacuauauacucagguauuauagaugggugagguucuccaguccuuguggaacaacaugaauuucaauugugugcuccaauuacaauuuuucaauuagaacagaaaaaaaguugaacugaauccagggcaucaauauccaaaauaguuguuuuauucagcuuucaaauucagucagguuucauaagaucuaaguaaaauuagaacguagguagcauuuguuuagcauucugacccuuuugacccacuuuagcuaagcugucugggccuucacauugucuuaugguuguccaaaaauacuuuguucuuuuuuaaaaaauuuuaucgucaaauagacauagcauaaaaucuaccauuuuagccauuuuuuagguguauaauucaguggcaguaaguauauucauacuguugugcaaccaccaagacuacccauaguaggacuggguucuaaccuaugauuuuugcauaaaauuucaauugguaaguauacuagcacacaggcugguuaagauguuguuaguauauauuuuuccccacaacugagguaauuuuguggacauauuuguauacaucuaggaaauggaauguaucauuuuagcaacaaaauacuggcagaauauuuagagacucuuuagucucauacuuucuuaacacaaacguaaauaagaauagcuacaucagcauaauuaaucaguauuauggugaaucacauuuuaaauuaauccaauuucagucaucagaaaaauaaaauacaauguuaggacuagguugaaccaacugaaauagucuacauuaaucuguuucugacuuacagaaaagauaggucaaauuucauauuuugaucuaaugagaauacuuguguagcuauuauauuccuuauaaauucuagauaagguuuauuuuucccaaacauuuuauuaugaaaaauuucaaacuuuccaaaaaaaguuaaaaacuguucagugacuacccauauacccaacauuuagauucuauaauucuuauucugcuauauuugcuuucucacacauccauucauuauucuuauuuuuugcugcauuucaaaguugcaggcaucaguauauuucaguccuaaauacuuguacagauuuacuuuuuagaacugacauuuaaagcaugcacuuggccgggugccguggcuuaagccuguaaucccagcacuuugggaggcugaagcgggcggaucacaaggucaggagauugagaccauccuggcuaacacggugaaacccugucucuacuaaaaauacaaaaaaauuaguugggcaugguggcgggugucugcagucccagcuacucaggaggcugagacaggagaauggcgugaacccgggaggcggagcuugcagugagccaagaucgcgccacugcacuccagccugggcaacagagcaagacuccgucucaaaaaaaaaaaaaaacaaaaaacaaacaacgcacgcacuuaugcacuuucaguuuuuuuucuaauuaauuucacaacuaugguaaauaagauagcugaaugaugauucagagugcguacuuaucaggaguuaggcuuucaguugaaauagcaguauuagaggcaugugaaccagagcaacuccgucuugauugaauaggagcuggguaaaaugaggcugaaaccuacugggcugcauucccagaugguuaaggcauucuaagucacaagaugauauaugaggucagcacaaaauacaggucauaaagauacugcugauaaaacagguugcaguaaagccagcuaaaacccaccauaaccaagaugcucacgagugaccccuggucguccucacugcuacacucccaccagcaccaugacaguuuacaaaugccacggcaacgucacgaaguuacccuauaugaucuagaaaggggaagcauaggcugggcgcgguggcucaugccuauaaucccagcacuuugggaggcugaggagggcggauuaugaggucaggagaucgagaccauccuggcuaauauggugaaacuccgucucuacuaaaaauacaaaaaaauuagccaggcgugguggcaggugccuguagucccagcuacucgggaggcugaggcaggagaauggugugaacccaggaggcagagcuugcaguaagcugagaucgugccacugcacuccagccugggugacagagugagacuccaucucaaaaaaaaaaaaaaggggggaagcauaaauaauccucuccuuguuuagcauaucaucaagaaauaaccauaaaaaugggcaaccagcagcccaaagucuugcucuguugcccaggcuggagugcagugguggucucggcucacugcaaccuccgccucccgguucaagcgauucucaugccuccgccucccaaguaguaggauuacagggugcccgccaccaugcccagcuaguuuuuguauuuuuaguagagauaggguuucaccaugcuggcuaggcuggucuugaacuccuuaccucaagugaucugcccaccucaggcucccaaaugcugggauuacaggcaugacccacugcgccuggccacacacagcuaauuaaaaaaaaauuuuuuuuuuagagacaggaucuccuuauguugccuagaccagucucaaacuccugggcucaagcaauucuccugccuuggauucccaaaguuuugggcgugagccacugugccuggccaaauauguuaaguucuaaagaauuuauuaacugauuugcuaucuuacuaguuguuuaaauuuaaucuaccuaguauggaaagaauagcagucuaugaaaugaggacugggcaaaggggaaauuaaagcauguaaaaauggucacacaaaugucuuuaggccgauaucagcauauaagagugugacuagucuuaagggcuaaaaaaaaggaggggagggcacgugcgugcaugcacgcgcacacacacacacacacacacacacacacacacacacagauguuuucuuuccuuauuuuaugagaugggucuggcucuguuguccaggcuagacuccaacugaaauccugggcucaggugauccuccugccucaguguccugauuaccuaggacugcaggcauauagucuagcuuccugcccccuccccugcccuuuuuugagacugagucucacucugccaccuaggcuggagugcaguggugcaaucuugacucacugcaaccucugccuccuggguucaagugauucuccugccucagccucccuaguaacugggacuacaggcauccaccaccacgccuggcucauuuuuguauuuuuaguagagaugggguuucaccaccuuggccaggcucgucuuaaacuccugaccucaaguaauccaccugccucggccucccaaagugcugagauuacagucaugagccacugcgccugcccauccgacugaccaggaacaucaccugggaaggucuuauaauuaugcuuucccuuuuugcuucuccauacccuaccccucccacucuauguaauuaaucuacuucaacgauuuauuccccaauucucuacccccuuccuuuuaagauggagaagagcuauuugaaaaugauucauuuauaauuucucaacaucuuggaauggaggggacaguagaaauuugauguuuaauguacauacaacacaaguccuucuaccuucuaggaguaaauaguaucccaugcuuucuauggaaaaucgcucuucccuccaacauuagccgugugugugguuuaggcagugaauaccauaaccaaccccagaaacacucagauuggccgcuguagccuaucuuccagacuacaucauugggaggcuggguccauaaagcuggucuuagugaaccucagaacuuuugcugggaaaagugguauacagacuuucucucuucuucugggcuuagaagcagagaaugugaggcuauugcugacaggagagccaccaacuaaguggagccuuaagaauccagaagaagugaagguggaaacugacggcauugagacauggaucaagaugugcugugccuaaagcuaaauauauucuuguacuguuaacucacauaaagcaguagauuuuuggguuuuugacuuaaccaauucgcauugcaucaugugcaaccaaaaugaucuuguuacuguguuggguacuaagagauggccucaguacaaucauagaauguaaacucuaaagaguuuuuauuauuuuugagacagggucucacucuguugcucaggugagacugcaguggcacaaucacggcucacugcagccuggaccuccugggcuccagugauccucccaccuccgccuccugaguagaugggacuaguuuuugguuuugucuuuugaaauggaaaauagccaauuaauuauuagucaaaaccaaaacacucaaaguccauacccaaggaaaaaggaaguuguaauuucugaccaaacuaagaguuucuccuuacaucuauuuuuccucuuguuuucuccaauccucugacucucucagaacucaguccucagugugaugcauaagcaucaccuggggacucauuagaaaugcaaaucuuuaggccuugccccagaccuacagaaucagaaacucuggggguacccagcacuuuguuucaauaagcccaucaggugaucaugaucccgaaaguuugaaaacuucugcucuagccauucuuccuuccuuuuuucugauuuuuccuuuguaaauauucuuuuuuuuuuuggagacggagucucgcucuguuguccaggcuggaguacaguggugcgaucucagcucacugcaaccucugccuuccagguucaagcaaaucuccugucucacccucccgaguagcugggacuacaggcacgugccaccacgucuggcuaauuuuuuguauuuucagaagagacgggguuucacuuguuagccaggauggucuccaucuccugaccuugugaucugccugcuuaggccucccaaagugcugggauuaccggugugagccaucgugccuggcccuguaaauauucuuaacucaccguaacauagaaaucaaauuguuuuaugcucacuguaaacauuuuuaaauuauuugguuuuuaauuuuaaacaauaaguaaaaugcuuaagguauuuuuuccuaaggaaacaagguuaaauuaauuuggggaaaaagauaaugcgaauucaggauauucuagcugguuaaagaaccuggacuuuggagccagauugucuggguucaaaccccugcuaacuacauagguuuaaugauagaaucucuuucacagaguuguugcaaagcagggguucuuaaucugggguccaugaaaaacuuaggggguggggaucgguaaaucugaaugaggggagaaaaaccaucacguuuauuuuugcuaagcucuaaauaaaauguagcuuuucuucaauaaugagugcaagcaaaccacaguaauauuagcagcacagcaauuagaaaugaguauagcaaccagaaauuuucauauuacuuuacagcuguagagaucccgaaauaacuaauuucaaauuacaaugagcuaaauguuaucaggccaacugauaaaucuuguauuuuaauguguuaaaguucauauuacuauuuuaggcuuuuaauauuuugauagcuguacuucaauauaauugguuucauuucuaauccuauauauuuuguuuuauucuuucaaaaacauucugagaaggaacccauaggcuuaaccagaccaccaaaggaguuuuagcauaaaaaauguuuuauguuaagguccccuauuguaaaagauuaaacaugugauuaagaaacugcuuaaaaauugccuagcacauauauaaccuccauaugaccacuagcaauaacaacauugacaaugaugacagugauggugucagcuuuccauucaaguuccuaaaauuuauggaugcaguuuucuuaccauuagcacauaaagcaauucuacuuggcacccuggcauucaguggaaaauguucuggauuccuagucauuuccccaauuuuucaacaggccacgccacuacuuaagaucuuaagauucauuuaaacccuuucaauucauuuucuuucacccuuauuacccuucugguagcuuuucuaaaugccaccuacuugcugauguuacuccuacaccauccuauucaccaaguuggggcauauucauuuacaaagcaaaaggagaucugggaaguaucaugauugguucagggaacaaagaacaaaucacugucauuauaugaagacaacagaagagaacuaaacuagacaaaucuaaggacuauuacuuauuccuaagaacagauguauagucuuacugguauggguaauauaauuccaugugauuuuaaaauuaugaugguuuuugccaguuauauaguaaacuaauaaagaguaaacaguaaaauuuauaaacaguuuaaggaauauacaugacaaaauugcccuaaaucuaacauuauucaagaucuccuccuaaauccacuugaguaccuaauaaguacauucauuauuugaugccacaaggaacuacauguaaggaacuuccagucuaguuaacgaacaaacaugcauacgaggaucacaaaaaaaccacuauaccaagcauuaagugccaagaaaaguuguuagaaaccuuaauacagaaaugugaugagagaccaagaaacaggaugaaacagcugagguuucaagaaaaggaaauaacuacagaugagaauucaaguuagaguggaaagaaaagguauuugaagaaaaacagaguaagcaagcuuagagauggaaaugaacauauauucauagaccaaugugguuggagcagaaagauuuuaagaugaagcuagauauuacaaaccaguugggaaaggaugaauaacaaagacaaucucacuucacaggguucauuugugacuaauuuacagucuaucugaucaaacagguuaauuauuuuuaaaguauguagaaaaaagugaggggggcuuuauuuaucaaaaagauaguuucucacuggcacuaaauuaagcaagauagguacaguaacuuaaaaaacagcugguaguaaagccuuugcagacucaaacugcagguguuucuuuuggauucuuaggaaauucugggaaaucagacuccugccugagaaaucacugugaugaaaauuggaauguagcagaauagaagagugagaauauagaaagcaagcguggaauaagcuuuaaauugcugcuguuguauuauauauggugccauaauaguguauuuacaugacugcucuaaggaaagagaacaagcacuccucaauuuagaacaaguuuggagauucauacugugguuaauguaaggagggcucuauuugacaaagaaaaagacuacauguuaggccgggcacgguggcucacgccuauaaucccagcacuuugggaggccgagguggguggaucaccugaggucaggaguuggacaccagccugaccaacauagagaaaccccgucucuacuaaaaauacaaaauuagccgggugugguggugcaugccuguaaucccagcuacucaggaggcugaggcaggaaaaucgcuugaacucgggaggcggagguugcagugagccgagaucgugccauugcacuccagccugggcaacaagagcaaaacuccgucucaaaaaaaaaaaaagaaaaaaaaagaaaaaagaaaacuacguguugcuuauuuugucucaggauuaaaagugucacacccaagaauugugaaacagaaagcacacuauuagggagacuaauauguccguucauccuaguggaauggaaguuaaaguaccuggaucuaucaaagacauauaaccacaaucaugacacauuaccaaaaagaaaaggugagaauacagucagcccuccaacugaggguucugcaucuguucauucaacuaaucucagguaaaauacauuuggaaaaaaaagagucuguacugaacauggagggacuuuuccuuguuauuauuucauaacaauacaguauaacaacuauuugcauagcauuuacacugcauuagguauuuuuuuuuugagacagagucuugcuugucacccaggcuggagugcaauggcguggucucagcucaccgcaaucucugccucccggguucaagcgauccuccugccucagccucccaaguagcugggauugcaggugugugccaccaugcccagcuaauuuuuuuguauuuuuaguagagaugggguuucaccauguuggccaggcuggucucaaacuccugaccucagaugauccgccugccucaggcucccaaagugcugggauuacaggcgugagccccugcacccggccuguauuagguauuauauguaaucuagagagaacguaaaguguacaggaggaugugcauagguuauaugcaaauacuacaccauuuuauaucagggacuugagcaucuacagaguuuggcauccuugggaggucccagaaccaauuccccacgaauacugagcaaucauuuauugaguauaguauauucaugccgugccuuuugucuuugauguucauaaacucugaaagcacaauuaaucccaucuuaaacaagaaccaaaagcccagaaagguuaagugaucuggccaaggccacacaguaagcagagaggcauggaugcaaccugggccaugacuccaaaucaucagcuuuuuucacugcaccaugcugcccuauguauaguguauucagagaaaaauucacauuuacauuucccauuucuuagaaaauuacagcaguacaaaaaauacguguuucauuuuacuaagguacuuuaaagcagccauaaugugcuuccuccagagaggcaaaucccuuucaguuuacuccaaugggccauauaaauauugucaucuaugugaacuacggcauguaaagaauuaggaggcaggucaggcgugguggcucaugccuguaaucccagcacuuugggaggcugaguggggaggacugcuugagaccaggaguucaaggccagccuggccaaaacagugaaacccuguuucuacuaaaaauacaaaaaauuagcugagcaugauggcacacaccuguaaucccagcuacuugggaggcugaagcaugagaaucgcuugaacccggaggcugcagugagccaagguugcacuacugcauuccagcuugggcaacagagugaaggcucugccucaaaaaaaaaaaaaaaaaagaauuaggaggcacugaagaugaacugcuacaugagucuggagaagaagagaaaaauauuucugcagacauggucagaagagcauuauaaacaaggcagaaccuaacuaggucuugaaaaauggguagagcuuugaaagaaaagaugccaaacaaaacccaaaaacaaaaaccaccuuauguuuggaagaaagugcgcaagccaguuuggcuugggcaaaagacuuggguacuuauacacuuauucauaaagagaagaaaggcuuuaaaaaggcaguuggugccagcuauguacggcauaucuuaaacauaauagggagcauaauaaauggucugugaauaauggugaguguccugaaggacaggcuaaagaauaugaucucuuuuuuuuuuuugagacagggucuugcucuguggcccaggcuggagugcaguggcauggugcaaucucagcucacugcaaccuccauaaccugggcucaggugauccucccaucucagccuccccagcagcugcaauuacaggugugggccaccacacccagcuauuuuuucuuucuuucuuuuuuuuuuuaaguagacacaggguuucuccauguugcccacgcuggucucaaacucuugggcucaagcaaucugcuccucucggccucccaaagugcugggauuacaggcaugagccacugagcccggccagaucuuuuuuucuuuucuuuucuuuuuuuuuuuugagacaaggucuugcuuuguuauacccaggcuggagugcagugaugugauaauggcuugcugcagccucaaucucccaggcucaagugaaccucccgcuucagccuccugaguagcugggaguauaggcaugcaccacuacacugguuacuuuuuuauuuuuuguagagacgggggucuuaguauuuugcucaggugggucucaaacuccugagaucaggcgauccuccugccucagccucccaaagugcccagcccugaacuuaaucucaauaagcaguaagaaaauacaaguuuugagcaaaugaggcaauuuaaaaaaauggugcuucugcaugauuauucuaagcacugauaugucacaaagaaugaaaagaaagacaucaugauacaaaagagggucuccuaugcacuaaggcccuugugggaaaauaggauagggaauacaggcaguuucuguucucagugaacuuccagaugaauaugugugugugugggaagcucugagacaugggacaaguauauuaaaaaauuuacaguacaaugugauacacuauaauaaaugcaacaagguucuauugaaacacagaaaggaguuauuaacucuguuugggggagcugugcaaggugucacugugguauuucagcugaauucaauauggguaagacuucaccagguguuaggagggaggaaggcaccuaaagcaaaaauaaagaaaugaaagagcaggauauguucaggggucaaugaaggggagugcaggaaaggaugguuaagguagguuggggcuggauuauaguaacagaucaaagcacguuaccccguugaaaguuuacguuuuauccuuuuacgugacacagagacuggcagauuuuuaaguauagaaaucgcaugauuauaauugugccuucgcuaauucuagugccacucuguaggccaaacuggaccaagugaaaaauugaagcuagaaaaaggaaaaucaacaauaugugaugaacaaguggaucuggaaggaaagaaggcagcaaaaaaauguaaauaggccgggcaagguagcucauaccuguaguccuaacacuuugggaggccaagguaggauugguggagaacaggaguuugagacagccugggcaacauagugagacccgucucuaucccccuccccaccaaaaaaaaaaaaguuuaaaaaaaauuagcugggcaugcuggcuugcccugugcuccuagcuacuugggaggcuugagccugggagugcaagacccuguuucuuuaacaaaaacaaagaaaacaagaaaaacuuauguuuuggcuagcuucaugccuguaaucccagcacuaugggaggcugaggcaggagggucacuuaagcucaggaguuugagaccagccugggcaacacggcgaaagcccgucucuacuaaaaauacaaaaauuagcuggacaugcagucccagcuagucaggagggugaggugggaggauauuuugagccggagggugggggauggagguugcaguaagccgagaugggccacugcacuccagccugggcgacagagccagacccugucucaaaaacaaacaaacaaauaaaauuuauguuuuauagcugguggacaagaagacugguaauaucaaagaccaaaaauugagaagucaagauaaguagcuuaguuuuagauugauuggcaauacuguauacacacaaauggaaauguccacugggcagguagaaauuaggugcuaaaggaaaugaggaaaagaggucaggaauaaagacacagaucugggaguuguuugaauaaacaggaaagagagugaguaaguguacuuucucaaaauaguaaaugcugagaauugaaccauacauagaaauugaaggaagaaaaagguaacgugauucugaaggauaaaaaguccugaagaaaaugucauuauauuuacuaagaaauuauuggugaccuuuaguauacauauacauauauagagagagagaucgugcaguggcacgaucucagcucacugcaaccuuugccucccagguucaagcgauucuugugccucagccucccgaguagcugagauuacagguaugugccacuaugcccuacuaauguuuguauuuuuuguagagauggggauucgccauguuggccaggcuggucuugaacuccugagcucaagugauuggccugccucggucuuccaaagugcugggauuacaggugugagccacugcacccagcccuucaguacacuuucaguagagcuaaugacaagaaaggggaaugaaagucaaauuaucaggaaaaauaauaaagagaaaauaagaaucuaaaugucauaaacgagacuggauuaaaaaagaaaaaaggccagguguggcggcucaugccugaaaucccagcacuuugggaggccgaggcagguggaucacgaggucgggaguuugaaccagucuggccaacacagugaaacccugucucuacuaaaaauacaaaaaauuagcugggugugguggcacgugcuuguagucccagccacuugggagguugaggugggagaaucaauugaacucaggagguggagguugcaacagugagccgagaccacgccauugcacuccagcuuggguggcagggugagacucugucucaaaaaaaaaaaaaaaaaaaaaaaguugaaagcuggaugugguggaacacaccuguagucccccacuuugggagcuuugggaggccgaggcgagcggaucacuugagcccaggaguuugagaccagccugggcaacguggugaaacuccaucuccacaaaaaaaauacaaaaaaucagcuaggugugguggugcacaccaguagucccagcuacucuggaagcugaggugggaggaucacuugagccugggagguugaggcuguagugagccgugacugugacccuccacuccagccugagcaauggaguaagacccugacucaaaaaaaaaaaaaaaaaaguagucuauuaauauacuuuucuauauaaaagcauuaaaccaagaaggauggaagaauauaaacccauuuuaugauaguggaguggggaugagaagauaugccauuggggaugguggucaaaggggauuuaauuuuaucuaugauguuuccauuuuuuacauauaucuggaaauaaauauaauugaugaugauuuuuaauucugggcauuggucuguaauugucaacauggugaugugauugagaaaaagaggucaacugacaaagaaaaugugaaauuguuuauacagcaugcuccuaucagaguauagcuuccuuggucuucaaagggguauacaucuguggauaacacucucacagaggcagaauucuaauucacuauaccauugugggagggggcuggaagaauagaccacucucucugcucuuucugccaucugaccauucuggggacauucuggcuacacuccuugccuauuuacuagaugcaaguaagugaugcaaaacaaccucaacaaauuaaugcguguuuauuuuaagacgggggaagcagaaguaguuuccaaaagcauuucucaguagguccaggcuucaaaucagagguccauuccugcaguuuguuauaauauucuuugcauuguucucuguaaauucacuccuaacuuugagaaguuuuagagaaaaaugagaaugucgguggucaaagagaaaguaauauauaacaacuucuuauuaaagaauugaagcaaugaaagacagaagagcuaacuaagguucaaaaggccugacauaaaggguuugggcuuaugaaugguuaucauuucagggaaaugauauuugugacacugaaacauucacgacacuagaaaaaucaccccccuuuccaccauucuuguuuccccacaacaacuuaaaagguucaaauaauaaauuuacauaaaacacuuauaguuuauaaaaacgaaaggcaauccaaagaauauauauccauauggucaggagugguggcucaccccuguaaucccagcacuuugggaagcagagguagguggaucaccugaggucaggagcucgagaccagccugaccaacauagagauacccagucucuacuaaaaauacaaaauuagccaggcgugguggcacaugccuguaaucccagcuacuccggaagcuaaggcaggagaaucacgcgaacccgagaggcggagguuguggugaaccgagaucgcgccacugcccuccagcagccugggcaacaagagcgaaauuccaugaaaaaaaaaaaaauuccauauauauauguauguauguauauauauacguauguauauguauucuuuccaccuacaaauauuacaguaaucaaaguuaccaauauaaacaaauaauagcuaaacuaaagugaguuauuugcaaaggacaagggaauucaacuucagcuauuaagaaguugccacaggccaggcacgguggcucacgccuguaaucccagcacugugggaggucaauuccggcagauuacgacgucaggagaucgagaccauccuggcuaacacggugaaaccccgucucuacuaaaaauacaaaaaaauuagcuggccuuaguggcgggugccuguagucccagccacucgggaggcugaggcaggagaauggcgugaacccaagaggcacaguuugcagcgagccaagauugcgccacugcacuccagccugggcgacugagcgagacucugucucaaaaaaaaaaauaaaaaauaaauaaauaaauaaauaaaagaaguugucaccaguuggcccaagugacagagugagacuucgccucaaaaaaaaaaaaaaaaaaaaaaaaagaaaaguugccucuaguuuaaaaacccugaaagauuaaaugguauaaauugaacauaccauucauauuacaauuaaaauagucuucacuuugacaguuuagacaacacaaacaccccuggaauugaagcuccauaagggcauuuuuguuauguucaauucaccacuauauaccaagggccuagaauaguacugggcauaugaagacacucaguauuuguuaaauaaauucaauaaguguaaauguuuaauaauugauuuacugaaaaauaacauuuuuuuuuaagacagggucuugcucuguuaccugggcuguaguacccaggggcacaaacacagcucacuacagccacgacccccaaggaauccuuccaccucagcuuccugaauauuugggaccacaggcaugugccaccaggccuggccuaauuuuuaacauuuuuguaaagacugagucuugccauguugcccacacuggugucuaacuccugggcucaagcaauccucucaucucggccucccaaagugcugggauuacaggcaugagcuacugugccuggccuaaauaaaauacguaacuuaaccuaaaagcaacagaacaauauguaacacacaguuccuuagucuucacgaagauaaaaccugcauuaaagaaauaaacaaaugaacaguuaucugagcuaaauucugucccucaaaaauugccaccaaaaaccagguuggggagaagccaaauucaugaaaagaauucuggguccuaauaggcugacauauuuuagucucuuggcccuguugguauuccucaagugaaccauguugaguaucuuuguguucaacuugcaguagggccagcccaggugaagaaagcuguaaacauaaaguagaugggggaaaaauggccaaacugguuuacauuagucuuaagugccuucuauuuggcuaacauagaguguuuugcuguuuuauagagauguauguuucauuugcuguagcccugugaaguaggguucucauuuuauaaaugauaauauacauagugucagaaucuaaguucaaagucacauagcuaguaaguggcaaaauucgaauuucauacuuucuaucucugagcccaagcuuuacucacuauacccuacuaucucuuaucaugaaagauaucacugacuuaggacuuagggcaguagguuucugccauaucuaaaacauuuaaaaagcuuuaaaauauagaugcccaggcucuacccuacagaaauuuuugaucuuauuggucuuacaguccagcauccaugcauauucugaaaugcuccccagguaauucuaacauggaaguagguugccaacuacuaaucuagacaauaacggucuuugaaagucauguuaaaaaucuaccuuaagguaugucaaaagaguacaaagaugagaguaguacaaagaugagaguaagccagugucauagucaccuacuucaguaaauggcagccagaaucuucgcauuucuguuaauaaguuuuaaaugccucacuagcuuuuuuuuuugagauggaguuccacucugucacucaggcuggaguacaauggugcgaucucagcucacugcaaccuccgucucccagguucaagcaauucucaugccucagccucccgagaguuggaacuacaggcccacgccacuacgccugccuaauuuuuguauuuuuuuuuuuuuuuuuaguagagacaggguuucaccauguuggcuaggcuggucucaaaggccugagcucuagugaucugccugccuuggccucccaaagugcugggauuacaagggugagccaccgugcccaggcucacucuuuggcuucuuacuuuuauggaaauauccaaagagcauaugaaaaguuaggucagcuuuuggacauaagaacuuuucuaggcugggcacgauggcucaugccugacaauccagcacuuugggaggcuaggcgggaggaucacuugagcccaggaguuugagaccagcacaggcaacauggcaaaacucuggcucuauaaaaauacaaaaaauuagcugggcauggugguauguguuguggucccagcuacuagggaggcugagguaggaggaucaccugagccugggaggcggggguugcagugaguugagaucaugccaaugccacugccacugccacugcauuccagucugggcaacagagacccugucucaaaaaaagaagaaaaaaagucacuauguaaaaaugaaaagcaggaggcccucaaaggaaaaaaauuaacuacaaaauaccccacaucagaacagggucucaacagaauagaacuggcaguggcaggugguuuccucugggcauauuuuaauuugccacaauuugccaauuuacaaugaaaggaaaaccugguaaauuaucagacccccuagacaacuggggaaacugacaaauaaguuugugcauuaguucauacaacaaauacuuacugauuaccuacugaguaccaggcucuguucugggauucaagauaaacaauaguaaguuucugcuuccaagagcuuauaaaccacacacauaucacacacauauauauauaaagcagucaauacaauugucaggauguugaccugaaacaagggcuggaugaaucaccaguuaucucaacugaaaaaaaucagugacauaauuccuauuaacugagauggcucaaaauucuaagcuccaaaaaaaugucugucacucuggaaggauguguacccuugggucauuuguguucuggguguggcaggcccaaaagcauuuaacuggguauaaacucaauuaagggagggccuucauuuaacaccuuacaguuggaauuuuacugaguacaaagaguugguaccaccugcugaaauggguggcaaguggugucuauugagaauuguaagcaaccacaaacaucaugaauuagcuuguacaacuugcuaugccaggaaguaagacuuggcucgggggaaauguggaucuagagucuccaaaaacucaugguaggacccacggaccagaauuucaacagcagagggcggugcacccgacuucacaaagaguuuuaccgacuggggccccccaagaaugggcaacuggacuccuguacgagcugaaacgucuucaaugaacucaacgaucgucaaguacacuaaauguucagcguuggacucauuuggcuguuuuccauaaccucuacucuggucugaccguuaaaucucccuugcggauacucugaccuuacaguucggagguggggacgggauggggcgggggggacggggggugcggguucagggaaagugggagaaugaaaucagccuaucaggcuuuccaaaagaaugcuuaucauugguucucagacagagacuuaaaauuauaagggggucauuccccugaaagauaacccgguucuugccagugacaucgcugacaaacacuucacaaguuggggagggggaagggggaggggaagaggguaaggaaaacuaauuuuguggauuaacaggagucccucucaggucaaaacgggguuccaaggaaaccagacgccacuccuuagcuaaguuucacccaaagucuacgacccaggccgcucgcucuguccucccccaggucuagacuccaaacuuuuugccccucucacggcccccuggccguggaacuccucccggcacgccggguucugcucaccaagagccucgagggcgggcgcgggcagggccagagcgagggucggcggcucccggucccccccacagcugcccguaccuguccagcaucugcuguagggcuugguccggcaucuuccgcggagccggcgcacacggccuuccccaguggacccgcucaaggccaggcccagggacaauagcacugagaggcggcggaguaggccgcaguccggcggcagccgcgaacccgucacccagcuucccggggcagcuccgcuagccuggcggcggcggugcagggccugcgggaguccggcggaggcggcggagagcgaggaggaggagccugaggcggggaggcggcgaucgcggcccggguucccguccgucggcccgagguuccgguccauggaccgcgggcgccgaguugcugccggcggaggagcuaccuuugugagguaagagucgccgccuccgugcgcgccaggguuacgacgcagggcggcccagagcagccugggagauguagucuucggaccgucuccacuagaggcugcacagcccgcccggaccaacgccuccgcgccugccgccgucuggccggcgcccucccguuuccuuccuccagggggaaaaaaugucuuucgggccgcuuuccaggaagcagcaggaugcgccgcuccacugucgguagcaacaaggucagcccucccugccuguuuguuuuugccuccgcucuugcccucaggugggaccgagccaggugaggggagggggcugaagggccauuucuuaucaggguccccggccccggccguggcgucggggcggucaguggcggcaguggggguggcagaaacuccuuccgaagcccccggcgcuggagccagccucuccugcgg

SEQ ID NO: 18814 - RNA, 473 nt, Homo sapiens
uccuuuuuuuuuucuguuuaauuuuuaaugaccaaaacgaagcaucuaaaaccgcagcuucuggaagaaccgcuuguucuugccugucuuguaucucucuucaaacuugaccuuggccucucaucgggccuuguguuuaagaguagggucucugaagacauccuuauugaugacaguuuuguccaaggggauauccacagaguaccuugugggcauuagcugauugugguuauaaacuuucacaaaagacuugaucuuugaccucuuagagaucuucuucuugcccauggcagcugucacuuuguggggacagcggucaauuccagccaccagagcauggcuguaggggcgaucuaagguaccaucaucaauguucuucacgaugauggcuuugcauccagaauagcauccagccagaacaagcaccaccgucccagguuucaugaacuugcccauuucagcagcaaccccuc

SEQ ID NO: 18815 - RNA, 1636 nt, Homo sapiens
ccucuucacucugggccucaguuuacucucugcaaggaagcugucuugguccuuuccagcucugacacuccauccagguggguccgggcuguggggguacagugguggccucaggcaguggugcucuggcugugccaaacuguggguguuugccugaaaggcugucguugcaguccccugagcaccaugcuugguggcuggguggcuccagauaaaaaugggcauuccacagugaacauuuguggcacauugcgugccaggguucaggaggcaucaaagggacugggauucuacccuggaggggcuccacuuggagaggaagggggccgggacugacagccucaucccacuuguagugugacagccucaucccacuuguagugugaagagagugaucucuagugcuggaugacaccaacacauucugagagcuggaguuugaacuggagcagugaaagguuuggacgggagagccuauuacagagagagcagacucagacaaagguggauguugagaagugucuugaaugcggaaucagucuuggaaugcaagcuucauucugcaggcgcuggagugcccuacaagaccuuagggaagcacagaaccaggguggugagcagaggacaggaaagggucuuagccaccuccaguucacagaugagaacacugaugucuagagaggaaagagagcuccugggaugauuccaagauguucuguucuccaguuagaaacuuugaguauucacccuggaacuugauaugaggguagcaguguagucaggggguuggaagacguaucaaaaagccaaaugguugaaaaagcuaggggugggcagagggaacaugaaaacugccuuucagcauuuuaaggauggccaguuugauucucaugugcgccuucuuaaagugugguaccaaaucugaacauuaucguccagcugauggaugggaaggauggcaaguuuucaguucaaugcaaagaagagcucuaccauggaacugaccucgaggaauugucaugugcauuuuucccacucuagcagcugggagguguagcacuagaauuuaggucuccucaucuaaggucagaagaaaaaaagacaaaaccaaacgggaacauaacuaauaguuaccguuuacugaacacucauaugugccaaguccuuaauuugaauccucaccaacaaaggggccauuuuuccccucauuuuuucaaagaggaaacugaagcucagagaggcugcgcaucuagcccaaggucauacauuucaccagugaaggaguugagauuggaacacagagcuuucuccugguuuccggguuaaucgcggauuccuccugguuuucggaagccugauggaagcaccaggguggagggucaguucagggcccccccguuuccaggugccucguggucaggcugaucuccucgccucucugcagggcuaccagauccccaagggcuggagcgugauguauagcauccgggacacgcacgagacggcugcgguguaccgcagcccucccgaaggcuucgauccagagcgcuucggcgcagcgcgcgaagauucccggggcgccuccagccgcuuccauuacaucccguucggcggcggugcgcgcagcugccucggc

SEQ ID NO: 18816 - RNA, 3675 nt, Homo sapiens
aguaccuucaaauuuuacuuuauuuggaaaugauacaaauucauuauuuuaauauuuaaagauugugguaguauagucaaaacacauaaauauuauaauauacauuuagaaauuaaauauaaagucaacacaacacuccuuaaaaacucauauguacacuuccaauaagucucagguuugaacauucaagcucaucagauuuccccauggaaaugggugaaucuugcagggagauuguccacaggauacacggugggacugguuuucauuguaggagguccauuuagaagcugccagucacaaugccuggccagcuccacuguaaauauuuugagaagaauuuuugcaaauucuuugccuacacagcuccuaaggccuccuccaaauggaaugaagcugaaccuggaugcauccucugggugaggcagcaugaaucggucaggauuaaauucuuccuuguuggugaagaucucugccacaucaugaguaucacagauacuguagauaacauuccagcccuugggaaucugguaucccugcaaaagauuaugaaaccccaagggcugacaaacuggaauuuaacuuucaacaacaaaaagcagucacugauaucuuugggggaaauuaugagcuaaaagcaagggagagguagaaagagagagguggauccagguugcugaaacauaucuccauauagggcagaacaauuaucaaaagcauaagaauugcagccacagcauagggaagaaagaggaguuuuuaaaccacaacaaaagggagaaagaagagaauuuuaacuuacauuuaauucaaaagucuucagagcaacccgaaacccuccuggaacugggggauucagucgaagggucuccuuaauaacacacccgauguauuuaaguuguuccaaaauuuccauguccaacuuguugucuugauugcucuugcaaaguaaacccuaucaaaacagucauacagaggugaacaguuauuuugugcuccaauaaaaucagcccagcagacguaaacagggcuuaaguggagacuaaacccaaagggccccaugaugggagagacugggagggggaaacagcagcuaauggccauuugccugcccaaauccacuaucuauuuacaaucccaggagaaugcugcucaccaguuagaaggaccaaguuucuccccacgcccccccaccccacacucaccaccaccacccacacuaaucagcuauucacacuauguaugcccuuggacacaccaauucaagaaaguggaaccuaucugagaaucuccacgguucagcaaaagguggaggagggguaggaauacaaggucaaacccugcccaagugggcucacagcucaagacuccauccuguuuauucacaaagcuaauucugcccacuggcccacgcagcccugggcccugcacuuucaaaauacuccaugaaggcagcacacugacuuauucggaaguuggcuagggagcagcugaauuuccuaagcuaauaaggacacccccagacccagucucccuaccuuacucuucagcucuucucgcacuuucuggagaacauguggguagagccccagguaagugaucagagauguggcugcacuggccgugguuucguguccuccaaagaggaguucgguugaagauugcuuuagugccuaagaauagagugagacccacauucucacaagucugccugcgguuugacagaaggauuacucagaaucgaacugagaguucuggagggaagacuagaagggcuaaauguuuugcugacagaaagucaaggaaagcaauaucuuuaaacaaaaugcaacgucccuuuaguucagcuggagcaguaaggcgaguacgaccccgcucuaccggaaacuccugaguuaaagucuuaguuuuauuaaaaucgcaagguucuuuauuaacauuuuugcaaauuccaacuuucccuuugaaaccuggaaaggcuaggggaugcucccaguuccgccgcagccccuuccgcagcucuccugaccgggugucucagccuuccuucgggauuccauagcuguagucugagccggccgcccacuccagaaagcugggccccaggcgcgcgcuuugggggccccaggaacagcgcuuggaaagccaggggaccaaacuccgcagugccuggucugaagcugcuacucaccugcauguccagccgcucuccccucucccacgagugcucgaucaacagcugcagcgcgucuuugcagcccuggcccgccucggaugcccgcagcccgcagaucuuggcgcgaauguucugcucgaugcgcgcgugaaugagguuccgcgccuucaugcccugagcgcagagagcgcgcggcggugagcagacgcccaggucccgcgccccuaguccgcagcccguuugccgcccuuacccgguacagcccgcugaagggcacgucgaugggcagcgagaagagauugcgggucauuuccucgaaggccuccacaagcugcugcucggaguccccgucgcccgccaguugggguucgcagcccaguaggaugcgcauggcgauucggaacaugaggcgcuucaccucgggguagaccaggaggccgcgcucgccgcagcucagccacugcuccaggcugcugcccacuuccucggugaucaccggcacguagcauucgagugccucgcggcugaaggcccgcauaaucaccugagucccgaggaggggacagcguuaaaagccuccauccgccccucucgucuaccgccguccccuuccagacacccccaguccugccagacacauggcacucuccgagcugggaaagcuaaccuggagcuggcagaggguccuagcccaccucaagcugcuagcccgcgccuagcauccaucagccggaauuccgcucauaaauggggucccccucccuguccagccgucgccuccugcccccaccuucuugcgcugcuugugcgaggagucgugcagguuagagaggcagccagaucccagaauggugcgcaccgacgcuggccaguggaccgacaccagccggugcucuccgagcaagaugcgccgcacauuguccgcgcccaucacccguacggugggccgcccgaacagaugcgucuuguagaugaagccguauuuccugcgcuucaucugcaggaacuuccuccgcugugggaggaaggcggaggagagaagugggcaugagggggcgccggggagcgccgcgcucccgccagcccugcuccuagccgcaauagcaugccucccgggggcgccuaccccgacuucagcagaagcccagagccgcgccgggcuccggggaagcagccugucccgccccacccucccuuaccugcaguaccaucugcaagguuuccccaaagaaggggaagcccauagucccggggggcaaugggagggcacaacugcggucgcggccgcucacgcaguacaggucccagagcuugaucgcagccaggaagagcagcagcggcagcacgaaggugcagagcgcacuggccagcagcgccgggagccccauggcgcgccgcgaccucccgcgccaccugccgccgccgccagcgcuucaaaccccacggcgcugccgcuuuauaggcggcccagguugcugcccacguuaccuuggucagac
